United States Patent 9,328,346 (POLYCOMB-ASSOCIATED NON-CODING RNAS) - sequence listing, part 133

SEQ ID NO: 191664 - RNA, 68893 nt, Homo sapiens
ggggggaggcguuccgguccccaagagacccgcggagggaggcggaggcugugagggacuccgggaagccauggacgucgagaggcuccaggaggcgcugaaagguggggguagcugcccccucuccauucccccucaccuucuccggcucgcucuucucuccuuucagggcggaugguuccgaggaccggggccgggcgcggcguggggagagugcuucccgggcucccaucccccuccaccuccccaggggcggggagcccugugggcagcucucucccgccccgcucuggcuuugugucggccgccggcgucugggcugggggaggggagccggggaaacucuugcgggggccccagucuuucucccacccguucaggggacgaguggcggacccgcagaccccucccucccagauauccucuuuucuccaccaggcuacccguacgcuaggcguuggggugggagaaaaaguaaacgguuggugggggcggggguaggggguagcaucgcaacuuuuaaguugucucaguaugccuuuuucagggcuuuugaagucaucuuuccgcgcccuaauuucgaggugguugccuucacuguucuugauugcacgccuuccacgcaacaggcuugagaacaguggcuuacaaacuucgaguagagagauuucagcguuuugagaauuauucuuugacauucagaaucauuuggggacggcaacuugggguaguuggugcuucuuagaaaggcagauuuauggacuuagaugaacaauuggugggagucggggccuggggauuuuuauuuucacuggauucccagcuuaauauaaugcugguguucccccggaccacacuucgagaagcacugcguuaaaaaugguuugugaaguugagugcccccuuuaggaggauucuuguuaucuguaaagagggugacauguuggaaguagaacuuggaggauugaggugguaauuugguugagaggccuuauuuuuuuaauuuuguauuuaauugauuuuuaauaagguaaaggacuaggaggaaaguuuguuuuuagagcgcuuuugagaaaacugauaacguuuuuuuuucuuccuucaucuagauuuugagaagagggggaaaaaggaaguuuguccuguccuggaucaguuucuuugucauguagccaagacuggagaaacaaugugaguugaaaacaugcauuugucguuauagaccagugcauuauuaagaauugcucaggaaagggaaaaaaguauauuuugggauaauuaaauaauucauucuaaauuguagaaguccuggucauuuaaauaauuuauauauuuacauuuaaagaacguauacgcuuacuuacuuuauacauggucuguaacggauuuuaaaaaccuguguauguuaaaauuuucuuuauagcuaggcuuuggcacgcuuagagaauguauuagucuuaacgagccagagaaaggaagaaugccuauuccauuaugacccuuuuuggccauaacaaauaggcuuauuccuagaauuuuguggcuuugauucuguuucagagucuuggugguauuuucucauauugucguguguccagccuuuuuuuggucauauuugcauauguagguguuuaaagugucacuucuauuuaucgucuggaggacucuguuauuaucugacaaauuccagaugcuacaguuuugacuuguagacuuucuaagauagcugacuuguuacauaugcucagcauuuuauucagcucguuuccaaauguucugaaucugaaacuuacgcuauaaaguuagggcuguguucagaaggaacauuccaggucauuguuuugcaguuugugugguagacacaaucuggcuaaguuuauuuguagacaacagugcaucuuugaugacuucuuuuuguagucuuugggugggggcuggggcagcaggaaagggguagguuucuaugguuucaauguuaauaaguggguuaucugcccaguaugaguguagcuuucagcaagaauuguauaauuucucuggcuuuauuauuagcaaguguucauuucucacaagauuugcuuauuuguagucuagccuuuuaacaacuagccuaauuuuagaaagaaaaaaaccuuugcugccucagugcuugauuuaauggucaugccugcaagcugagucuccuuaguauucuauuaaaauacaccagucauuuugagaacgucagugugauguguucaauguuguauuucuauuuauuacauuaaaaaaugggacccucugggcgggggaagucauuuuuaccuucgcauuaggguuucauauagaacaucuugauuuagaacaauguaaaacuguuaauuugugcuuauauagauaagccuaaaaaugaccacaugccaucuuucaaaaauaaauuaaucccuaaaacauaaaugcuuagacugccacuauuccucuugaauugcuagucggcacagacuuagcccugucaacaaugucaagccaaauagcauuuuacuuuuggcuguuuuuugauauacaagaugauaucaaacuauuuggagaugaguacuuaaaacgucuuacucaguuuaucagguuuguacacacugcuuucccuuuuugauaaaguacauugccuauaaauguauaaauaauugaaaguuucuaaaagauagcuuuuuaauauccugucuuacuggaacaccaaguggcuggggaaguuaucugauuuuuuuuggacaguuauuuuauccugguagaagaggacuuaaaauucccaauccuccaccccauauucgguguuuauguauucacuaagcauguuuuguacugaaaugauugguguaguuagauucuuauauucaauggaauuuggaaaauauuuuuuauuuuauuauguaaauagcagccaguguuuaugcauuuagcuuuaagcuuugauuucuuuuuaucaacauggcauaucuuugauacugacauuugcagaguuucugcuaccuauuuauggcuaaacuaagcuuugucuaguaugugagauuguaacgagagaaugaaaaugaaaauuuaaagaacagcaauuuagacuuuucugauguuuuaggauggguggauugcuuaagauaagcauuuccaccggaugugguggcucaugccuguaucucagcacuuugggaaacagugggucacuugagcucaggacaaaaaauuuaaguuaccugaguguguugguacaugccuauagucccagcuucuccagaggcugaggcagaaggauuguuggaaugugggagguugaggcugcagugagccaugaugguuggugccacuguacugcagccugagugacagagugagacucugucucaaaaaaaaauuucauaguuguuuuuauuuucacugaugcauuauagcaagaaagcauuaacagaaguaguaugugaaacuguuuauggaucaaaaucagugaccccccaggcugcuuaguuuucuuuucaaaagacaauugauuugacacuugcuuuuagcuuuagagagguuuuagaauuguaaguauaggcuuuuacaauggaggagguuguaggaaaaauggaggaggccguaggaaaaauuugaacauuuuuacuucuuagucuauuaaaauuaccuguaaacaucugauguaggaaguuaggaaagaugccaagacauacuaaauugaugugaagagggaaacuauauauguauauaacuaaaauaauuaauccccaggugaauuguuucuggccacuucaaaaaauuguuuuuauguuggaaagaauacacucuucugaagguaauguaguuucugacaucaugcuaaauauauaguaugcgcugaauaaacaggaacauaugguguguuucaaucaugaauuuaaacacuugaugcauuucagucauggauuuaaagguauuugauggguuugaguugcaauuauuauccuuuuugacggucaaguugucucccauuuggucagugguagccuuuuccaguuggcuccagaguccuuuugacgugaccuuaguaguuuuugauaguauccuuauucucugguauaagaauauguuccaagcucauuuccugccccagaugugaaucagauauuucucaagaagaccugccuuuuagugggaaauggcauuucaagacuacaaucuuggugguagagaaguuuauuauuacucagcuacauaaaauacuaagacuugcaauucagaaugaggaauacagcguuuuaaaaaguuuuuuuuuuguuuagguaaaauauacuuauauaauuuacuggccaggugcagugauucaugucuguaaucccagaacuuugagaggcugaggcagguggcccagggucacuugagcccaggaguucgagaccagccugggcaacauggugaaacccgucuuuacaaaaaauauaaaaaauuagccuaacgugguggcaugcgccuguagucccagcuacucccagcuacuugggaggaggagguaggaggaucaccugagccugggagguugaggcugcagugagccgugauugugccacagcacuccagucugggcaacagaguaagaccuugucucaaacacacacaugcacacuugcacacuuauguaauuuaccaucuuuaccauuuuaguuuucuuucuucuuuuuuuuuauuuuuuugagauggagucucgcccuaugccacacuggaucguaguggcgcgaucucggcucacuucaucccccaccuccugaguucaagcgauucuccugccucagccuccugaguagcugggacuacaggcacacacaacuaauuauuguguuuuuaguagagacaggguuucaccauguuggccaggaugaucucuaucucuugaccucgugauccaccugccuuggccucccaaacugcugggauuacaggcgugaaccaucgcccccggccccaucuuuagcauuuuaaguguacaguuuggugguaauaaauacauguauauucuuuuuucuccccuuuuaucucuccuguuccuugcucagucucuaguaaucaucagucuuuagacucuuaccuuugugagauccacuguuguagcucccacauaugugaaaacgugauguuugucuuucugugcuugacuuaacuucacuuaacauaauggccuauaguuccauccauguuguugcaaaugacaggaucuaauucuuuuuuauugcugaauaauauaccacauuuucuuuuccauugaugggaacucagguugguuccuuguuuuaaaaaaauguauuuuugaggcaaggucuugcuguugcccaggcuuuagugcagcaacucagucauagcucacugcaaccucaaacucuuaggcucaagggauccucuugccucagccuccugaauagcuaggacuuacagauaggguacaugccacgaugccuggcuaauuuauaauuuuuuuuguagagacaaagucuugcuauguugccuaggcugaucuccaacuccuggccuuaagcaauccucccagagugcaaagauuacaaagcaugagccauugcacugagcugguuucauauuuuggcuguugugaauagugcugcaguaaacaugggagugcacagggauuuuucuuuucuuuucuuuucuuuucuuuucuuuuuuuuuuuuuuuuuuuuuuuuugagacggagucucgcucugucacccaggcuggagugcaguggcgcgaucucggcucgcuacaaccucugccuccuggguucaagcgauuuuccugccucagccucgugaguagcugggauuacaggcaugcgccaccacgccuggcuaauuuuuuuguauuuuuaguagagaugggguuucacuguguuagccaggauggucucgaucuccugaccucgugauccauccaccuuggccucccaaagugcugggauuacaggugugaaccacugcgccuggcccaggguuuuuauaacuuuuugcauaccaggaauccugguucucucaagaacacaggcaggguaugauagaaucaggaugucuuguaauuacugauuguaaccaacauuacacaucagaaagucuaaaauaauaaugcgaauauuacugccaccaauauaauuacuaggaauguuaaauuuuuuuuuuuuuacauauucucuauuucuagcccccauuuaaaaguuuuucugucucccuugucugagcauauugcuauuacguaacuuucccuuuuguuuuuuuuuuuugagacagagucucacucuguugcccaggcuggagugcaguggugcgaucacagcucaccgcaaccucugccucuuggguucaagugauucuugugccucagccuccugaguagcugggguuacuggcacgugccaccauugccuggcuaauuuuuguguuuuuaguagagacgggguuucgcuguguugaacaggcuguucucgaacuccuggccucaagugauccucccccugccuuugccuccaaaggugcugggauuacgggcauagucacugccccggcugacuuucccuuuuaacugucaaucuuaguuuuacaguagguauauaucucaugccuacaaccaguccuuaugucauugucauuguauucucucugucucucgucaguuugguugucugaaugaagcuuauucuuuaauagauuauugaaaagcggcuaauugaaacaauauuucuggaguuuuuuuuuguuuuguuuuuuuuugagacagagucuugcucuguugcccaggcuggagugcaguggugcgaucuugacucacuacaaccuccaccuccuggguucaagcgauuuuucugccacagccuccugaguaucugggauuacaggugcaugccaccacgcccggcuacuuuuuuguauuuucaguugagacgggguuucucugugauggcugggcuggucucgaacuccugaccucaggugaucugccugucuuggccucccaaagugcugggauuacaggcgugagccacugugccuggccuaacuuuuguauuuuuaguagagaugggguuucaucguguuggccagguuggucucaauuuccugacuucaagugaucugccugucucggccucccaaaguguugggauuacaggcaugagccacugcgccuggccuggaguucuuauguguaugucuuguauguugucugugccuuuuauucuuuuuuuuuuuuugccccccuuuuuauuuccccuuuuuguugagcauggggucucgcuauauugcccaggcaggucucaaacuccugggcucaggcuauccucccgccugugccucccuaagagcuggaauuauaggcaugagccaccgugccuggcaugugcccuuuaaucuugaaggucacuuuggcuggaaguaaaaucuuugguucacauuuucuauccuugagugucuuaaguuuguuaauucuauuguuuccccccaguaaaacuguuaaaaucuauuuauuuuugagacagagucuugcucuuuugccccgguuggagugcagugaugcaaucuugguucacuguaaacucugucuucccaccucauccuucccgguagcugggacuacagguauaugccaccacaccuggcuaauuuuuguguuuucuguagagaugggguuucaccauguuuuuaggcuggucuccugagcuugaacucccgagcuuaagugaucugcccacuuuguuggccucuuaaagugcagggauuacagaggugucaccaugccuggccagcuguuaacaucugaugauaauuuuuuuuaccuuauaaacugcccaaucuuuuugccuaccuuccuaaaagauuuuuuucuuuaaaauacagugugggguguguguguguguguguguguguguuuguuuguuuguuuguguguguguguuuugagucggagucauguguguguguuuguguguuuugagucggagucguguguguguguguguguguguguguguguguguguguguguguguuuugagucggagucuugcucuguugcccaagcuggagugcaguggcgccaucuccgcuaaccgcaaucuccgccucccaguagcuggcauuacaggugcccaccacuaugccuggcuaauuuuuguauguuuaguagagacgggguuucaccauauuggccaggcuggucucaaacucuugaccucgugaucuccccgccuucgccucccaaagugucaggauuacaggugugagccacugcgcccggccaaaauacagugguuuuuauagacuagaucuuuaaaagcauuuugaaaaucaauguuggauauuuuggagucauuguacucagguauaugguguggucuuuuuuuuuuuuuuuauccacuuaucuacacacuggugguguagucuuucaauaugaauuuuuaaauuuuuaaaaaauauuaaauauuucaagaaagugaauuguugucuuugguuuuuuuguuggggaggggagggagacuauauugcugcaucuuugcauaucuucaguacuuaucauuuugucuugaauucuucuuuugaguccuuuuuuaaaaagcaguguuacgggccgggugcgguggcucacgccuguaaucccagcaguuugggaggcugaggccggcggaucaccugaggucgggaguucaagaccagccugaccaacauggagaaaccccaucucuacuaaaaauacaaaauuugcugggugcggugcaugcuuguaaucccagcuacucgggagaaucaccugaucccgggaggcagagguuacagugagccgagcucacgucguugcacuccagucugggcaacaagagugaaacucugucugcaaaaaaaaaaaaaucaguguuauugagguauaauugacauacaauacacuguauuuauucgaaauguacagguugcuaaguuuucauaucuacacucaggaaaccaucacaacaaucaagauugugaacauguucauucauuacucccagaaguuugcucaugccccauuguaaucuucccucccugugugugcugccuucccuccaagcaacuuuuugucaauguagauuaguuugugaguucuagaauuuuauguaaauggaaccauacaguauguauucuuuggcuucuucuauucaacauaguuuguauuucuuuuuauuucugaguagaugcaucguaugaauaugccacaauuuuuuuuuuuuuuuuuuuuuuuuuuugagauggagugucgcccuguugcccaggcuggaauacagugguaugaucucggcucacugcaaccucugccuccagguucaagcuauucuuccgucucagccucccugguagcuggggccacaggcgcgcgccaccaugccuggcuaguuuuuguauuuuuaguagagacgggguuuuaccacaugggccaggcugacuccugaccucguaauccaccugccucggccucccaaagugcugggauuacaggcgugagccaccacacuuggcccagaguagcuuuucuaacuacauggagcacucucguugguuuugugaaguguuuuaagaacacggcaguuugcauucugaaauuccaggcuguguucuccacuucugcuuuuuuuugaaccuugucuucauuucucuugacucuuucuccucauuguggggcuuaccucuagauuggagcacuguugggucacuuucaagagcucaagugagcaagaccugcuucgucuuuucgaacucagagcagucuauucacucauugcuagaguuggcaaaauccaucucaguuucagcugcuguucucaaauuggucugcagugauuuccaaugaguaccuguuggcuauuuuaugauucuccuguuccuaggccuuugaaauacaccuugacuucucucugucacagaucccaguaauguugaggucaugugacuaucaguuuuuccucauccacuuuuugagucugugggaauacugugucagcuaguuuuguuguaaauaugguccacugguuuuugguucugcucucuaguuuggucagccauaagguuuuagagagaugaaaaacuguagcaccacugccacuuucuuagaauucugcuuuuuaggaaaacuuuuacaucccuguuaagucacuucccucauuuauaaaaugagauaauaauaguaccuugaagugugggcaggcaauacauaggaaacucagcacagugcuugguaugcagaguaaaugcuugauaauaauacucguuguuauguuguugauaaugcauauuuugauucugcuuuuuuuucccccucuacaguuugaaguucuuuguguucagguauuuugacaaaacaguaagaaaauaaaaggugguuuaaaaguaguuaucgacaacuaagacccgcauuauuacaaagaaauucuccuuaagcccaugaggcuguuagauccuuuugugagguuucuuuuaucuuuuucuuuucuguuuuuuucuguuuuuuguuuuuuguuuuuuuuugugagacagagucucacucugucacccaggcuggaguacaguggugucuuggcucauuugaaccucuggcucccggguucaagcucccagguucaagcgauucuccugccucagccucccaaguagcuggaacuacaggugcgcaccaccacgcccaguuaauuuuuguauuuuuaguagagaugggguuucaccauguuggccaggcuggucucgaacucuugaccucaagugaucgacccgucucggcuucccgaagugcugggauaacaggugugagccaccgcgcccggccucuaugggguuucuuaagagggaauuuuguuuuauuuugucuaacguaguauuucuugaaacacuuugaaaauuauuucuaaaaugucagccaaauacuaccuuuaugaauuuuuccacauucuuguaacaucuguacaauuacuucuuuaaugcuuuuuuucaggucagcugaguuuuuuucccucaaaauuuuuuuuaaguggaaagacuauuacagauaaaggucaaacccucaacccccagcccccacccccccucccauaaccacuguguuaauuuuuuucccuuaaucuugcuuugggaaauaagaucugaagccauuggcuugguauagugguuacguuuucugagucacuuuacaaucuauaaauacuaaaauuacuaaaauaugaauuauccaugugucaccuaaaguccucucaugugcugucaucacagugguacacagaggaagcacaauagauuuucaguaaauauaaguugaauagaugcccuuuugcuucuguauauuccagugagugaaguuauuaagauaugaacaugaauaaaauuauaguuuucuuuuucaucacaucauguaaaccugaaugguacacuggaaguuaggcacgccaacuuucugaguagaguuaauuuuucuuaucuucauucuuucgggugcccaaauaagcucauguuuuccauggucgguuuaguuuuuacuagucguuggcuaguuuccuaauugcaugugaguuagcauguggugauggcggaguaaugucaugucuuggagagaacauugcuugaguuccaaacuuagcuuuucuacuucuuggugagacuuuggacaaauuauuugugagcuuguuuccucacuuaaaaaaaugggguuuguaccuuuaguuguuucaacuguugugaggacuugaauaauaaaguauauagcuauagauaagaaaacuugggggacaguaaaaauuaucuguaugcugggcauaaauagaaugaauauggcuaaagaaacgagucuaaaguacuuaaucuuguggaaugaacucugauuggacagucaggagagcacaaaacagauuuagguuugaauucugaauuucaucacguaguuacuauaugaccaaggcugacuucucucccuuaauuuccagguguguaaauauagguaauaaaguaggucuauuuaaagggauguuguggggauuaaaugaguuuauaaggugcuuaaugcagcgacaggcagauagugaguguccuguaagugggaguuacuguaacuaauuauucuacuuuuagugauuuucaucacuuaaguuacuguuggucacaguuuccucagauacuaaaugagaggcuuguaauagaugaucuccaagguuccuuccagcuugaaagcuuagaggaaucucugugcugcagcacuguuugucugggggugguauuguagcaguagcgacuacgaguggggaaugggacauggugauagugcuuaguguuaaagugucugauaauaauaugagauguuaacuguucgggaguaauuaguaauuggugaaugguguggagacauuaaaaaguugagaagcaguugucuauauugcaugagaaagagcagucaccacuacuacuaaacucuuuaaagucacaaagagguucuuaaaauaucuguuaguuuuaccuguaugcacauguguaucuguaucuacagauccacuuagugucugccagugaauguauggaaucauaauguuuauggacuauuacuguauaugacauuacuggauaccugucaaaaacuucauguugcuucaaaacaucauuaguaagcuucagaucucauuaguaagaagauaaggaauuuauaguccacagagcaccuugcuuucucucugcuuguagacuaaaggucuuuucccuuuuugauguagaaguuuguuauucaggauccauagcaaaaaacugaaucgcugacuaaaacuaacaguguagauaauugagaguguuuacuguuuaauuacaugugccuauggaaaacauuauauguugagaaauguauuuuagaucuucauuuucaccagcucucugauguguucguuugcuugucuucucucugguuucacccaugagcaguccuguugaugugucaggcugcccagguuuugcauugcuuguaauacauguguguggaaaucuacauguaaccacuugcacauuccaucccuaucggauaccuuggguaaccuauuaccugaauauuaaauauuuuugagaacucacaccauugacuauaaagugaauaauagcuaauucaagucucaaauuaguaaugauaugaaacaguaguaauaaugcccuuagugguauuuuuuaaaauguggcauggaaguagggcuuuuucguuaucaguuaaccacuuaacgcaaaaaaauagaaaacuuuuuuguuuuguuuuuuuugagacaaggucuugcucugucauccaggcuggaguacaguggugccaucauggcccacugcagccuugaccucccgggcuuaaaugauccuccugccucagcccccgcccgcaguagcugccagaggcaugugccaccaugccuggcuagaaaaauaaaaagcuuuauugagaggcucuguagagugaagagccauuugcagcuauaagugucauaguaucucucuugucucuaugcuuguaauuuguuugaccguugcuuagaagacagucaugguuaaaacucuacuucuuucaguauaauuuacuugucucucucgcucucuuuuuuuuuuuuaagacagagucucacucugucucccaggcuggagugcaguggugcagucucagcucacugcagccucugccucccgguuucgagcgauucucuugccucagccuccuaaguagcugggauuacaggcgcccaucaccgcuaauuuuuguauuuuuaguacaccauguuggccaggcuggccuucaacuccugaccucagaugauccaccugccucggccucucagagugcugggauuacaggcaugagccacugggcucagccuuucuuuuauuccuaaauggcaaauauuuaaugaacauuuauuuugugucagacauuaucaaauauuucauaugcauaaccugauuuagucuuuacaacuacuaucugaaguaggucuuucucuuuuuuaaaaaugaggcuguugagucuuagaaggcuuaaauaauuuguccaagguuguacagcuaaguaauggaacuggguuuuauacucaggcauucuggcuccaaauccucuuguaauuugcauuuuauuaauauauaccauuugccccuuguucaguugucuuacauccuccuccucuacuguaacagugccagaaucuuuucaaaaccacuguuagaaugcggagcuuucaggccaggugcgguggcucacgccuguaaucgcagcacuuugggaggccgaggcggguggaucaucugaggucaggaguucgagacuagccuggcuaacauggugaaacccugccucuacugaaaauagaaaaaauuagcugggcaugguggcaggcgcuuuuagucgcagcugcucgggaggcugaggcaggagaaucgcuggaacgcgggaggcagagguugcagugagccaagauugcaccaccacacuccagcuugggcgaaagggugagacagugucucagaaaaaaaaaaauuuggagcuuuuugcuuuuguuaggacucuuauaaucguuauuucuguaauuucugagauuuuucaaguggcuuaccuaagcuugaccucauguacugugggguauuuuggggcaauuaugagaagguugagugugggucaauaagauagaugacugauguacccuuaacauuuguaauuuugacuauuuuccagucaccucaaggaaaaaaacuuuuaaguaauuguaauuuuguagagacauaaauuugaaacauacaggugaugagacugauacguguauuuuaacuugaagugacucuaagcuuucuauuuaauauaugcaucuuggauuuguuauucucaguuaaguaaaaaucuuaccacaccaauauugggagguaguucuaauauucccauuuguaggugaugaaacuggagaaaaauauaugcuauagaauuugaaauuuaaggaaagugcgaggucuuaacauuuguaauuuuugcacuauuguguauaucugggaggaagggggagagugagguagcuuucuaucaacuaauggcaaaguacgguugucccuuguuauaugugggugauugguuccaggaccuccuuuggacauaaaaucuguggaugcucagucccugauguaaagugguauaauauuugcauauaaccuuugcacauccuuggugcaucucuagauuacuuauaauacguaauacaauauaaaugauacguaaauaguuuuuauaccuuauauuguuuaggaaguaaugacgagaaaugucuccacauuucaguacaauuuuucucaaauauuuucuccuucuuuuuuuuugagacggagucuugcucugucacccaggcuggagugcagcggcgcaaucucagcucacugcaaccucuggcuuccggguucacgccauucuccugccucagccucccgcuuagcugggacuacgagcgccugccaccacaccuggauaauuuuuuaaauauuuuuaguaaagacuguguuucaccauguuagccaggauggucuugaucuccugaccucaugauccacccaccucugcccuccaaagugcuggggcuacaggcgugagccacugcgcccagcccuuucucaaauauuuucaaucugagguugguuggauucgcgaauguggaacucguagauacagagggcgcacuguauuucuauuuaaaauugugcaacuaaagggaauuuaauauuuuuagagauuguuuuauuagggauacuguugucuauggugauuuccaggguggcuuuugaggugguggccguuuuuguuucaaagagauuuguuaacuggagacugguccaccuuuucuagggcuuuugcauacuagagugugucuugcuguaaggagcaaucuuaaauguagguagaauguaggcuuuuuuuuuuuuuuuuuuaaaccacccuuaccagugaauacuaguggugaauuugagauuuucauguuuguagggucauugcaagacaagucguguuucuuuuccucuuguguagauacugauacuuuucuagucuugcccugccugcuuguucauaguagagaguuuuuggggaugauaccuuguuaaguugucauucaguuuucuuguaaauauuguguguggucuuugguuuugcuauguugcuuuugguaggauauggcuaaaaucagugccauagccagcaugugguuacuuuaaaaauuauuucugacaaaauauuagaugguuagaugaacagguaaaauuuuaaaaguagcuuuaaaaacuuggauuuaaaauauggagaauaucuugauauaugcuuuuucuauuuacaucuucauuuugguuaaggaggaauuuggugagaauaacugcauuuugaguguaauggaucacacaaauuagguaauucuugugccuauaaauguggaaaacucaugugcaaagaugauugaaauugauacugcuuuagauguuucugucucauuuuacaaaaauguaagaaaaaaaaucaaacuauacuguuaccuauuucuuguauauucuuaacagaauguucuguacacauaaguguauguguguuaauccucuuguuaaaugccaugaaacuucaguuugccuuuuguuauuuucuuuauuuagauaccuuuuuucuuuuucuuuuuuuuuuuugagacagucuugcucuguugccuaggcaggagugcaguggcacaaccucagcucacugcagccuccaccuccugguuucaagcaauuuuucugccucagccucccgaguaggugggauuacgggcacgugccaccgugcccagcuaauuuuuuuguauuuuuaguagagacaggguuuugccauguuggccaggcuggucucaaacucuugaucccaguugauccgccugccuuggccucccaaaaugcugggauuucaggcaugaaccaccgcgcccgggcuuguauuuggauaucuuaccaaaacacaaaaauuuaccucguugucuucaugggcugcauaauauuuuauuguuuuggguguucuuuauuuaaccugucuucuuugaugguuuuuugggcaguuuacaguuaccaaccaauucaaacagugcuuaaguuaauauacuggcacagauguaagagugggauuuauggguucaugauuauguacguuacuauguuugacagauacugccagcuggcuuuccaaaaaacuuguucaguaugugcuucuacuagcaguauaugaaaguuaucucuauauccauguuagcaccaagcauuauucagauuuuaaaauuauuuuuauuuuuauauuuauuuuugagaccgggucucacucuggcccaggcuggagugcaguggcaugaucauagcuuacugcaaccucaaacuccuaggcucaagugauuuucccaccugagcuuccccaguagcuaggacuacagguaugcaccaccacacccagcuaauuuauuaauuuuuuuguagagauggggucuugcucaggcugguugcccaggcuggucucaacugagaauugcugaacucaagcaauucucccaccuuggccucccaaagugcugggauuacaggcaugagccauugugcagagcccauuauuaggcuuuuaaaucugaaaaucugguaggugaaaaaugcuuuauuuaauuugcauuguuuuauuuugugcuaacaucuuauaguuuuuuuuuauugccacuuguaauuuucuaucugaugccucauugauagaguuguuccuuuuucagauuuuuuggcuagacuaaaaaaauugccuguaucauuuguuucauuggagauuugaaagugauaauauucuaaaucuagcauugcuuuaucauuuauuaguuggaauccuuguguauuuauuuauucauuuuaaugagauggggucuugcuguguugcccaggcuggccucgaaacccuggccucaagugauccaccugccucaacuucccaaacugcggggauugcagauguaagcagccucacccagucguaauuuuuuuuccucgaaauauacuccuggccuguuuauuaauaaacaugccaaagcaagccauuuaggauauaggaagaaaauaaauacugagagcacucugagaucucagaaaugucauaaaguccuauaaaacagaaggaaugaaaacacuacccacaagaucuaagauugcucucugcuaucuuuuuuugagacagagucucucucuguugcccaggguggagugcagugacuugaucucagcucacugccaccucugccucccugguucaagcaguucuccugccucagccuccugaguagcugggauuacagguguguaucaugcccagcugauuuuuacauuuuuaguagagacaggguuuugccauguuggccaugcuggucuugaacuccuggccucaaguaauccacccgcguuggccucccaaaguugggauuacaggcaugagccaccgugcccagccuacugucuuuuuuuuuuuuuuuuuagggucucgcucugucgcccaggcuggagugcaguggcaugaucucggcucacugcaaccucugccucccugguucgagcgauucuucuaccucagccucucgauuagcuggcacuacaggcgugugccaccaugcccagcuuuuuuuuuuuuuuuugagacggaguuucgcugugucgcccagacuggagugcaguggcgccaucucggcucacugcaagcuccacccccuggguucaugccauuguccugccuuauccuccugaguagcugggacuacaggcucccgccaccaugcccgauuaauuuuuuuguguguuuaguagagacgggguuucaccauguuagccaggacggucucgaucuccugaccucgugaucuaccugcuuuggccucccaaagugcugggauuacagacgugaacuacugcacccgcccuguuuuuuugaguagagacaggguuucaccauguuauccaggcuggucucgaacuccugaccucaaguaucugccugcuucggccucccaaagugcugggaauacaggugugagccaccaugccuggccucuacuaucugaaacauaguuuuaaaugacauauuuuaaucuaaauauaaauaaaacauuuaauuugaccaaugcuguuuaauuaagcuaauaauaacccuugacaauaaauuagaucugaaauuauuugaagaugugugagauucuuugagaugugggaguuuuuuuuccacauuuuccuuuaauucuauaauauucucguucacuuuuuuuuuucaaugccuuauagcagugguucuaaaccagggcugacaaugucuagagauguuuuugguugcuacaguuugggggcaugcugccggcaucuagugggguagagggcagggaugccuccaaacauccuauauugcuuaggacacuccccagcaaugaagaauugucuggccccaaaugucaguagugucaagguugagagacugcuuuauaggagaaagcauaccugaagauuuuaaaagugucuugaaguuuucuucuaggaccucugaaauuuaaaaaaaugguaagaccaccaauuaaggucuuuaaccaagucuuaguuuuaccuaucagaauucuauuugagacgguaaaguauaauuuugagaaauaaauaauaugaauguccuagauguuuuuguguuuauuuaaauauggugucuguuaacuagcuuuauugguucauuguuuauuuuuauuauuuuuuuuuuuuaauacagagucucacucugucacccauucuguuaacuggcuuuacugguucauuguuucuuuuuuuuuuuuuuuuuuuuuuaaauacagagucucacucugucgcccaggcuggaguucaguggcucacugaaaccuccaccucccacugaaaccuccaccucccggguucaagagauuuucaugcuucagccacccgaguagcugggauuacaggcaugugucaccacaucuagcuaauuuuuguauuuuuaguacagauaggguuuugucauguugcccaggcugguccugaacuccugagcucaagugaucugcuugcuuuggccucccagugcugggauuaauagagaaugggauauggccuauguugcuuaggcuggucccaagcucugggcacaagcuauuuaccaccucagccucacaaagugcugggauuacagacaucagccacugugcccagccaggucauucuucauaucuguggggagagagccuucaauuccucacuuucuugauggauuaguagccucauggcuucauuaaccacagguaaccauagagguauaccuaaccuuuaguuucccauaaauucugccuguuguagccuggaagcuguguguauuuuacaguccaggucacaggccacugcugauacaccaaccagucuucagugacagcagugcugaccacuucccccacccccaauuagcacccaaaggagcuagcugcccuagccacugguggguccccugcaugcuguccuugaaagggaagaguuagauauauugagucuagaaagagugagagagaaagagauugguuauuucugucaucuuucagaauuaaguguauguuaaagugaggacucuguuccuuauguaugcaucauauauaugcauuuuggaaacucuugacaaaguuggaagaacuuuggaagaagcuggaaguguggagaagucuacuaaauccauaccagcuuuuuuuuuuugagauggagucuugcucugucgcccaggcuggaguguaguggcucagucuuggcuuacuauaaccuccaccuccuggguucuagcaauucucccugcuucagccuuccguguagcugggauuacaggcgaccaccaccacacccggcuaauuuuuguauuuuuaguagagacaggguuucaccauguuggccaggcucauaccagcauguuuuaaugcaacuauuaacaauauuuuguuacuguaugguagagaugguaaacuggcugggacacugggcgugcagauacagaccagguugguuuuggggaaacuaggagguauggucacucuauuuuguuucuuugauguccuuuguacaucauuccuaguuaauauauuucuuauauuuuuauccuaucuuucuuauacuuuuagccaggcagauauacacuugacccuuacacaacacagguuucaacugugggggucaacuuaaacauagauugaaaguacaauauuuguaggaugugugaaaccugccuacacaauggacugcuuuuuuuguauucguggguucuacaggguugacagcgggauuuaaguaugugcagauuuugguauacacaggagucuuggaaccaguuccuaaaguauaccaagggaugacucugcugucauagucguuauguuauguuauguuauguuauguuauguuauguuauguuauuuauguuauguuaguauccgaaacagggucuugcucuguugcccaggcuggagugcagugauguguccauggcucauggcagccucaaccacccgggcacaagcaguucucccaccccagccucccauguagugucuuggucuuuaaaauuuuuucuucaccuagguucuucuuaccuuuccagucuucucuuuccaccauuuguaacuuuuucacauuacuugaaguucacugaauaugcaguguucuacugugcugguguuaaauucucauagcacuuuguuguuaauugccucauauguucuuccuuaugggauaccuucaacuugucuuuuaagacuguucagauggcccccauucaaauauauauuauuuacugagaaguuuucuuggaucuccuuuucucaauaaaaacugccauauuucugacauguaucaauugcauuuucuguuauagcuguuugcuuacuagucuguuucuacuugugguucuguaaguuuugagggggcugaacuuauguuacucagaaugugucacacaguaggagcuggguuagauaaaugaauagagauauguaccauauaaugacauuuuagucaucgauggaccacauauaugauggugguccuauaauaguauaaugccguauuuuuacuguacuuuuucuauuuuaccuauguucagacauacgaauacuuaccauuacagguuugcaggcuaggagcaauaagccauauaccauauagucuagguguauaguagacuauaccauguggguuuguguaagugcacucugugauguucacacauuggaaucaucugaugacacauuucucagaacauacccucgucauuaaaagauacaucacuguagaugaaaaacagaacacugucuucaucuacaaaggaacuauuauuuuauuuauuuauuuauuuuugggacggagucuuacucuguugcccaggcuggagugcaguggugugaucucagcucacugcaaccuccuccuccuggguucaagugauucuccugccucagccucccuaguagcugggauuauaggcaugugccaccacacccggcuaauuuuuguauuuuuaguagagacgggguuuugccauguuggcuaggcuggucucgaacuccugaccucagaugaucugcucccuuuggcuucccaaagugcugggauuacaggugugagcaaccaugcccggccccuagaagcuauuauuuguaacuuuagaaaauaauagaaauuauuauugggauuggagucaugagugugagugggugaaaguguauucugagugaaguauacuugcucucucucuucucucccaauuuccauauguccagauucugucuauuuguccacuuggcucuugucugagagcuucccagauuuuccuagaauauaauagccuugccauuuacaauuuugucuuauuuuccacucuauauuagggguauuuuguuauaaauauuauucugccaagguguaggcuucuucuagagggcauaauuugguuguuuuaucauuauuuccuucugcaucauaugucacgauuucuucaaaauacaaauuuacugucuuagcuugggaugcuauaacaaaauaccauugacuuggugacuuaauagaaauuuauuuccucaugguuuuggaggcuggcagucuaagauaagugugccagcauagucagguuaugugguaaggcuuucuuccuggcccuguuuuuuuguuucauuuguuuuugagacagggucuuguuccaucacccagguuggaguguaguggugggacaauagcucacuguaguccuaggcucaagcaguccuccuguccucagccuccugaguagcugagacuacaagcacacauccccacgccuggcuuauauuuuaaaaacauuauuuuggccaguugugguggguggcucacgccuguaaucccaacacuuugggaggcagagucaggcggaucgcuugagcccaggaguuuugagaccagccuggguaacauaacaugcugaaacccugucacuacaaagaaaugcaaaaauauagcugggugugguggugugugccuguagucucagcuacucaggaggcugaggugggaggaucacuugagccugggaggucagggaugcauggggccaagauggcaccacugcacuccagccugggccacagagugagacccugucucuuuaaaaaaaaaaaaaaaaaaaguuaaaaaacuuuuuuuguagagacaggguguugcuguguugcccaggcuggucuugagcucuugugcugaaacaguccucucaccuuggccuccuaaagugcugggauuauaggugugaucuaccgugccugguguuucuggcauaauugguguguccucacaugguggagagaguauaaguucucaggugucuucuuauaaggguccuaauccgauuaugagggcuccuccuaaaggcuugggcuccaaguacuaucauauuaggagguggguuucaacacaugaauuuuagugguguggggcaggcggguaagggcacacauuugguauguaacacuugucaaagauuugugcauuagucuauguugcuuaauguuuacugguuaaauucagguauggauugcuuuaugcagauauguuuuugaaaauuauguuaacuaaguuguguguaguaaauguuuuaagugaacucauauagcucacuuaaaaagaguaggaaggagaaggggcuuggauucauuuuauuucauuaaaaaaaaauuuuuuuuuuuuuuuuuguaacaggaucuuacuguuucacccaggcugggggugcaguggcaagaucacuacucacuguagccucaaucucccuggcucaggugauccucccgccucagccuccugaguagcugggacuacagauuugcaacaccaugccuggcuaauuuuuauauauuuuuuuguggagauaggguuuugcccuuuugcccaggcuggucucaaauuccugggcugaagccuuccucccaccucugacuccagaguguuaggauuacaagcauaagccaucacgcccagccuggaauuuauuaaauguauaccaugugacagguuagauacuuucaacauaaauuaggaaaaaaauacuggugugaauuuucucaaaggggaagcucuguuuaucacaguauuuguguaauuccugauuuuacauuguuugcucacauuccuucucauguuuauuaagguaucacuuaagucaacaaauauuuauugaguauauauucuguuccaaguacugcgcuagguauugcgggugcuguggugagcaaaccacaguaucugguaguaauuuuaaaaauuacuuuaacagugaaguauuacauuucuauauguguguguguguguguguguguguguguguguauauaugcauauauauauauuuuuuuuuuuuuuuugaaacaaucucgcucuguuguucagguuggagugcaguggcacagucuuggcucacuguagccuccgcuucccagguucaagugauucuccugccuuagguucccaaguagcugggucuagaggugccugccaccacuucuggguaguuuuuguauuuuugguggagauggaguuucaccauguuggccaggcuggucucgaacuccugacuucaagugguuugcucuccuuggccuccuaaagugcugugauuacaggcacgaaccacugcgcccagccuguuucuuuuaauauuuugcuuauugcuuuuaucagcauuggccuguacaaaauacauuaacuucauuuuaaaaauuaggccuggaggaaaucuuuuauaaauguagcccuuuaagagaguaauuuuuuucaguugauuuuuaaauaagcuuagguuaggggccuaagacugaugagguauauagaaggucaacaaacaauuauuacuuuuguuaugcauugaaaaguuuuaguuacaaggugaaaguuacagugucaagugauagaagccucauaaugugugaagugcuuaguucauaaugugagagagcuugguuagauuagaugggaauaaaauugaaauuuaaauuuuuuccuuuagaauuuuuucuguuacauauguaaauuccaaagauuuugacacaauuacaaacuucaguaaaaugaaguuuaauccuauaauaucuuugcuaccaaguuuaagaacgucaauaaauaucaucauuauguuuuucuccacauuuuaauaucucugaaauuggaaagucuuugaaacaucaauagcgaccuagaauugcagcuugccgcauuucuuuuuuuuuuuuuuuuuuaaacaaugcagucuuacaguugaugcugacuuauauuuaauggauacaauauuaauaacucuuggaagccuuaggauauuggauaguacaagcaacuuggaagagacauucacucuugaaggaaagacuucugaguauucaguguaaauaggcugauuuaaauaaugguguguuucagguaagaaaauguuuuaagagacaguuuaguauguugcuuuuauauuuaguugguauuguuugcucagaaguucagaucauuaugaggauuuguggguaaaauugcauccuuacuuugugacuguuuaagagauuuugccuuuuuaaaauuguuaauggaacaauacaaaaacuuuaaauuauggaaucauuauggagugagguuucuuuucuuuuccuuuuuuuuguuuuuuuuuugagauggaauuucgcucuuguugcccugacuggagugcaauggcgcgaucucaaccucugcucacugcaaccucugccuccuggguucaagcaauucugccucagccucccgaguagcucagauuacgggcaugcgccaccaugccuggcuaauuuuguauuuuuaguagagacaggguuucuccauguuggucaggcuggccuggaacugcugaccucaggugauccacccgccuuggccucacaaagugcugggauuagaggcaugagccacagugccuggccagaauaagauuucuuuaaugugcccuuuuuaaaaaucacugaauuugguauugagaugaggcauaagguguuaaaaaacacagcugcauauuuaaaauauguuuuuuauuacaaaaguaggaaaccuuguuuaaaacaauuuaaacagugcaguaguucaucaaaggaagacaugacagucccuccauuucuauccgauguaauauagcauauuaauuuagaauauacuuaauauuuaugugcauucaguaaaauaaaaaauggaaguggaccauuuaguaaguugcuuuuuaaaaagucaccgugaaaaaugaaaguauacuugagcaaaccuuuguauguuaaggaauuaaauucagauuuuucagguauaauauacuuggaagagaaaugccagaagccacuuaaaagaauaauuuggauuaccuuugcuuuuugauauucaguuugaauguuuuuguuucugaauuacaaaguuucaucauuaguagcuuaauuuuucuuaauuuguauuuucacuaagcauuuaccuuuuuaauacuuuuaaaagguaaaaagcuuauauuaaaaauaaaauagauuuuauagauaugauuggcugaaaugaacagccuuuuucagacuagaaacuuaaauucauaaauauauacauaauaaauucagaucuaauuucuaauguaggaaaaucaguguuugggucugaugcaggaacauuuauauauuuugaagaucuaugauacuuauauuggaaaaagguaaaauucaccaauuuauaaucaaggguagaaaggaaaauuuaucaaacuaaaaucaagggauaaauuucuaggaagaaaggaaaauagcaauaaaguuacuuuauugguagugaucugucuuaggaggauugucaauguguauaacaacauagaggaucuuguacauucuguaggguuaccugcggagaaccaaacuaaaaccuaaauucucugaauauuuugguggaucuuaagguguuggguagucugcuggacucaguguuuuaaaugguucauuugggaauguccacccagauuugaauuaauuuaguagucucacagcauuuuaaauauuaaaugguaaauaaacuucuaaauuauaauuugaaagcccaaaggaguuucuuuucucucuccuuccuuccugccucccucccuccuucuccuuuccuuuccuuucccuuuguuuuuuucuucacagcucagauuucugcuuuuaagcuaaagcauuuaagauuuagucccaaaauaauacuuggcuuuuugaaagcaucaaauucauuuaaaaauuuuugcuuccaagcagcacaacugauugugguucacguaagcccaaaagaaaacuagaaaagaagggaaagaaauauuuauuagaaggauauugaaauaacacuuagaaacaaggguugagcuacacuaccaagccaaaggguaugaggauggagcccagggaccucagcagcagaaguuguuagacuuguucuucagguucuagcaaaggacugaguuccagucuuggugucuuccauauuucacauuuuuggaggaaaauaaucugauuggccuggcccuggucagguggggugaugagagaaacagagcuggcuacuggaggcccauccuuguguauucaguaccuuuuaaagaaaaugggaaccaugagcuggggagcugacucauuaguaugugcuauaaccagcauauauguguauacaguaccugcaauucaucauauugguaaaauauguuaaaauuauuaucuuaaaacuguugugaagguuauaauggcaacuuacugugucagugggaaucaccuucugaccuuuaaggguccagauaaauuuagcacugacccuuguucuauuauugugagacguuuauuguucuuacuaagaucuuugaauuguugaaaugcuuauauuucuugauacuguagcuucuguuagccuaguaucauggaaccucaucuuuauaaggaaaaaaagacguagaacuggugauuauggucuggggaagaauauaauaguugcuuuaaggaaguuauaaacaaagugcuuugggagcaguaacuuaaaaaguuuauuucugacaaggaauauuuagcagugcaucauggugcaaggaggcauuucaacuuagucugggcagagggaacagugagcaaaggaauaguaaaguucagagcuguggaggaagaauuaggauagauuagaaagggucuugcuaaugcauagaauuuuggcuuuagaaagacauuagaaauuaaugaaggcuuuugagcagagaaaagauaaaucagagcuuugccuuggagaaauugagucuaauucaaaggaauuagggaaaucacucaggagaugauuaugguauuuaagcuagaggagaugagaauuuguaauggugcagcauuagugggaaugaacaugaggguucacagacaacauuagguuauggaucuguagauaauaucuguucaucauucucaccuugccuggguuuuuauagguuuccuaacuugauuuugcuugcccuuucuagucuugucuaauauaugcuauuaguaguagucaugcuacaauauaaguauguuauucccaugauuaaaaucuuucugcaccuucucccuugcucaaguuaaaguucuuaugagauuuaaggcauaaauaaauaauuguagcucuauuuaauuugauauuuuucuauuuguucccuguguuuuucuuuucuccuaaauuacucaauucucuaguaaauucguacugccucgucccagugacuuuguacauauuguucccuuugcuggaacaaagaccuuacuuuuccuuuguguacauuuuuucucccucuucuguguugcucuugacuuugugcucauuuuaaaagauacaugcaaggggucaucucuucuagaaaaccuccauugacccugaauuagaugugacucagcccacuucuaucaucauauauaaaauuugccgugccauuauuuuuuguuuagagugaguucccugaggacaacuaaauucuuuauauaucuuuucuuaccacauaauagcuuagggaugcauauuugcauuaaauguuuuuuggccuauaccgagcuuauacagcccgcaggcugcaugcagcccagggcagcuuugaaugugacccaacacaaauucauaaacuuucuugaaacauuaugagauuuuugcgauuuuuuuuuaaaaaaagcacaucagcuaucauuaguguuaguguuaguguauuuuaugugcagccuaagacaauuucucuuccagugugacccagggaagccaaaacauuggacaauccuggccuauacuguuccuguaacuagaugucaugauguaauuagaguauggauucugaagccauaaagccuggguugaaaucccagcccuguuacuuauuaccugugcaauuaugggcaguuuauuuaaccuguuucgaaguugucuuauugauaauaaaaugcggagaguaguaccacccaacucauacauaugcuucugaagauugaguuaauauguccaaagugcuuagaacaguaccuggcauuugugauuauguaugugcuugcuauuuuuauuaugcauuacaguucaaauaugaaucuauuccccuguuuuuuuguuuuugagacagagucuugcucugucaccagguuggugugcaguggcaugaucucagcucacugaaccuccaccucccagguugaagcucuuccccugccucagccucccaaguagcugggacuacaggcgugcgccaccauugccuggcuaauuuuuugcauuuuaguagagacgggguuucaccauguuggccagggugaucucaaucuccugaccucaugauccgccagccuuggccuccuaaagugcugggauuacaggcgugagccccgcucccagcuauuccccuauuaauugccaaagcaguucuacacauaauucccagaucugcuuggaagguggcauuuuuucuaccugauuuguuuuuucuacuguagaugguuuguagacauuauucccacagagugggcuucaggauauucauuuauucaaucaccagauaauuauugagugccuacuauuugccagacuuuguauuuguuuuauauauaugaauaaauucuugguacuugugagguguguguguguguguguguguguguuugugugugugaauaaauaugugagcagacaguagauaaauaaauuauauauuauguuacuggauaguaagggcaaugcaaaaauaagaaaaaggguaagggaaaugaggguuaagaguggagaauguuacagcucuuuuagaauuugucuaguaggcuuucugggaggucuuuaccagaaagccuccccaccgcuccccucaaacucccauguuaaaaaaaacuuuuuuuuuuuuuuaugagugaauagguaguuggauuuuuuuuuuuuuuuuaagagacggggugggcugggcacuagugagucacgccucuaauuccagcacuuuaggaggcugaggcagguggaucaccugaggucaggaguuugagaccagccuggccaacauggugaaaccucaucucuacuaaaaauacaaaaauuagccaggcgugguggcacacgccugucauccuagcuacucaggaagcugaggcaggagaauagcuugaacccaggagguggagguugcagugagcugagaucacaccaccauauuccagccugggugucagagcaagacuccgucucaaaaaaaaaaaaaaaaaaagacggggucuuacucagccucccaaaggcugggauuacaggugugagccaccaugccuggcccagguaguuggaauuuuaaauaagauggucaggggaagucucauuuagaaggugacauuugaucgaggcccaagaauaagggagucagccgugcaauauauagaagauaaauccagguagaagacuuuuuuuguuuuugagauggagucucgcucuuccaccaggcucgagugcaguggugcaaucugugccuccugguuucaagcaauuccccugccucagccucccgaguagcugggacuacagaugcgcgccaccaugcccagcuaauuguuguauuuuugguagagacggaguuucaccauguugaccaggaugguuugaucuccugaccucgugauccgcccgccuaggccucccaaagugcugggauuacaggcacuuuugugagccacugcgcccggccaagguagaagaaucuuucagugcaaaagccuuaaguaggacuagugugucuagcccuuucacagacuaacaaggaggccacuguggcugaaguagacugaucaaggagaggaggagguaaagggaaugggggaaauauaauguagggcaauguggagcacuguaaaggcuuuggccuuugagugaaauccagagccgucgcaguuuuuuguuguuguuuuuuugagacagucucacucugucaugcagugugagugcagugaugugaucauggcucacugcagccucgaacuccugggcucaagcaguccuccuuccucagucuccugaguagcugagacuacaggcuugcaccgccaugccuggcaaauuuuuaauuuuuuuguagagacaggaucuuguugcccaggcugguuuugaaccccuggaugcaaacaauccucccaccuuguccucccaaaguguugggauuacaggcgugagccacuucgccuggcuaguauuacagaguuuugagcagagaagugacacuaucagacuuaagcauuaaaagaauuguccaaugaauggcugugcugaaaauauauuugagguaaaguaagcuagaggcagggguauugaaaucaggcuaagagauguuugugguuugaauuaagugguagcaggagguguuaagaauuagucacauuguguauguauuuugaagguacaaccaacaggauuuccaggcaagauagagugugaugugaaaaagaaagaaaggagucaguagugacucaggaguuugucugagcauccgaaguguggaauuucaucacaucugagaggugaaaggcuguaggaggagcaauaugugggaaagaucagaaguucaguuuuggacaugccaaauauuacuuggccaaaugguuggguggaugauuggggaucaggagucauccugauaaaauuggcaugcagauaguauuaaaaacuccagacuggaugagaucaccaaguguagauagaaaagagagacugaauugugagugcuccagcauuaagcaguuugggaaaccagaaaaggaaaaugaacaagaaagauaaaaggaaacccaggaaaguaauuaaggaggagugaucaacuguaaaauauuguuagugagacauuuaagaaaauuguccacuaaccaguggauuuagcaauuggaguucguuggugaucuugauaaaugcagauuagguuuaguggugggacagaaagcuuggaguagauuugagagauaaugggagggagacagcuguuuuaaggacuuuuauuacaaagcacagcaaauuuuuaaaugguauuggaacugggaggguaaguggaauaaagaauaaauuuuaaaagggagaaauaucaguguauuuauauuuguaugcuggugggaaugauccauuauuagcaaauaaaaaguugauguagaugauaggagaaaggggagaauugcucaagugaugcucuugaguaggugaucaaauggcaaaugugguauauaaauagaccagagcauggauaguuccaucuaugauaacaggugggaguucaggguguguacauguacaugacaguagguaacuggugggacccuggaaauucccuauuguuuucaguuuuauaagugcaacaagaagcaaggucauugagugugagggagggaaaacucaauguaggguugaggugagaagauaugaaauaguuacugggagagucagagaaugaaauagacuggggauaaugucugguagcauuuguagcguacucaagaucagccagcaugguuguggauuuuucuuugucuuugcuuucuucccuauguaggcacagauuugguggggauuacguugauuuuuuuuuuuuuuuaauuacagugaagccagagaagggcuagagaaccaacuauaucugagggagugauuauauuuuuuuuucucuuuccucuuuuuuucuuuuuuugagauggagucucacucuguugcccaggccggagugcaguggcgugaucucagucacugcauccuacgccucccggauucaagcaauuauccugccucagccuccugaguagcugggauuacaagcacgcgccaccaugccuggcuaauuuuuguauuuuuaguagagacgggguuucaccauguugagcaggcuggucucgaacuccugagcucaggugaucugcccgccucggccucccaaaaugcugggguuacaugugugagccaccgcacugggccagauuauaauuuuuacaguugaagcuggguaaugaagggagagagguugucagaggguugagggacaguaaaaagguaauagaaucaauggauaggaaauccugguggagucaaaauuuuuggaguaaguauaacauauguaaaugucuuuuagcucaucaagaacuauaaaaauguagcuaagguuugacaaagcuaagugauacaccucuucucuauacuuuucuguuaguugacauauuucauuuauuuuuauggcugggcgcggugguucacgcuuguaaucccggcacuuugggaggccaaggcagguggaucaccugaggccaggaguucgagaccagccuggccaacauggugaaacccugucucugcuaauaauacaaaaagaauuagcuggacaugguggcaugcaccuguaaucccagcuacucgggaggcugaggcaggagaaccacuugaaccaggagguggagguuguagugagccgagauugugucauggcacuccacccugggcaacagagugaaacugugucucaaaaaagaaaagaaaaaaagaaagaaauauuucauuuauuuuuaaaaaacaagcaguuuugugauggguggaaaagcaacguuggguggagacuuuauccucucugaugaaagaggauauuuaaagugccuuuagaaguauuucuaggccagagagaaugccaauauaagcccaagcaucuuacuguggucuaacacaggucuuucucacuguugcagucuuccuuacuuaaugccaucucagaacacuacccucauacccaaagcugucugcauauaucuacuguauuacucagauguucuccccauccugaguuucuugaggaauaacgaccauugggugcuuacuaggugucagccauuuugcuaagcacuuugcuuacacuaauguuaacccuuacagcaacagaacuaaauauuauuaucccuguuucacagaugggggaaacagagaggcuaggguuaucugccuuaggcccuacaaaugagaaaguguuugaaauaccuggucaggcuuccagacuccagagcaccaccugacucuuuuuaaauugauuuuuuuuauuauuuaguuuuuacuuuuauuaaaguuauaugcacacacauuagugaauuuauuaauacgauaaaggucacaaaaaagucuguguacuuucuuuuauuucuuuuucuccugagagacacccacuuuaaauuuucuuuguuuuuuauuuuuugagcuacaaguaaaacugcuuuaaaauuauuucuuuuuuuuuuuuugagacggagucucgcucugcugccaggcuggagugcaguagaguagcaugaucucggcucauugcaaccuccaacucccugguucaagcgauucuccugccucagccuccugaguagcugagauuacaggcaggcaccaccaugcccagcuaauuuuuguauuuuuaguagaggcgggguuuuaccauguuggccaggauggucuugauuuccugaccuugugaucugcccgcccuggccucccaaagugcugggauuacaggcgugagccaccgugcccagccuaccuuccuauuucuaagguacagucuuuuuacuaguuacuuuuucucuuaauuuuacagucuaguuacuuuuucccuuaaugucugauuucuuaguaaugaaaguuaagauuuaguuucuuuuacguacuccuucuccaagcaugcacacaaacuucccacuuuaacugcucauuuuuuccaguauaauuacauugaaauuuuggucacauuagcauucaauauauacguugucucuguuaaugcuauuuuuuucauuuaauuuucuguaugcuuaugacuaauucaaccccaaauuuuaguuguuuauauaucaauuucauguuuuaaaaaaaaucucuuguugagccuucuuaacugcuccauucuggacugguugcucucuagaccugccugaauccuaccaaguuaugaugaaaauggaaauucuaccaucuuacggugggagacccauuuuuaucauccuguaauuaacuuuuuguguuggagucucaguauucuagauaccauaucaugcucuuucuugguuuacaucauuguuuugguggaaugagaggaggcacaauaacaauuuuuuuuguuuuguacuuuuagugucugaaaauguguuuauucuaccuacuuauuugauagucugguuauucuagguugaaaauuauugucucucugaauuuugaaggaauuuuuucauugcuuucuuugacaccuguugauaaaucuggagcccucuuuguaugugaccugguuuaugucccuggaguuuuguagaaucuucucuuugauuccagaauuacacaguuuuacugcagugugcuuugcugugagacuauuugucaacucuuguguuggucacucuucagcaacucuugugaguucucuuaauuugaaaacuaguauuuuuuaauucugggaauuauuuauggauugcuugguugaggcaaaacaugcauaaaaugaaauuuaccacuuuuuaaccguugcuaaauguacaguucaguggcauuaaguacauucacaguguuguagagccaucaucauuauucauuuccagaaccuuuuuauugucccaaauauaaauucuguacccauuaaacaauaaugaccauuccuccuuccuuccaaucccugucuagcuuuugugucuuugaguuugauggauuuuagguaccucacuuaagugacauuauaaaauauuucgugucuggcuuauuuuacuucacguaaugcuuucaggguucaggguuguuuucaccuuuuagccauugugaauaacacugccgugaauguuggugugcgagugucuaagucuguacuuuuacuucuuuuggguauacaccuagaaguagaauugcuggaucauacgguaguucuguguuuaacuuuucgaggaacuguauuccacaauggccgcgccauuuuacguucccaucagcagugcccauuggucccaguuucuccauauccucaccagugcuuguuauuuuucauuuuagaaaauguuuuugauuuaaaauaaucauugguuucuucuccacuuuucuguguguggguguguguauuuuuuucuuuuuaaacuggucauuuagacuuugaaccucuuguacuacuauuacaguuuucugauuacuucccuccuuuuuauaaaugucuuuaaacaaugcaccuuuaaaaaagaguguuaaauggugccaucauugaguuaguaguuuuguuuuauuuuaacuccuccucuucccuccaaaucuauaguuuuuguguguguagaauuuuccagguaacgcagaacacuugcugacuauuauuacucaggcuauggagauuccuaccaguuaguggacacauauuuuccuccaauuucuuagucuucaagaauccuagcuccauuugauaacuaugaguagugcuuuuugaauaacuucuuuuggagggaugagacugcagcaagcuauaguuuuguuuuguuuuuuagagacuguuccucuuuugcccaggcugcagugcaguggcacagucauagcucacugcagccuugaacuucuggguucaagcaauccuccuaccucagccucccagguagcuaggauuauagguacaugccaccaugccuggauaauuuuuaaauuuuuuguagagaugggaucucgcuauguugcccaggcuggacucaaacuccugggcucaagcagucuuccugccucagccuuccaaaguguugggguuacaggcauuggcuacucugccuggcccuaguuuuguucuuaaaaaaaaaaaaacauuuccaacaguucagaucauuggucugggcaaagguaggugagaccucaaaagcacagggaacgaaagcaaaaacagaugaaugggauuacaucaagcuaaaaagcuuccgcacaagggaagagucaguagagugaagaaaaugaaaugggagaaaauauuugccaacuaucuuucugacaagggauuaauaacuagaauauguaaggaauucaacucaaaagcaaaaacaccaaauuauccaauuaaaaugggcuaauuaucugaacauuuucagaagacauacagguaugugaaaauauguucaacauuaguaaucaucaggaaaauguaaaucgcaaccacgaugagauguuauacaccccaguuaaaugaccauuaucaaaaagacaagccaggcaugguggcacacaccuguagucccagcuacucgggaagcugaggugggagcaucacuugagccgaggaggcagagguugcagugaggugagauugcaucacugcacuccagccugggugacagagugagacccugucuaaaaaaggaaagaaaaagaaauggcagauucuggcaagggugcagaaaaagggaaacacuaguacacugcuaguggaaauguagauugguacagccacuaugggaaacaguguagagauuccucagaaaccuaaaaauaggucuaccaucugaccuagcaauccccacugcuggauaaauguccaaaagaaaagaaaucagugugucaaagagauaccugcacuuucuuuuuuuuuccauuuuugagauggaguuucgcucuguugcccaggcuggagugcaguggcacaaucucggcucacugcaaccucugccuccugaguucaagugauucuccugcuucggccuccccaaguagcugggacuacaggcacacaccacaacgccuggcuaauuuuuauauuuuuaguagagacgggcuuucaccauguuggccaggcuggucuugaacuccugauccgcccaccucugccucccaaagugcugggauuacaggcaugagccacugcgcccggccaauaccugcacuuuaauauuuauugcagcauuauuuacaguagccaagauagagaaucaaucuaaguaucuacaaauggaugcauggauaaagaaaaugguguauauauacgcacacacacagugaaauacaguccaauucagauauaaaaagaaugaaugaagucccauccuuugcaccaauguggauggaacuggaggucauuauguuaagugaaauaagccaggcacagaaagacaaauaucacauguucucaugcauuauguuggagcuaaaaaaguugaucuuaacggagguagagaguagaaugaggguuaucagaggcugagaaggguggggggccaggaaugaauagaaauugguuacuggguacaaaaguacagucagauaaaaggaauaaguuuuaguauuugauagcacaguaggaugacuauaguuaacaauuuauuguauauuucaaaauagcuagagaagauuugaaauguucccagcacaaaugauaaauguuugaaauggauagcccaaauaucgauuugaccaauacacguugcaaacauguaugaaaaguaucacauguaucccauaaauauguauaauuauguaucaguacaaauuuccaguuuaucuuuuuaguuuugucauauguaaauggagauucccaggaagcguuaauucauuuaguagcguugacauguucauuuuccauguauucaguccuuaaaccaaaguacaaauuguucuugugauagguacuuugcuuuuaaugauuuuuuucuucuuuuuuugaaaguaugagauacauuccagaugcauuccagauaauuauuacuuacgugauuggcauuuuuaaaguagcacauaacucugggauauacuuuaaaguagcagugaaaguaaucuguauauaaaauuacacaaaauaaacgaauaccaaaauauuagcuaacauagcagacauuguuaagauacuuuuguuuuacugucaaacucaagauucuucaggauaaaaccuuuguauuaaaauauacaguaaucucucaccacuuguggcagugcuaacucauuuuuauauuucaguaacagauauuuuaagcuuuaaucauuuacauaugucuuucagucucccuaaauuuaaaaaugaaaugauuauugucuucuuugcuguauaucacauggauuggucuuuggguuggauagaagggggauuuuuuuucccccuccacuuaauacacagacgacuacacccaagaaaaaaauucuagauuagaucuucauagcacauuguccuguacaacugaaagugauucaugagauuuuaaugcuaaugaguauauuuuuuuaaaugaaucaucuguauauuagguuuagauuauuuagauuucucuuucccucuuucuuuaaaaagauguauauacaugugcuacaaaucuuauuccucaaauuuugugacuuugaucuuggcaguucugauuuccccagccuuauuauuuuaagguaaccaguuaagauguuaacaaaagggauuguguauugcaguguucuccaccaggaaccacuucccucccaugguucauuuggcaaugacuagagacuuuuuuuuaccacuuggagugaggauugcugcuagauagaggucagggaugcaaauauccuacagugcacacagacagcagcacaucacaagcuaaaacccuuuggcucaagauguccauagugcugaguuugagaaacucauuuauuguuuauauuaaacaccugcuucuuggcuuuacuuuagucaauauauuuccaauuccuuuuucuguaagguucagcuuaaaguuccaacuuuguccugaggcccuuccuuguugagcccuaaaccuacacugugaucuuuagguucucuuguaccaucacugaaaucucggcaauuaaguguuuaugauguuuuauuuucuauuuaauaucuguaagucugguuuuccaaaugaauuuuguuuuauuguuuuaagcacaccugcuggcaguaacaaaguaauuuuguuagucaaggauuguuacauauuucuucaggacuugcuaacugcuguugaccuucauguuagggcugaguugguagaaugaaaaaaagggcccagguccuaccaacccgguccugucugacacaugugggggugaagggauagaucagucccuuuugauggcagauuggaauugguuaucaacuagauuguagagggggugguaaaaagcaggagcaaaaguggugagaaaagugacacucuaguuucagggaggaagguagauccacuucagccauuaagcuaguacaaguuaaaaaacucaacaucucuuuguuggcuguggucauugugagccgugcuguuagaagagucaucuuugguacagcacugacauagaagggaggagucuauguugguauaguaauagauucuagggacauuuuuuuuucuuuuuguuuuuucuuuuuuuuuggagauggagucucacucugucacccaguggagugcagugucacccaggcuggagugcaguggcaugaucuuggcucacagcaaccuccaccucccagguucaagcaauucuccugccucagacuccugaguagcugggacuacaggugcgugccaccaagccuggcuaauuuuuguauuuuuaguagagacaggguuucaccauucuggccagguugguuucaaaauccugaccuugugauccgcccagccagggacauuuucuauaagggcucaaaggcuaaaaauuaagcacaagucaggcuaaccggaauauacuguugguuggacuuuuuguuuuaauugguagggagagguggaugaauagguaguaauuugaaucuuuaggcauuuuuagaauccuuaucaugaauauguaaguugccaagaaagaaacccagguuuacacugagcuauugucugaaaguuuguguuaccuucugaagcuuucuuuuucaucugauuggauccuuuauguguacaaccauuuagcacucuaauuugaaaaauuugucacuuucaguggcaaauacuuucccuucagaauuuuugucaaaacuuuauuguuucaaagcagguacuaugccaucuucagauagaaguuuaugagcaagaaaauauguaacacuucaaggauaauuucaaaauaggaaacaugagaaauauuuuagugucauuucauuuauauaaaaaacaauacuuuuuuuaugagacugaguuuugcuuuuguugcccaggcuggagugcaguggcgccaucuuggcucacugcaaccucggccucccagguucaagugauucuccugccucagccuccugaguagcugggauuacaggcaugccccaccaugccagcucauuuuuguauuuuuaguagaaaugggguuucaccauguuggcuaggcuggucucaaacuccugaccucaagugauccauccaccugggccucccaaagugcagggauuacaggugugagccaccaugccuggccaaaaacaauacuuuuuaccuuugaagcagucaguacaaaaugagaauccaaaaauucuguucauaauuguaucacauaauuuaccuuuuccauaacacaaaaauaagcaaaagacagauaauuuuagagagguggggaaugggcccaugguucuuaacuggggacaauuuuugacucccaaggaacauuugauaauguugggagacauuuaugguugucacaacuggaguggguggugugcugcagguuucuaguggguagaggccagggauguagcuccacauccuccaguacaaaggacauccuccugugacaaagaauucuauccaacuugaaaaugucagcaguggccgggccugguggcucacgucuguaaucccagcacuuugggaggccaaggcggcgaaucaccugaagugucaggaguuugagaccagccuggccaacauggcgaaacaccgucucuacuaaaaauacaaaaauuagccaggcaugguggcaggugccuguaaucccagcuacuuaggaggcugaggcaggagaauugcuugaaccagggaggcggagguuguagugagccgagaucgccauugcacuccagccugggcgacaagagugaaacucugucuccaaaagaaaaaagaaaaugucaguagugccaaaauugaagaagcccugggaugagggauugcaaaggaccuguuaacacauaaaacaagugucuuguggucaaaaucagguaaaaauauuccauuucacuagcaaugaaggaaauguaaauuaaacuguuucucuacuagcauauugacagaauuuuugaaagguuaucauacucaaauguaacauguugcuuuauauuacugaugacacuacaaaguaugguacauggugucuggggaguuucugaagguugaaacaaaagucuugacguauguacuucauacuucggacucaauaauuucacuuacagaaaucuauccucaggugauaaauagaugccuacaggguuuauuauuaggcuguuaaucacauaacuacauaauuauuuuuaauuguaaugaaguagaugugaccuaauuuuuuuuuuuuuuuuuuuggagacagucuugcucugucacucaggcuggagugcagugcaguggcauaaccuuggcgcacugcaaccucugccuccuggguucaagcgauucuucugucucagccugucuguaauuccaguagcuggaauuauaggcgcucaccaccaugccuggcuaauuuuuguauuuuuaguagaggugggauuuuaccauguuggccgggcuggucuugaacugcugaucucaggugaucugccugccucagcccccgaaagugcuugcauuacaggcgugagccaucgcacccagcccuaaauauuuuuuuaaacugugauuaauaaauuauggcacaaauacguggugcaguuaaaaaucuugcccucaaagacuguuugucccaugcaaauacccguagugaguaaggaggagggaaaaaggaauauuaggaugucaaauuugaaaaauauauuaaaauguuacuuuagugaugaugguugacugcagauuauggauacauacuucuaugucuuuauuauuucuuauaauggcuguacuauuaauguaaucagaaaaaacacauuauuuaguuuuuaaauccuauuaacauuuuggaguagucucaauauuuuucaguuuacugacuaaucuguccuuuaccauauaucagauuuucauauaugugugggugugcuucuccgcucucuucuguuccacugaucuauuuuaauguucaguuagucgacaagauguaauaugauguggaaugauaauguaaaagaaucucuuguuucgugccccauuuauagagagaguaauuuguguuuuaaaauuaguccuuuuaaaaaugucauaauuuuauguaagcaacucaguguuuucuuacuuuugcagaucuuucacuuauuuaauucaguauucagauuaaauauacuuguuuuguuugccucagucauauaauuaagacugaauuauuugacauuuuaagucaucugauugaaauaucugccuuuuaaacauuaaguguauuuuaagccugucaccuuuaaugaaugaucaucuccauuagauuuuauuuauucauucuucucagauucccguuugauguuuauaaauggugcaguauuugcuauccuuuggaguagcuaauaguaguaggacucuccugagcuuuguugugcucuuaguguuccucacacuuugugugcaaugcagauaggcugaguagagaguaaucuuaguagaacuggaaauguuaggaaccaguacguuaaggugguuggccgcuggccacuaaauuguuguagcaccacuugggaaaagaaaagauggauuuucuguccuuaagccucuggaaaauaccuuuagccuuuagagaauugugagagaaacauguuugaauaugaacuugugaguuccuauggagaaaaaaggucaauguaaaaucuagcaccaggauauauuuauuagagauaugaauuguacuuuccuacaggagaaacugcaaaaaugggaaaauggaaggggagaagaaaaaggaagugaagggaggugaagcuacuuaguuaauggugauuaauuucaguacauuauugaguuaauuucaguaaaguagauuuaaauuuugaguauguauuuuauuggaggggauuuuauguggagaaauuuguucugaaguugaaaauguguuuaugucuuaugagcaucuuuuuagaauaauuugauuuucauauugaaagccaaggguuuuuuuguucucauuucuacucauccagugaguguacauuccuaagaaauuguuuuuguugccaaguuuuuaguugauuugcgcauggccuguuuuuugugccugaauauaauuucuuuuuuuuuuuuuuuuuuuuugagauggagucucgcugugucacccaggcuggagugcggugcugcaaucuuggcucacugcaaccuccgccuccuggguucaaacaauucuccugucucagccucccgaguagcugggaauacagguuugugccaccacacccagcuaauuuuuguauuuuuaguagagacaggauuucaccauguuggccaggauggucuuggucucuugaccuugugauaagcccgccucggccucccaaagugcugggauuacauccgugagccaccgcgccuggccccugaauuauauaacuuuuagggaagcauuuucuguuuuuguuuuuaucaaauaguuguccuccaucaaaaagcuguaucuuucacauuuuaugaaugcccuccccauauauauauguggaauaguaucacuugaauugcaucguauugaucuaauuuagaguaacugcuugauuuauuugaaaguuaagacuacaguguguucauaauucaugucaauuuauggggcuuaauuucugucucaugaguuagugccauagagucuuugaaucucuucagaauuuccauuaccugggaucccauaccucuugucuggcuguucccauuaaugugcuuuuuuuggaccgcaaacaugucaugucagaugguuaauggaaagaugagauuaaaacacaccacaagacucugugcauauggaaaucugaacucacgcuaugaauuggugauuauuaaaagcacaaaaaauuauuaauuuaagaaaugaaaaguauaagcguccuauuucaguauaacuugcccugguauguuuaaguaugaagugcauguggagagucucauaaaauuuaaagauaaauuuuaggaaccaaaagcaauuguacauuaauaaggauuaauauuaggcauaucaaaaauucugugaaauuaaaaauuaaaaauucugcuuguuaaaccucaaauuccccuuucuaaaauaggauagggaaagguggaaaaaacuaaucaugcaaauagcuuuuaauuauccucaccauuuuuaaaaguaauagcauacuuuuaaaauacauaauucacucauuuaauagaauggaauuguuggauuacaaaucugcauuuaccuuucugaggaacugcccaaguacuuuccaaagcaacuacaccauuuuacuuucccaccaguaauguaugacauuaccaguuuccccacaucaacccagcacucguucauuauucaucuuuuugauuauagccacccuagugggugugaaaugggugguuuugauuugcauuucucuaauagauaauaaugcugagcaucuuuucauaugcuuauuggccauuuguguaucuucuuuguggggaaauaccuauugaaauauaccuaauguaaaccuuaccauuuuaacuauuugaaguguacaauuuauugccaguaaguacacucacgauguauguuaccaucacuaucauccaucugcagaacuuuucauuuacacaaacuugaaacauuguacacauuaaagaauaagucccuucaccuuccuccccacaguuccagacgacucuaaauugacuauucuugauagcucauauaaguggaaucauacaauagucguucuuuuugugucuggcuuauuucacuuugcauaaugccaucaagcuuaauccaugucagaauuucuuucagauuaaagacuggauaauauucguguguguguguguguuuaucucucacauuuugcuuauccauucaugugcuguuggcacauuuggguuguuuucaccuuuuggggaucuauggagaaaugggauuccugaaucauagggugguuucauaauuuuuguuguuguuguuguuguuguuuuuggagcaaccaaacugcuuuccacagugacugcauuguuccuaccagcaaugcacaagaguuuugguuucuuggcugggggcaguggcucacgcacuuugggaggcugaggugggcugaucacgaggucaggaguucgagaccagccuggccaacauggugaaaccccgucucuacuaaaaauacaaaaaguuagcuggacguagugguaggcaccuguaauccuagcuacuugggaggcugaagcaggagaauugcuugaacccaggaggcagagguugcagugagccgagguugcaccaccacucuccagcccuggcaacggagugacacugucucagaaaggaaaguuucaguuucucuacauccuuggccagccaauacuuguucacuuguuuuuuagauaauagccaacccuaauggguguaaagugguauugugauuuggauuuacauuuccccaagauuaaugguguuaagcaucuuguguguuugcuauuuguauaucuucuuuggagaagugcguauuuaaguacuuugcccauuuuuaaauugggucaucuuuuuuguuaaguuguagguguucuuuauauaaucuggauauuaaccccuuaucagauaaaagauuugcaaauauuuucucccauuucacgauuugacuuucugcucuguugauaguguccuuugaugcacaaaauuuuaaauuuugauguaauucaauuuaucaauuuuguugcuugugcuuuugguaucacacaguaucuuuaagagacagggucuugcucugucgcucaggcuggauuccaguggugugaucuuggcuuacugcagccucuaccuccugggcucaagcaauccuguugccucggccucuugaguagcugggacuacaggugcauaccaccaugccuaauuuaaauuaauuaguaauuaauuauuuuguagagacggaguauugcuguuugcccaggcuggcuuccaacuccugggcccaagugaucuuccugucucggcuucccaaagugcugggauuacaggcgugagccaccacaccuggccucguauaauauuuuuaugucgacacugguugccuucagaauauuuugggacuauaucaggaagcuuucaagcucacagugaagaauaaaaauuguccagacuuuuaguuuuuugcuuagaaguucaaauuuuuaucauugguaacaaauacugucaguuauuuaucuugaaaugacagguucacuuuauuuauuuuugagaaaaugucuaccacauucuccuaauuuuuuuuuuuuuuuuggaaauggagucuugcucaucgcccgggcuggcgugcagugaugcaauccucagcucacuacaaccuccaccuccucaguucaagugauucuccuugccucagccuccuguguagcugggauuacaggcaugcaccaccccgccuggcuaauuuuuguauuuuuaguaaagacaggguuucaccauguuggccaggcugaucucgaacuccugaccucaggugauccgccugcuggguuuacaggugugagccaucacacccagucugcuaaucuaaauaagcuuuauuuguguggcaguccuuucagguuaaaaugcuguucuaugaaaaauagcuaguucagcuggcagcggucuaaauaaagguauuguucuuugagaaucucauaccucuuugauaugcagcauaauuuuuuuaauaccuguuucucauuuuguuacacagaauauguaaaagauguauucaaggguugggauuuaaugaaauuaguaauuuuuauaucuuuuacacuuuaaguggaacagauuuuuaaaauuacgaguuugugaaaauucuggcuucugcuacagcuaguaauacaguuuggugcugcuguccugacucuugcuacauggauuaucaguuuuauccaccuugcuuuuauaccaucagugcacacauuaacagugaacuagucagcccuuauucuuuugacaauagcuuugaccucuuggaccacaauuugaaaacugcuacccuaguuuauaggguugcugcaugggauggaaggugauuacagaugggcucccguuaauuuguguaaauuuguuuaaguagucaaccuguguaaagagauugaucugcugucacuaaugguaguacugucugccugaggaaaugguuagcauuccugacucccgugucuccuggaauuuacacuauucaggcagguauccucacaaaauuuccuuuuauauuacuggugaaaugugaggaaagagggauaaaaagguguuuauguuaauuugauaaaugaauagaugugaaaaguaccuaagcaaauuauguauuuuuauugugcaaguacugguuggauagaaccugugauuaugugccuuaaucauagguacaugccuuuugucucuuaagugacaaaagagccugaagauauuaacugaaaggggaaaaaaaaggagaaaguaaaguuuauuuuguuauuuaguagauaauagacaaauuuuacuaguccaugcaaacauuguaacuuggaugauuaagguauggauucauucugacuuaauaggauaguguaacuaaugcccaccugguuagguuuguuaugagugaaagagucaaaauauuauuuuaaacauacuaagaauaggaccuaacacaccauagacuuucaggcagagguaguucauuuaaaagaucuaaaugagagaucuggguuuuguuuggguugggaguuggauagcaucaggauggagcuugugauaaaugaggcaugaugugugcucuucaaugacggcauucucauuacuaauuauucacaucuuaauuuuguuaguauuagugucauaguauauuuuauauuuguguuuuguguucaagaauugugaagcuacaugguauuauauauuuuuuaauuuuuugcuuauaggauucaguggucccaauuuaaaggcuauuuuauuuucaaacuggagaaagugauggaugauuucagaacuucagcuccugagccaagagguccucccaacccuaaugucgaauauauucccuuugaugaaaugaaggaaagaauacugaaaauugucacuggauuuaauggguaugcacuuaauacuguuuuaaagauuuaauuuuuagcagaagaugaauagauuuuucuuuuaguuuugaugugucugguugaugauugauuauccauuagaauaaauuccuuguuucuagugacauguaguaguugaugauuuuuagcuuacaacuauuuaaaauauuuguagccucuuaaaaaacuugaaccaccuuuuuauagguaucaguggaaacagucauuuaucaggaaacauuuuaaugguuuuucuuuccuguuuuauauuugguguuaugucuucauacuuuauauagaaccuuuauaucauugagaaaucacauuucuuuuaaaacgaaauacuaauuuauggaaguauuuuagugaguuuuuguuuagacuuuuuuuggagucaucauuucucuccuaaguaacggcuugcuuguuaguuacaaguaaccauuuuuggccgcuuguaaaacauuaaaaacacuaaaaagauauucuguacaaaaguaaaacuccccgguuuuuuuguuuuguuuuguuuguuuuugagaaggugucucgcucugucaccuaggcuggaauacaguggcgugaucuuggcucgcugcagucucugucuccuggguucaagcaauucuccucccucagcuucgcgaguaacugagacuguaggcgcaugccaccacacccggcuaauuuuuguauuuuuaguagagacaggguuucaccauguuagccaggauggucucgaucuccugaccucaugauccgccugccucggccucccaaagugcuggaauuacaggcgugagccaccacgcccggcaguacucauuuuuaaagaaauguuacugugucucauacucugucauuuuaaauucuauuuuuguaggacuuuguuuuuuguuuuauuuuguuuuguuuugagacagagucucgcugucacccaggguggagugcaguggcaugaucucggcucaccgcaaccuccgccugccagguucaagcaauucugccucagccccccggguagcuaggcuaggaccacaggugcgcgccacggugcucggcuaauuuuuuuauuuuuuaauagagaugggguuucaccaugcuggccaggcuggucuccaacuccugaccuugugauccgcccaccucagccucccacaguguugggauuacaggcgugagcccccgcgcccagccaggacuuuguauuuuuacgguuuccuuuauugaagggaagaaguguuugugaaguugaauuauucgauauuuaguuuggcguuaacuuaggguguggaacaacaauaccaaauauaaugaauugugguuuuucuaaccagugaauucauaguuagaauuagauaguauuugaaggguuucaguuguauuuuuagauggcauaaauggcuugauucuuuagguauuuaauugcaugggauuuugaaauaagauaguguaauccaguuaacgguuugcuuuauaucauauuccacuguuuuuagguuuaagaauuuugcuugaaaugucaaacccuuaggccuugacuuggggucuguuacaaaaauauuuugugggggagaaaucauagcuuuugucuuugagguucaucaguuauaguuaccccugggggccugggaugggaaggagaccuauuuucacugugcacccuguuggacuguugaaauuauuuaaccaauauguguauauuuccauaucaauauuuuaaaauuuuucagaaaaaggaaaaaaaacauuuuaaaggcacuuauccaagaaauagccacaugauacauuuuagaagcauguugcauaagauuuacuguugaacuaaaugaauacauucaagauuagaauacuucucggggccaggugugguggcucacgccuguaaucccagcacuuugggaggccgaggugggcagaucacuaggucaggagauugagaccauccuggcuaacacggugaaaccccgucucuacuaaaaauacagaaaaaucagcugggcguugucgcggacgcccauaaucccagcuacucgggagacugaggcaggaaaauggggugaacccaggaggcagagccugcagugagccaagaucucgcuacugcauuucagccugggugacagagugagacuccaucucaaaaaaaaagagaauacuucucgggguuauuuauaaauuguacauauauauaaauaguacuuagacauagugagucgucuuuuauuucaauaaauuauggccgucauucaaaaauaaaaguuaaggugaaacaggucaaauuauacugcugcuuuguaagcauauuuacuuguuauucugaauuaguaauagcaaauaccauuuucaguucauucacauuaaguugggcuagaaacaaauacauguauuauauauuauauauaaauauaauaaaauuaauauuguguauuauuuauuacauaaaucuaaauauuuguaauuucuuaaucuguaaaagagguaauucaccuacuucagaaaaugauuugaacagucauuaaaugccugagcauucuucuuuuacaacuuuauuuuugaaccguauuuugaaauuuuguuuuguuuuguuuuauuuuauuuauuuagagauggagucuuugucacccaggcuggagugcaguggcaccaucugggcucacugcaacuuccgccucccaaguucaagcuauucuccagccucaaccucucgaguagcuggcauuacagggugcaucaccacacccagcuauguuuuuuuuguuuguuuguuuauuuguuuuguaguuuuaguagagacgggguuuuaccauguuggccaggcuggucuggaacuccugaccucaaguaaucuaccugccucagccucccaaagugcugggauuacaagcuugagccaccgcgccuggcccgaacuuacauuuuuuaaauuugauuuuucaguuuaugaaucacuuucucugagcaggcagaaucuaagucuuauuuaaucagugauacaucaagauuuuucuauuuuuaauuuacucuuuuuuugucuguauuuuaauauauugguauguugaaacauguuuacaaaauguucaauuuuuguguuuuuuauauauauauaguuuuuuaaaauauuuacuaagaaguaacauuuuguugguuuuccaccaguuugaggguuuguccauucuuauacacuccuccccccauuuguaauagauaaucuuuaaauuacaaaagcgguguauguucacgcuuuuaaaaagauccccacuguuacagaaguacauaaagaaugaaaguagaaucaugcuauaugcuagugguauuuuccuuuuagagaagcuucaacaugucuauauuaguacauuuaaagcuaucuuuuuauuuauuugaaauggcuacauuguuuucuauuaugugaauaauagguuuuuauuugccuguccugauugaugguaggcauuuauuuuuuuggcuguuaacaagcagugcuuguagugagcauccuuccacguaucuuuuguugaugaaugucauguuuugaauauacguauagauuguugccuuuuuuuuauuuuuuucuggagacagaguuucgcucuugcugcucaggcuggagugcaauggaacgaucucggcucaccacauccucccccuccuggguucaggcgauucuccugccucagccucccgaguagccgcguuuacuggcaugcgccaccacacccggcuaauuuuuguauuuuuaguagagaugggguuucuccauguuggucaagcuggucuugaauuccagaccucaggugauccacccaccuuggccucccaaagugcugggauuacaggcaugagccaccgcaccuggccagauuguuacuuuuuuuaauuuguagaaauguaauugcuagguuagcuuaugaacacuuaauuuucaguuuaucagugcugcaaaauugacuuagcaaaaugugguuguugaugcuuucuuuuguaauaagugcagauauuguaauucuucgguacuguauaugugucuguauuuguguuucuuugauugcaagugaaauggaacaucuuuuuguguacuuacagccuuucugugaauugcccuuuauaucuucuuuugacuuucuuuugcuaauuuucuuacugguaaguuuuuguuguuuuugcuuuuaguuuguaaaaguuuuauauuaaaugcuuccuaguauuuugccguaagaaagauuauccgcuuucuaaaauuauuuuaguauauuaccaaaguacaaguuuguuuguuuguuugguuuucgagauggagucucgcucuuugcccaggcuggagugcaauggcucaaucucagcucauugcaaccuccgccucccggguucaugccauucuccugccucagccuccccaguagcugggacuacaggcacccgccaccacgcccggcuaauuuuuuguauuuuuaguagagaugggguuucacccuguuagccaggauggucucgaucuccugaccuugugacccacccaccucggccucccaaagugcugggauuacaggcgugaaccacugcgcccggccaaaguacagauuuuucccucuuugaaguggaaauuguccaugcacuuguuuacuugauuuccugaacuauaagcuucuggagagcugggguaacagucuuuuccaaacaaggccuagaagagugagugccugaauauaguagguucuuaaacagacaaguauggaaugacuaggugcguggauggauaaaugaaugaaugaguaaagaaaagaauauugaauaacuggggacuagaaaaaaaagaauaaaaguauauuuauaucuauuuugucuauugaggcauagaagaaucacaauggaaugcuuaauuucuuucuuuucuuuuuuuuuuuggucauuuucuugucuuuuaaaauuacuuuggaacuuuaaaauuucauagaagauggauuauaacuacucuccaaaagugaaguuacaguuugucagaugagaaacaccaaaaauuaaaaugaacgaaacuaaaaauuuuaaugaaauggucaauuaaaagaccauuuuaugcccucuggaauuauaauaaaaaagaguauauggguuuacucaaaccagggccauuuaugaaaauccuccuccuauuacagagaccaugaauauaauuuaggaauugcuaauagguaaugguucauuccuauaaugguauacacaaagaggcauuuuguugagggauagagagcauguaaguuacauuccuggcaguuuuaaaagauaccauuuuauguucucugaauuuuucaaaaugaaagaauaaugaauauaaaaguaaguuaaucucucaagucuugacccuuucuugucauugcuguuaccucuaaguccucucuaaaguaggcagucggccuccucacucugugaauaguaaacuaaaauaguguuccuauauauuuaugaggaggucuggaaaaaguggaaaacuuuugauaccuaauaaucuuuauaucaucuguuaagcagguacagucagucacagcugagaguacugcucaugaucuuuuaaaguuauauaugagacuuuuauacuccaaagucuggauuguagaauaaaacaacccacauuugauuuucaguuuguguguuguuugcuuuacgguuagcuccagaugauucagggacugagagaauggguccuuagccguuuauuacuuuguucucugacacuguugauucacuuuauugcuuccugauuuuugugcuccccaguugccuggggaaaauagguuuuugugcuguuaauuauuugugucaguguuuguugaguauauuaguuaaaauguacuuauuuguggcagauuucugucucucucacauacacaaacccacacccacccaccccuacuuacuuguuuuuucuuuauccccuuucuuucucuuagaauaauuacuugagaauuagcaugacuuuguaaccaucccuccuuacuauuccccaccuggucuugucuagugguaauauggcuugaugugauacucucuuuaauaaacuuaaaaauugaaauuaacagaaagccuaauuaacuuuuucuugcuaguuauauuugaugcaaauaaaauaacaguucagacuauaggaacuccaagagaugauuaacuuuauuaaaagcuuugacaauugcuauagauuaauuuugggucaaggaguggugcagacauuaguuuacuuacaucauugggguuccuuaucauuauuaaaagaggcgaaauuagcugggcgugguggcucacaccuguaaucucagcacuuugggaggcccaggcaggcggaucaugaggucaggagauggagaccauccuggcuaacacugugaaaccccgucucuacuaaaaauacaaaaaauuagcugggcgugguggcaggcgccuguagucccagcuacucgggaggcugaggcaagagaauugcuugaacccaggaggcagagguugcagugagccgagauggugccacugcacuccagcgugggugacagagcgagacaccaucucaaaaaaaaaaaaaaaagcgaaaucugucauuugauuugagacauaagauuauauguguaugaauuuucuuuugguggggacagaguguugcucuauuaccuggguuuaaacaauucuccugccucaagcaccugaguagcugggauuacaggcaugcaucaaccaugcccggcuaauuuuuguauuuuuaguagagacaggguuucgccauguuggccaggcuggucucgaacuucugaccucaggugauccacccgccucggucccccaaaaugcugggauuacaggcgugagccgccgugcucagcuaauuucgccucuuuuaauaaugauaaggaaccccaaugauguaaguaaacuagugucugcaccacuccuuaacccaaaauucauaaauauaaauauuuaugaauguguauguuuauguaaauauuaaagccugaguagagaaagaacauacugcuucaaguaaagcuaguaucacaggauucuaaugguauuucugacuuuuguaagacuuuguagguguaaacaaaauuaugaacuuagucuuugguaacagagauauuguuaguuuccauguugacaguuaaguuuaacucaguauuucuguuaacuaagacaccacuaauguggucauuuagucagaaaagacaguaaaauccacauauacauggguaaaacaaaagugaaugacuguuuugacuuuuuuuuuaguaggaugucagauuuuuauggucauuucuuuagcuguuuacuccaguagccucugugcuacauguuacauuccuuugucuuuuucauguggaaaaguugcuuauauaauuuaaaguuaagguaguuaaacugauuuuuuuagagucugaaugaagugcgcacuuauuuuuugagugccuugucaacuuaguacuuuuauagaaauuuagguuaaaauacaugcuuaagacauuauuucuuuaguguuuagccuuaugacuuaaaauuuaucuuuuaaaaaauagcauugaauugcuacuuuauguuaagaugucuuucccugauauucagcaacuuucuugguauuugaauuuccauagcuuuuagguguacaagacuucugcuuuuaaaaaaaaguaaauagggacagcuugcauuuaaauuaagauauauaagguaaaaugugugguccuauuaauuaggguaaguuauuuuccuuggaauuaaagggaguauuuuuaaagacagaccuauacuuuugguuuuguuggucuuuggaccaugugugccuucccacaaucucuaucaaagaguagauggaaugaugacaauaagaacuaagauuuauugaacuuucugaaauauuuuaggcacuguuaggugauuuaauauaccauauacauuaugucguauuuagucgucaugauaaucuuugaaguguacuuguagaacccuuguuuucagacaagacccaugagacccaugaagacucagguaaauucaguuuugaguaaggucuccuagugggguagcguguguguguguguguguguguguguguguguguguguauuaaaauauauauauauauuuagcaaagguggauccuuaauguguggggcgggggguuuaaaaaauguuacuggauguuguaggcacuguuuuaaaaaauuugagaugcuagcuagucauguccuuuuuucaguuccuuauaucaucuuaguuuuccauuuuacaauaugaauaaaucagaugauauaucauugcagaguaaaccaaacgcuuuuuuuuuuuuggagacagucucacucuuaucacccaggcuggagugcaguggcucaaucucgacucacugcaacuugcaaccuccaccgcccagguucaagcaauucuuuugccucagccucccgaguagcuaggauuacaggccaggcugguucuugaacuccugaccucaggggaucgccugcuucggcuucccaaaguccugggauuacaggcgugagccaccgugccuggcccaggguuuuuuauuuuacaguauaacuuugcuaaugaacaucugaucaccacuuccccccaaauuuaaggauuucugaauagacuuuucauugagaaugaguggcauguguguuuaacgcuccucucccuauauuugcuuuucuuaguaugugugggaaaagccuuaauauuuucagaaguuagaauaaacuauuuuguaugcuaugucuaauggaugaguaucagagagcagagcuuucauauacuuguaccaaaugcuuucauuuuguacugguuuuucugguuuauucuugugccuccuuuuagaggccuaccucacacuaaguuuucccagugucacgcuuacuaagcuuggcauacaguuuauucugucuccauggcacuuuuuauacaguguuguuauuuauuacuguaauuguaauuauuuacaugucuuuugacugcuguugaacaagguugguauuucuaguuuauaauaggcucuuauauuuauggaauaaguuuaaaaguacagucuguauguaaagagaccuuucaaugcuguuacguucauuuaucauacuaauauuuccaguggauccauugauuugcagaaaguguuugguugggauuuagccugucgugugagaaaaggaaguguugugugacauuuuagugccaucuauuggauacuugguaaaaugacuuuuaaagcuucuuuuacuuuuugaaauaaggaucuuuugaaaaaagcuucugaaauugucuaagaacuuaaacucguuuuaucauugcugguauugcuauguaaacacauaccccccucccaaagcaguauuaauauuaaacaacacauaaaauauuaauaauuggcuacaauuuaacuuacauuucuaaagaaaauuagccaaagcauucaguguacauguuguuaaacaagaaguuuuaaaauauucaucuguuaaaacuaauuuuaauuagugagaaaacauuagguuuuaaugugggaaagaauuuuaguaggaagaaaaagcauaaugacuagacaguauuuuucaguuaaguacuauuugaauacccaaacacuuguugaauacccaaacuguuggugcuauuuuguauauuuugaauaauaaauuuuaaugacaguaucacuauggggugauuaaugaggaaauagcuuagguguguuguguguguaagguuugaagagccaugaacuagaagaggagcuaaggugaguuauaccacuaaucugaaauccacgauaauacuggguuucacggacagacaauugagaaacuaauacuguuuguuauacauguggaaaaugcuuaaacauuuuuaaaguagaguuaguuuuguguauuagcuauagauuucuaaugguugucuuuauaggaaugaaacaaaagauguauaagcuuauuguuucauacuuaguaacgcuguuggugugcuuuguacuuccccauuuaaaaggauucuucauuuugacauuguacuucacucugaguagauuuucaaaagcaaaaaaguauucuuccucagaaacccagaggaauuucuaguugcuucugaauguuuggaauaucaggcaaacauuuaaucuuuuauucugugccuugucuuuugguagaacaguuuucucacuuuuagguuuggauucgauuuuagguuugagacaaaagauugauucuuggacucucaaauuuaucuaaaaacauuuguucucauaugaauaacaugcacuuuaagcacuuucagaauuuuuugcacaucuuauacuuugaacauaagaauaguauugacacaaagaauaugagaaccaaauguaguuuauccaguuagaaaauaaacaacuauaauuuuguaaaauacgugugguacaauggaaaggacaugagauuugaaguuagagagacugaguuugaguccuggcauuuuaacucacuaacuacuauaccuugugguggaagaaaauucuguaucacacugccuauaaaaaaugaagaccuuugugaauguuaacuauuaauuugaggcuuuguaauucuuuucauuaaagagaauaaauagauugguauggcagacacugaagucugaagauuuguuuguauuuguuagcugcguuugucguaccucgugcucauaacuuugcuguucuguucagcuuguaauucuuaugaaugcuaauagcuacaugagcucaaaacuuaaaaauauuuauaaaaugauuuuaguuccaacuuauaucaguuuuguauuuacuguggucaaggaaaaauugagguauagugaaauuauuugguaaaguuaaauaaaaguuguguauauuuuaaguuggauuaaacuuagauuauauaugaaauugcaauaauggagcagaaccacauuuaaaauauuuguaguuuuguuugaacauuuuaaagaaaccuuugagugcagaagaauacuugaggaaaaauacauauauuaaauaacccccaacuugauuauuauuuguguuaccucucuuguaaacuuaaaaaucaaauuaucaggauuuagaauuuucuauuauauaaaaauuuuuuccucaguuuugaagcuuucuguugauuuuggguguucuaaguugcuuuuuuuuuaaaaaagaauuucuguugguaaauaguagguuuacauauuuaugggguacaugagauauuuugauagagccauacaaugcauuauaaucacaucaggguaaauggguuauccaucaccucaagcguuucuuuaugcuuuguguuacaaacaguacacuuauacucuuaguuauuuuaaaauguacgauaaauuauuguagucaaccuguugugcuaucaaauacuagaucuuauucauucuaacuauauuuuuguacccguuaaccauuccccccucccuccccccccaccuuuauugcuuuuuaaaggaagggagaaugguuuuuuuguuaaauagaaagguaugcuuauuuuauugucuuuuuuuaaaugacucauccauuuauuucccuauuauagcauuuucuuuuguagcuuaauacaugggugacuagauacagcuuuaccuagcaaaagaaauaauguuccucguuuucuugauuaucagugaucucacacuguaaaauuauauuuuuuugcaguaucccuuuuacuauucagcgacuaugugaauuguuaacagauccaaggagaaacuauacaggaacagacaaauuucucagaggaguagaaaagguauuuauuuuauuauuggaauuauauuaugcugugguguaauagcuuuuauuuuagaaaagaacauugaguaagaucuguuucggguaccacuucuugaaauauguuuuucagccuaccuugaguuucccaaauuguuuuccaaauugcauucuguuuuacagagagauuuaauaggaccggguagaggaggguuuguguguuggucauugaaguuuggugaaagcagcuuauuauuucuuggaaauucauaguguauaucaacuuauuaaagguucugugaaguuauaauugcuauuuuaacuuuauagaguguuuuauaaacuuacacauggaauucauuuucucaauucuggaguucaaagguacauaacuuuggaaacuuacuggugccaagcauguaaaugagguauugaguagaaagaugcaggucagauuuagagauaaacauuaguguuuguguguggaggggguugagggaguguuagaauaagggaaggguauucugaauaaaggaaauggugugggcugggugugguggcucaugccuguaauuccagcacuuugggaggcugagguggguggaucacggucaggaguucgagaccaggcuggccaacauggugaaacccugucucugcaaaaaauacaaaaacuagccgggcgugguggugcacgccuguaauccuagcuacccaggaggcugaggcaggagaauugcuagaaccugggagacggagguugcagagagcugagauggcaccauugcacuccagccugggcaacaaagugagacucugucucagaaaaaaaaaaaaaaaaggaaauggugugaagaacaaagauucaagguguuuaagggaaugaaaaguaagaaauugacuugucuugagugaaaaaugaaggaagcccugugagaaccaagauuggacuaaugaguucuaauuuucaguugaugguugguccggaaacacuccccuguucauuuaaggaucugguucaaauccacuuuauuuuacccugggaacaggaaucaaaaaccauuacauagugauuuacaguaguuuuuguggccauacuggauuaauauauuuuguugauccucuguacacucaauugaauaauauccccaaaggccaggaaacugagauggcucaucaguacuuacuuuucagcuccaggaguuguaauaauuacauuuuggagauuuucagauaaaguagcaauauguuacaguagucauaccaggugcccugccuuuaaaucaggguugcaguguuucauaguugugugaccuugggccaguuaguuuucuccucuguaaaaugugguuaauaauagggcugggagggggauuaaaugcaaaacacuuacugugacucauacuaaacuuucagugaacacugaauauuaguaaaguuauuuuuacugggaagaucauaaauauauuacaaaaaagguuugagucucuuucugugggauauaugaugcaacacaacaagccguggauuggguguugcuuuguaaggaaaaucaauuacauaugucuuaaguacuucaaucucucaacaucuuuguugauuccaucugagcuuaguuacucuacuacguauaguguaugauguuacgggucuagaauaacuagauuaggguaaaaaauaaguauaggaaaaaaaaaauuaguggcugaguaggauauucucuuuugguccuuuguuauuguuuuaguuuuugcuguuucaccaguuuucauuuuuaaccauuuuccuuuacuagcaaaauuagaaucaaugggaauuuaacccaccagagugauuuuagaaacaaaaaugaugaaacuuuauguuguaguacuuuucuucauacuaaaucacugauuuuuguuauugcagaaugugaugguuguuagcuguguuuauccuucuucagaguaaguauauuuuuucuauuucuaguauauuauuuacuauauuuaaucauuuuauugcuucuaauauauuauucuuaaaauagacugaauuuauuuaauauguaauuaagugugauaacauacuugugaaccuaccauucaguccccaaaguagaauauuacuaauaacauuaucuauauguuuuuuccauuaaagagauuuggauuaaagagauuggugauuuacuguaauuuuaauauuguuggauuuacauacugugguggcacucauugcccugagaugccauucuagaugccuuuccagggugucucuagggcauaauucccauguuuggaauaacuacuugauggcuuuucucuuuaugauggaaaauauuuccaguugucaagauuuagauauagcaaaguaagaauuaaauuuggauacaauuucucaaccuuggaacuauggacauuuuguaccagauaauucuguugugaguggguguccuggggauuauaagagguuuagcacuguccuugaccucuacccacuuaugccaguaguguuccccucuccaaauaucuuuagacauugccaaaugucucuuggagaugugaaaggcagggaggggagguuguccccugcugagaaccauugguuuaagguuaaucuggcucugcuuucauagacuacucuguuacccaggcuggagugcggugaugagugaucauagcucacugcagccuuaaacucuagugauccucccgccuuggccuuccaaagugcugagauuacagaugugaaccaccacacccagcccagucaauuuguuuuuagaauguucccaagaauauaguuauguugcuaaauaagauacuaaaauaaucccauacuauauuucuugacagaaaaacuauuaaaauguauacaugauaaaaauuucuuuuaugaagcaaaauauguuuuguuuugcucaugaacgugagguauuuuggaaaaaugguaaagaagugcagagucaagucauagcgacuaauaauggguuauuuucuuaaauuguaugcuuauguuaauucucacagucuuuuuguuugggucugugacagaucuuacaaaagaucuuuuagaccuaugauucuuaacaaaauuaaagaauuaagucggaaccaauuuuccacaaugucucaucuaagaaaggacucacagcccagcagcccaggagaugacgcaauggacaggagugggcucccugaccuucaaggaagauuugagcuaucugggaaaaacagacaguauccacuggaugcauuggaaccccaacccagcauuggggauauuaaggacauuaaaaaagcagccaagucuaugcuagacccagcacauaaaucucauuuccacccugugaccccaaguuuaguauucuuguguuucauauuugauggguuacaccaggcauuacugaguguuggugugagcaagaggucuaauacugugguugggaaugagaacgaggaaagggguacuccuuaugcuagcagauucaaagauaugccuaacuuuauugcccuugagaagucaucaguucuccgccacugcugugaccuuuugauaggcauugcggcuggaucaagugauaagauuugcaccagcagucuccaaguucagagacgauucaaggcaaugauggcaucuauuggaagacuuucacauggugagagugcugaucugcuaaucagcugcaaugcagaaucagccauagguuggaucagcucaagaccauggguuggagaauuaauguucacacuucuauuuggagacuuugaauccccucuacacaagcuacgcaagucaaguuaguugccaagaaagcacagaugacaaccuauuaaugcugugagaauguuucuagaucagugcauggauggcuccauugcucuacgggccauugugucugagaucccagucuuugaggagaaaaaaaacaaugguuaaaaaggcauuggggaaauauuuugaguuuggggguguacuuugccaccccauuauuggggagcugucaccacgaauguucccaaacuuagcaacagcggcaaacuacugggccaagaugagcaaccccacauuuuugggauuuaaagcuccugauguuauaccaggaucaaccaucacacucccuuugcuucaaauggcaucuaccccguaagaucuugaggggggaguguuggguggaaucauagauccaugcacuccuaacaugaacuaauucucauuauuuaaaaaaaaaaaaaaaaaaaaaaguccaggugugguggcuuaacgccuguaaucccagcacuuugggaggccgaggugggccgaucacuugaggucaugaguuugaggcuagccuggccaacauggcaaaaccccgucucuacuaaaaauaaaaaaaauagcugcgcauggcaucacacgucugucaucccagcuacuugggaggcugaggcauaagaauugcuugaaccugggaaguggagguugcagugagcugagauugcaccacugcacuccauuccaccuugggugacagagccagacuccaucuaaaaaaaaauuaagucauccacaaguguauuuucuuuucuuauaggaaaaacaauuccaauaguuuaaaucgaaugaaugguguuauguuuccuggaaauucaccaagcuauacugagaggugagauucuagauuuuuaauaccuacagaguuugcauuguccugauuuugaguagcaggcuuaguguacuuuuuaaaaauugggcauuuuauggacaccauaggaugaacuacauagaauuaguuaauuugguaaggcaugggccugaaaacaaaguugcagcaaauacuucugugauguauucacaucaacauaccuuaagagggaugacuuuuuauaaaaauaggaaaugauguucauuuaucuuauuauaggucuaauauaaaugggccugggacacccaggccacuuaaucgaccaaagguuucuuugucagcccccaugacaacaaauggguugccugagagcacagacagcaaagaggcaaauuugcagcaaaaugaggagaaaaaucacagguuuguauguuuuauauuuaaaaacaguguuuuuauuaaaaguuaaaguuaacauuuaaucaguacuuaucacuuacuauuuauaaguucugagggacagaacaagguuuucaugcgguuuauaggagcacuggcuucucuuugcagcuguagcaaauguugaagguggacauagacaagacuuaaaacugcuaauuuguggagacuguuuauguagggucuaaaaguaacguagauaugaugauccauuucauuuguuguuucugaaaguuacuugaaaagaaaugaucuuuauaaauaaguugauuuuugugagucguuucucauuguaguucauaaaaggacaccuuuuguuuauaucuucaaauuuucuguaucacauuaagggaaggaagacuaaaugagggagaggacuuaagagaguauguccguauggaagacuugcggguuuauuguaggagaauauuuaacuuacuggagaauugcacagaaaggucauauagcuuuucugaguccuacugggaauuauucaucaaacaguuuaguuuaccuugaaauuauucucuuguguuuuucuuuguucagguguuauaauuuaacuuugacacugaaauacaauuuaaaacauuauuuaaccuuaaaaauggggauguagaagauggggaaaauaaucuuauuaaugacacuuuaaaaaaacauuuacagugacucuucgaccucugaaucagaaguuuccucagugagcccuuugaaaaauaaacauccagaugaagaugcuguggaagcugaggggcaugagguaaaaagacucagguuugacaaagaaggugaagucagagaaacagccagucaaacgacuuccagcgaaauuucuucaguuaugguaggagaaacagaagcaucaucuucaucucaggauaaagacaaagauagccguuguacccggcagcacuguacagaagaggaugaagaagaggaugaagaggaagaagaagguauuuagagaccaucuguaaaaggguggaguaaggagauccucaaauucuuguacuucauuuuuuucgugaaagaauuuuacguaauggaacuccuuauaaugcugauguugggcuuuucucccaccuguauguaguugcugcugaauuucaggggaugugauuugaacuauagaauaucagaauucaugaaacuuaacuguggagguauuuugaaaauacaauuuaacuacaacaacauuugcuuauuuuuagagucuuuuaugacaucaagagaaaugaucccagaaagaaaaaaucaagaaaaagaaucugaugaugccuuaacugugaaugaagagacuucugaggaaaauaaucaaauggaggaaucugaugugucucaagcugagaaagauuugcuacauucugaagguagugaaaacgaaggcccuguaaguaguaguucuucugacugccgugaaacagaagaauuaguaggauccaauuccaguaaaacuggagagauucuuucagaaucauccauggaaaaugaugacgaagccacagaagucaccgaugaaccaauggaacaagacuaacuauuuagaaacauuuagaugcaguauuuuacauacaguucugguuuuaacacuguauaaaacuuuuguguaauaaaauggaccuuuaguuuuacaagagaagcagguuguaaaauaaaguacuuuauggauaauucc

SEQ ID NO: 191665 - RNA, 22107 nt, Homo sapiens
uuguauuauacauuuuauuuaccugaugaaagcauuuaggacucaaaucuuuagagaauauauaauaauagccauauccuuuuaauuaauaaaauaacacuuuaaagacaggcauauuaccauuguauaugacaccuaauacacauugucagauaccacauaaacauauuuaucuuccaauaccaauguuuguuuuauuaaaacaauaauuaauuaauaggcucaauagugacccucaaguuaaucccaugacuuccccaggcucugcaugcauaaagaaaucauugugacagaaaaauaucaaccacauacugaagcauagcuugcuagaacaaauccuguacauaugaaugccagcaacuggggacacauuuaguauucacauuuuaugcaaacuuacuuggucaauuauuucuuuuuuaagcacagguuuauuuuggaauucagauaagaacugacacaucauagacagucauuguuaagguaacccuguuauuucaauugcaaacaaacaauaaacguuuuuucuucaagacaguuaccacuuuuuaagaucuuaguacuacccuaugcaaaaacaguuuuuuuuaaaagccugaacagguuaagauagauaauagccaacuauguuuucucaggugaaacuauuccaaaagaacuguacauuucagugauauaaaucagauccagaaagguggaucucuguuuaguucuugaaauauauaauucacaaaauaagacccuuguuguucuacagagguccccuaaacugucuuuuauucugguguagucucuaaaaccucauuaagagggaggggagaaaauuuagucuuaccagaaaugcucugcuuuuuaguagccaucaguuuuaggucuucuuuauguaacucagaaguucaucuuuuuccauuugguaaccacuuuuuuuccacuguucucgcaacuguuguaauagagccccaauuucuuuuccugaagaaaugcccacuuuucugaugucauggccacuuacaggaaauggaggaauggaccacugcugcauuuccuuuaggagacagugcucuccuugguacuucaguaguucacauacacgaguaguugcaucagguucccuagacuacgugucaaaaucaaacauuuaguuucgucacacaugaaaacauacacuuacaaucuuauccuaaaauuuaaauacucaacauaaauuuuuucauuuaaaauaaguaaaauucacagauuuguagaucuuaguuuuaauaaauuaauucuaaauucgugacgauacuucauauuucugaccaagccuaguauauacuuacaucuauaaugaagucuugauaggguuucaaugggucugaacuaucuguugcuuuaauuaaaucuuuccuauuuuuaacuauaaauaagccaagguuuuucuccucuuuugcgaucuucaaccucaaauccaauuuugugacaucaucuuguacuuugaauaaugaggccaaaagagucacuggcuuuggugaaaaaccaucaacauuuuuacugacuuugucaaauucuucuaaacuugcauuagcagguaaaccuguagggacaaaagcauuuuucaccuguuuuuaguggggauaaaaaaccacucauauccuaaaccuugccaccauuuuaguauccagaaaugcuuugucacuaggauacauuauauagguucagucugauguuccaacuuaaaggcgaaccacuaauauauuguuauucucuccccugucaccuucaaaaccucuaaaauguucuuguuuccauuaaagcuacaucaagaguuccagggguaguggugacaguggugucagacucacaaggcauacucuuucuaaucacaaauuccugacuuuacacugauacaagauccaccccccauucaguaauguuacugaaauuugaaauaugcccaagcuuaccgaagugugauaaaccauauaaucccacuauucucugugaaaaugaauuacaacguuuacugaacaauuucuguguacaagucacucuucuaaaagagcuuuacauguauuaacucacugaauccuuuuagcuuuccuauuagauagaggcuacauuacuuuuaaaccgcuuuuuuggguuagaaacuaacccaaguugcaaagacuagauaaggggcugagcuuccuucaaaccuaggucugacuagagacuacucuacaagcaccacaagcugucuuugagcucuucccuacucacgacaaaacuuaccccauaacccaaacuuugucuuauuuuaaaauacuccauuucuccaagaauucuucaaccaaaugagucaaacauuuuuuccuuaugaaauuugaaaccagauauuucacugccaaaaauucaaacacuuuauaacuugcucucaccuauauaaggagccacaucaagaucauagauaaggugaaucaaaugauuuacaugguuaccaacaagaauuuuuuucaguuccacccaaauccuuucuccugauauuccagccaagccuuuugcauuuucugcaauugcuuccaaagucucaggaucauggucaccagguuugucuacaauucucccauaaaaccuacaagacaaaaucuucacaggguauuaccucuauauuggcauaucacaagcaaaaucuguuuuucauuuuuauugguacuaucccauacaucugcuuaaugaaaacaacauauaauuaguuaggucuagaagggaccuuagaaagcaacuggucauuucuccaccuccucuuucuuuucccagauaagaaaacccaggaucgaauaaaauauaaguagccuuuuugagguuagcaagaacuaaaacuucaaggucuccaccucacuuccaaauuacugacucaagacauuccgaauggucaucaaaugcaauuccugaauuggcacuuauacuagaugaaaaaaaaaacagcauucuuguaaaggcagcaaaccaaaacaagacugcagugccuuaacagaguagucugaauuccucaaagcuugccugucuguacacauuaguacuuucaaggaaaaccuucaaauacgacucaucuaguugcgcacccuggaguauauuucgcggaaucuuagaacuggaagcccuaacgugcauguguuucccucucaugcccuuaaaauucuaaugaauucaucagcgguccaaagugaugcuaaauaaguaaauuaaugcuaaaucuggauuagugauacaaauacagcuaagucuuaaucuauguucuauuauuuauaagacagacuacaaauacucaaguuuagagaaacuacauugacaaaauauccauguucuguuauagaauauucugagagcaaucccaaccagugaaaaaugaauauuacuugacauaaacuagccaauucggauaguuuuuuaaaaagguuagugugugacauuuaaacaucauugcuacccacaaaacuagucaugcguuucauauuuaccaaguuuauccaagaucuucuuuuuuuuuuuuuuuuuuuuugagauggagucucgcucugucgcccaggcuggagugcgguggcacgaucucggcucacugcaagcuccgccucccggguucccgccauccuccugccucagccucccgaguagcucggacuacaggcgcacaccgccaugccuggcuaauuuuuuguauuuuuaguagaaaugggguuucaccauguuagccagcauggucucaucuccugaccucgugauccacccgccucggccucccaaagugcggggauuacaggugugagccaccacacccggcccauccaaguuucgauuaugucuuuaugcuuugauucuuuaaaucauauaacagguauuucuuuucaccaaaaucauuuuguugugaaccaucaccgauuuccaugacuaccuaaaaccguaagcuguaugaaggcgaacacuuucacucguucauuaccacguuuaaugcaccuaacacagggauugaccugugguaagcauucaaacaucuguguaauuaauaaaucaauggaggaaauaucaaucaaaaagaaaaauggacauuuaaaaagaugacuuaaaauuguaggaaagaugacauaaaguauaugugcguucugggaaugaaaauacaauaugaaguagcuaaguaauuuucacucauaagucauagggugcuaggucuccacuggagacagacauuugggaugucaccauuuuguacacugaccugcuguggguuucguaugaccacuguuaugcucuagucaugauauuaaaacuaucauuuuuuauuuuuaaaaauucuuaccugaaguaucuuaaaauucuaagauaauccucuuguauucucuguuuagcauguccaacaaaucuaacuuucuuauuuuuuaaaucuucauaaccauuaaaguagucaaauaaagugccaucaaaaccuauucauuagaaaaggagggagaaaaaucacuauuggcaaauaagaauuugaaaacacaagaaaaucagcuaaacacuaucacaaacaguaaaaauucagcagagugaacaguuauuaaaacacauacguauucauacauaucaacuaucaaauggaagacaauaaaagacugucuuuuagucuguuuagcugcauuuacaauugcaacuaaaaagauaauccaagaauaaacuaaacaagaaauaugcaaaacuuguaugagguggaguggagccaacaagacaccauacaagcuaauuuucacaauaugggaaaauaauagccaaaauaaaauggaaaaaauacguaacaggauuaacagaagaaacgaggaaaauauuuuuaaucuuggaaucuuuauaaucuugaagaucuuucaaacucagcaagaaaacagaaaacgcaacacaaaaacaacaggauuuucgaagaaauaauugaaugacauaaaaaaugaaauaugccuguauggcagaaacuacuaucacacacaaagucauaagugacauuuuuggaaaaauauauguaaguccauauuuuaaaaauggcuaauuuccauaauauauaaaaguucuaauaaaaaggccacguaaauagaaaaauaggcuaccuauaaaggaaauauagaaaucucuuuaauaaugaagauuuucaaccuuagucauaaauccuuuuuuuguucuuugaggcggauucucacuuugucacccugguuggagugcaguggugcaaucucagcucacugcagccucccagguucaggugauucuccugcuucagccucccaaguagaccugccacuacacacagcuaauuuuuguauuuuuaguagagacaggguuucggcaagugggccaggcuggucucgaacuccugacaucaagugaucugcaugccucagccucccaaagugcuaggguuacaggcauaagccaccaugcccggccaguaaauacccauuuccaagauagcgucuuucagaucggcaacgaugcaaacacuugauaacaguguuagcaagggugugguuaaaugggcaguccuguucauuacagaucaggagacuucacuguagagccuuuaaaacuuugugaauuuugaaccauguuaaucuauuagccauucacaaaaaugguaauaaacaaauguucucauauguugaaugaaaaaagugacauaaaacuaauuuuauauauauguacauaaaaccucaaguauuaauuaguagagugaccacuucauacugguuugccugagacauuccuaguuuuaaaguugaaaaucauacauccaaggaaguauuucaagcucaggcaaacuaagacaguugguuaccauggagacuuaaaaaaauagaaaaaggaauuuagagccgaaacacagacaccauucagcucaccaaauggggaggucagugaucuaugagauacuucacucuguagcauuacagaaaagaggcacugacaacuacuuaucaaaaauaccucuuggcuguguuugaacuugaauguucucugauuaucccaaaagcaacaguacauugguaaguucacacuuaaugcuuaacucuuuccaagcuguuaauaguuuuauaugcauaguaacuuuuaaaagggaaccaucuugacauacauggcaaauuucgaaggcuccagauucaaaaagacauaaaagaaaaugauaaaaagaaaauauguaaauaggcaaaaauaugaucacaaaguagcaaauaauaugguauauccaucuugguguuauuucuccuaaugaagagacuuguaaccgucccuggggaaccuaaaggcaagaucaaaauuuggaggaaaaaaucauaggaauaugaucaaagcaaaaauaagcguuugggaagcaaaguaaccaaccauaaaugccagaacuaugaaugcuugauccaauaaggcuuggaaaaagccaggauagaaaacuacacaaagcuuaguaagcaucauacugguguguauuuuguuuugcucugaauaucauccuuuuaaaauacaguaaauaaaaauaugaaauaugguugaguugcagggaauaauguagugguuaagaaugugaccucuggagucaggcugccugaguuggaauucugauccuacacuuuacaagcugugcaacuuugggcaaguuaccaucgguuaaauagcaguaucugcuucgcaggguugucaggagauuaaauuuacauaaugugcucagaacagugccugacauguuauaaggguucaguaaaugucagaaaaugauaguaccaauaggaacaacuuuuauuuuauaaacuaggacacugaaaaagaguauuaguuucucucuuucaguaugcuuaugagaagccaguuagacaagacucuauauugcacuauuuggagcagcuuccucuaugaguaaauaugagaauaaauaaauaccuggagcucugacuacauuaacugagagaaaaaugcaccaauugggcucucuauggucauauauugccuaggccuuggaaacaagccaaaaucaugguucucugugacuuaaacuaaguuacuuaauaucucucagucucaaguuuccucuucuaucaagugggcuuaacauacuuuaugaaguuuuucugagaguuuaaugaaauaaaguauaucagguacccaauguuguaccuagaacccaguagguacccuagaaauuguaucugucauuacuguaaucagcaagagaugccaccuuagcuuauaaacuucuugcccaucuaugcaugaagcaaauccuauuacuucauccuuuuaccacuacuauugcuacaaacuagguuaugaacaguggauguuucauccuuuuuuaauccaaaaucuuaaacauaaagggcuugucuuaacuuuaaaguacaacauaugaugcaucaguaauguaucaaaacacuaaccuaauucguaucuagcccccauauaauucccagugcuuucauuaaacaaaaaaguuaagcugaaauaaauagguuucaucuuacauaccaacucugauuauugaugauuccuagaauacaaugcuaaaaaagaaucugagguuguguguaggcucagcaguaaaaagugcugaagucauucaccauuguuugccagggaagcagaagaaagauugaauaaacaugcaugaaagauagugcaaaggaaaaagaaugauccuggguguguguguguguagauguguguggaguauguacauguaccaugugugugugcacuucucuucccugaaaucauguuuauaugcaguuaagaaguuagcacugacugaguguguacaugugucaggcacuguucuaagcauuuacaauuaacucucuuaaaccucacaacagcgguacaaaggaagccaauauuaauuaacguuuuuguuuuguggcuagugagugacggagucagaauuugaacccagggauuuuggcuccagagucuauucuuuuuuuuugagauggagucucgcucuguugcccagacuggagugcaguggcacaaucucagcucacugcaagcuccgccucccggguucacaccauucuccugccuaacagcugggacuacaggcagccgccaccacgcccggcuaauuuuuuauauuuuuaguagagaugggguuucaccguguuagccaggauggucucgaucuccugaccccaugauccgccugccuuggccucccaaagugcugggauuacaggcgugacccaccgugcccggcugagggacuauucuuugaagcaaucugcuaaaccaucucuuagaagaaauuaaugcaacuucucaaguugaagaacauuuccagaauguagguuuuacuugaaaagaaggcauucugauagacucacaauaugguuuuaucugcaaauauuaccuaaaaacauagaauuuauagugagaucucugcguuccgcaucuuucugccagucaguuguaaauucuaccucagcaugucuuccaucaguggugacaucaauccguaguguaguaaucucaaaauuuucuucaugaagcugcaauuaaauacaugggguuuuuguugucauuuaaauuagguuuucauacuacugaauugaaaaaaauaaguuuuugucuuuauaaagggaugguacuauaagcccugacaguuauagucuuuuuaacgucaacuaccauaccuaaacauugaaacagaaagauauccacauuauucaaaaacagaucaaaagacugauuuuuuuaaaaaaaauccaucaugauuaaaaaagaugaguuuaacacacaaacaugucaccucugccaagugauguggagaaacuccacaucaaacucaaaacuguucuucaauuucaaaucaagcuauuaucagaaauauuuuuaauagcuccaguuugcaaagaggugaaugucaauuuauggaacauuugccauugagcgaaagacugauaaagaauaaguacaguuaacagaucuugcaacucccuuacugauaauccccagugaaauuaaaauaaaggcugggggugguggcucaugccuguaaucccagcacuuugggaggucaaggcaggcagaugacuugagcucaggaguucaagaccagccugggcaagaugguaaaaccccaucucuaccaaacauacaaaaaaaccagccaggugugguggugcaugccugugguccuagcuaccugggaggcugaggugggaggaucgcuagaccccgggaggcagaggcugcagugagucgagaucacacugugcacuccagccuaggcaacagagugagacccugucucaaaagagaaagaaagaaauuaaaauaaagaguuaccucuaucuugggaagacagacuaccuccagcuggggaagcugaguaacuucauguuaggguggcgucugugccaagccuugaaaaagcagcaggguuuguacaugcaggugugguagaaaaacuucaaaugaagagaagagaugaccaaaggcacgguggaggaagaggaauauauguaaaagagaaaguauaucugacagguagcauauuagcauuuaggaguagagaauaaaguguuuuaugugccaagaguuaggaaugucuuuauuuaggaagugaaagccguuaacgaucaccagaagucuguuguaggauuucucucaauuugauacauacucuucucuaaauacaagcuacaucuaucucucacuauagaauuccagaacucaagaauuugaggcacaaguaucucugaaggcaaagaauaagguaagguuugaaauaggaaaacuguuugcaacucauuuuaagaaauaaucagacccaccuagaaugacucccuuaaugaggcagaaaaccagggacugauucucuagaaagguucaaccaaaaauaaucagaacuuguugcaccaggcacagaugcucaugggaaugaagcaucauaaugaaaacaagauucaagugaaaauuaacaugacccucaucccuuucccuacuugguuucaagaugcuaacaaucagguucauucccuggcauaauacuggaguauucuucucugauuucuccuaaugaaaacuccuacugagacuuagacugggagucccaguuggcugacacuucccaugcaaaacuacaauaaagcccucagauacagagcaucacccaaauucaaggaaagccaaccugaaagaaaacacucggaggaaacaaagacacugucaaaauaacuauaguagauauccuaagagaaauaaaagaucuuccaucugaaacaugaacgggaagcuuuccaaagaaauauacuaagaaagaccucuugaaauucuacaagaccacagaaguugucaguauuauacaaugacugggagaugaaguuaaggcacucucauagaaaguaagacaggagaauauaaaauaaagacaaaagauaaaacuagaaggucagucccagcaauccaggauccaaauaauaagaguuuccaaaggaaaaagcauuuaacaaaagggaugaaauuaugaaagaaacaugagggcccacuaagugcccugcacaguaagugaaaaauccaaaacaaguuauaucaucuugaaauuaaaaacauuagacaugaaaagaucagaaagacuuccaaaaggaaauaauggcaaucagguuuuuaaacaaaagagaaaucuaaauggaacuagacuuacuggcaguacuggaagcuagaaaacaauaccuuuaaauuucugaguaaaaauuauucccugccuagaauucuauaaccguaacuaucaaaccaccauggaggugaaauaaaaacauuuucagacguguaaggcuuccucagguuuuggauuauuaaaaugagggcuuaagccaagagagaacagcacaugggacccaggaaacaggaggcuuaacaaaaaagagaggccaaggaaauuccuaaaaguccauauuggagcaggaagacagcaccagguaagauguuucccaaaaacccaauugaaacuugauauaauguguuuaaaucuuuugagaggaacucuauagcucuggcacagagugcaggaauaaauugguaguauauggaaagcuuauguaaaagaaaaaugccauuaacugcaggaaaauuuaaaaacaugccaauagaagaaaugucaucacaauauacuccacaaucuggcuguaaacaauacagagucauaaacgugaacccugaauauugacuuaaccaaaaauuaugauauaaauauacuaggaagacagaagaaggagaauuauacgugcuuguuguugagaagggugugguaagaaagcuaaaucaucuucccuuauggaaagucaauacguaacacaucuuaaaacugggauaguaaaaacugaaaaguaaauacccguagcauacaaaggucuuuuuagaaauggagagguaacauaaaaaguaaacauggcugcaagaacagaggacugcaggguuuaugacgggcauagaagagacugacuuuuuuauuagacuuuucguuauuugcuuuuaacuagagaaaauuaaguuuuuaaaaauuaccaaaaaagcaauguaauuaccugucaaacuuuugacucacccuggcaguaauuguuccgugcuuuucuccucuguuguuuaucauccgaaucccagccgacugaaacaucuccuucauuugaguagggguagcagugguggcaaaaucuauauccugaggcuuuacuccauuuaauaaaucccucacugcuccuccugcuauucuuaauucgugauucucuuugacaaauaauucugagaugagagaaaauaagauuuuuauucccaaguucuuuauuucaauguguuuauuuuaaccacaaaaguacaaggcuuuuccaucuaguuggaacagcagagauucauuuaacugaggcuuuucauaugaaaaaugagaacaaggcccaaagaaguaaaaagacuugucuacaggagagugccucugaggaccaacaggaaacagagaacuugcagaauucuuugcuuauucagaagauaauucagaauuccacaaugccucaaagugaucaauauaaauuugaaguauuacuaaagacuaaagcaggucaggcgcaguggcucacaucuguaauccugauacuuugggaggcugaggugaaaagaucacuugagcccaggaguucaagaccagccugggcaaagagcaagacucuaucuauacaaaaaauaaaaauagccagguucaguggcgcacaccuguagucccagcuacuugggaggcugaggugggaggauggcuugagcccaggaguucaaggcugcggugagcuaugaucgugccacugcacuccagccugggugacagagcaagaccuuaucucaaaaaaaaaaaaaagaaaaaaaaagaaaguaaaucaaacaauucugcuuucuuuuccccauuuaugugcauacuuuagaaaugguaacauguucuuguauuucucuguguuuacagauagauguugaggcaggauguucacgcaugaaacuaucagacauuagucuauaccacuuaugauuaauguuuauagcuaaaaaucuucaagaaauggucuguauauaauucuaaaaucaacuccuaucugugcucuagguagaaccauuugaacacugaacaacuauaagcaacuacauagcugacuccucuauauguagaggauaaggcaaaauccacuauaacuauauccauauguccacauggaaccuagugagaauggcauccaggagcuagccugccacaauauuaggcccuggggucugugguacagaaacauuuucacaaaacaucaauaucagacaagcccauucugugaccacgauggaucgaucaagacaacucuguaaucaccuaaacauacacgaaacaugaacacuguccaugauacacccuacaauaguugguaacagugacugugccuuaccaauuagguuuagucucacaacuguacucaacuucuaggaaaccauuauuaagacacccaaucacagaauuacuucugcuuccugagagcaucuaacccgcugcaaagcucuacuaccuuaaaugcucuccaaaaugacccaauacaagcccaacuccuauaagaagucauuucuaaagcccucuuacugaguauaccuccagguucuccagugucagcaugcuacuccucacucagcauguugcuccucacugccaggaguaacaacccaacuugugucccuguuggucuuuggcuagcagacagcaacacgagcauucaacuaaacucaucauacaucaaaguuccagcaccucuaaucacaacucaaaacagaauccucuaucccuaccucaacaucuguuuucuguccugcccacacuccucuuccaccuacucuucccacaucuuuucagccccauucucuguagacuccuuaaaaugauguacuuaaaaguaacaaaugcucccuacccucuugacuuaauuaaggauaucuuuuccacaagcucuccccaaggggaaguguucauauuccccuaaugccacauuucccaugaaagcccacuucugggaccacaucaccucccuuaaauccagccuccaccaucuagacauagggauuuaaaacacuagguuaauuacgcuacgcauuaacugcuccuccuaacuacucacaacacaguacccaaauuccucagugcuauauccaaaggcuuccaugaccuauuugucucaucucuugcuaaacucugcaucacacugucuguaccagcugucugcacaaaacucuccccacaguuuuccuccauaauuuugcuugugugagucacuucacugaaacaccuccccaacuuacuccagcucaguggcuggcugucacacuucuuagcccauaacccacacuaagacauucacauagcagucaccaaaauuuguaugucuacauggcaaacaaaaguaucauaaaagaaaaccuacccuucguaccaugcaaucuauucuauucucucuuuuuuuuaauuacuggucaugaccacuaaauugacuucauggcccacuaagagguaacuacccaguuggaaaacaaugaucuagcucacucuuacuuaucuguugugacucacuuuaggaagccucaccugaagguaagguuaggugaauuucuucuaagcgacuaguacagcauaucuuuauacauaccaauuauauuaaaauuaccuguuuuaugucuuugucuccccacuucucaggguagaaaaccuaucuuauucaucuuuauaccaaucuggcucauaauuaaacugaauuaugauauucuaacuauuaaaaaaaagaaugacuucacugguaaguauuggguuuuuuuaaguuuucuuaaaacgguaucaaguagcuguucugaaauucaagcaaauaaaggacaaguuuuacguucacuugaacuuacuauaaacagugggaugaagaaggucaaggcuuaauuuauacagauaacuacuguuuuaagauucucaugcuggcuuuacuaaaauaaaacgauaaguucaaauuuacucaguaagcuaacugcauuacaaagagauccagaacucaaaguaauauauucaccauuuugauuagccuauguuauuaaaccauuccaaaaaccuugccauucaggauuuuuaaaauaacauuuaagacaacugagaaagacguaucaaggcauauuugucuauaugaaagagcagucauaaaaauuauaagaaaagcauaauuucacauuggccuaaaacagcagggacuaucaagcuucaagauuuauuuauuccuguuacugauaucuucaaucuuacagaaacagggaggcagucaacauuucaaaagacuuugcgagcuacauucaaugaaauaauucagugaaaauaacaccuaauguaacuaaauuuaacuguaaacuuaagccuaaaagucaaagaaugcagaaucucaucauccccaaacuacguuuauuugcuccaaaugccaccucugauaguaagcaauuguuaauuauuauuagcaauucaaaagaccauacauuaaugugucagaaaacuuuuauaacugucaccucuuuuuaauguuaacuuuuaauuaaauuuucaugaacgucuucccuuuacagcuuuaaauuuugacgacuggaggcuggggugggguaaggggcagugagugggagcuaugagugggaagacauggugugagcauuacuacagaaaaacagaccaucuguucuaagagcuccggacuucaagagagugaucaguugucccuaucgugcuauauuuuaacaugauggccuucugacgucacauaacacugagcgcuaucacccccuguggacaacagccaaaggacuaaacaaguccuugcucauccauuaaugcuguuagcucaggcaaaaaucgucugcauugggaacuucagccucaucucuaggacagaaaaauagucucucauuuuuuuuuuuuugagagagggucucacugucauccaggcuggagugcaguggcaccaccacagcucacucugcagcccugaccccaaguucaaggaacccccugccucagccuccugaguagcugggacuacaggugugcaucacuguaacuggcuaaauuuauuauuauuauuuuuguacagaugggauuucacuauguugcucaggcuggucucuaacuccugggcucaagcaauucucccaucucggccucccaaagugcugggagauuauaggcaugagcuaccacagcuagcugggaaauaaucuucuaugccacuagcauaugauuguacugaagcaaaaagauacauaaaauaaccugacaaauuauaaaacccuuaugauaugacaauaauacacuauucuagucucucauauucuugcauacugaaaacuaauuuuacacauggcaaagcagcuauuaagauuugaaaauugguacaggauuuaaacuccaaguaucacuauauagcagccaucagaaaggcuguguguuuuuguacauuuugauuuuauacagaacauuacauuuuaccagggcacccaagucuuugacauucuaacuuguugaucauugcacuaaaagauuccauucuugccacuucuccaguagccuagaaaaagucaacuuuagaauauauccauguucucauuugccaguccuucaaggacaggacucuggaagcaaucaccaccucuaccuuaccacaccauuuaggcucuaacuuccuuaggaccucauuucucaggguggagaaaauccaguguuuuuuuuuuguguuuuuuuuuuuuuccuucaauagguauauguuuuuuuuuauuuuuuuaauuuuuuuuuuuuuauuauacucuaaguuuuaggguacaugugcacauugugcagguuaguuacauauguauacaugugccaugcuggugcgcugcacccacuaacgugucaucuagcauuagguauaucucccaaugcuaucccuccccccucccccgaccccaccacaguccccagagugugauauuccccuuccuguguccaugugaucucauuguucaauucccaccuaugagugagaauaugcgguguuugguuuuuuguucuugcgauaguuuacugagaaugaugguuuccaguuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcaugucucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugauggccagugaugaugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauguuguggguugccuguucacucugaugguaguuucuuuugcugugcagaagcucuuuaguuuaauuagaucccauuugucaauucuggcuuuuguugccauugcuuuugguguuuuggacaugaaguccucgcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaguuucagguuuagaacguuaaacacaauuguuaaaaugauguucaagaaacuauaguaaucaauauuuagaaccuuauuuccaaaaaaugcagaaugaccugaguuaggccaucaagaguuaauuacuacuccuucuuccaagaggccucuugcaauugaaguugaaaaauugggggcugugaagggcauacacagaaagaaaaaagcuucaacucaacccaaaaucacagcuucaaaaucugcacuauucaaacagcagccacuuguacuuacugagcacuuaaaaugugguaagucugaauucagaugugcuguauuaaaugcaugccagacuucaaagacuuccaaguaagaauauaaaauaucucauuaauuuuuuuuuuuuuuuaaagacacggucugugucgcccaggcuggaguguaguggcacaaucucggcuuaccgcaagccccccucccaggcuucagugauccucccaccucagccucccaaguagcagggacuacagacacauaucaguaugcuugccuauuuuucauauuuuuaguagagaugggguuucaccguguugcccaggcuggucucaaacuccugggcucaagugauccacccaccucagccacucaaaagugcugggauuacagguaugagccaccauguccagccucccaaagugcuaggauuacaggugggagacacugugcccggccucauuaacaauuuuuauacaaaauucauacugauaguaucuuagauauauuggauuaaauuagaugaaccaaaaauaauuauuaaaauuuauuucaccauuucuaucuuuuuaaugugguuaguaaaaaaguuuauauuacauaugggcucauaaauuucuauuggacagcaauuuuuagcaauuuucacucucuccaauuaaaaaagauagugaagcaucggcaaaaccaaacaugcauuuaagcccucuacuuaaagucugccuaaaacaaucuaaaagaaucaacauauucugggccauuuaucucuggcacguaccuaaaaagccaucauccaauuucaagaaugggaaaguagcuuugagaauaagcuaauacaaggugagucauguuaaaguaaugguucgucuaucuucugugcaucagaauuaacuuguggagcuuuuauuaaaaauauagauggucaucccacccagagauucuaauucaguaggcugcagguagaacccgagcaugugugcuuuaaaagcuccccaggugaaucuaauagauagccagugcuguauaggucauauuucuacauauacuacuaaauauauuuaugaaggugcuauuaaaauucccacaggcuuuguaaugcuacuguguggcugcuuuagcaacaucagcagacaacauugagaaucaacacuaaugaaacuguggcaacagcaagaagcuacuggcacuuagcuaaagccauuuccuaugcuccuuccagacagguuuugcaacgugcacaauggaggcaacuccuauuuccuucuuccuucaguucucauggaaagcauuuauaccuaggaaggaaacagagcuuagcgguugcaagcugggcucugaaaucaaucugcguaaguucgaaaccuagcucucuaguuaguaguuacagaaacacaggcaaagcacuucacaugccuaacaaucuguuuccuuuuucacguaacaggucaaaaugugcguacucauuaaguuaguagcaccaguccuguaaugaauggcaaguacuuagcacagcauacagaaaagccaugcuuuuuacugcagucaacuucuugccuuuuccagugauuuagcuauauuuuuggaucagccauauguaagccuuucucuuuuaauauuccuuucucuuuuuuugagacagggucucacucuguugcccaggcuagaguggcaugaucauagcucacugcagccucaaacuccugggcucaaacaauccuccuaccuuggccuccccaagagauuacaggcuggguacacccagccaagccuuucuuccaacaaugaaaacgugcacauugggcaccguggcucacaccuguaaucccagcauuuugggaggccaaggagugagcccaggaguuuugagaccagccugggcaacacaaagagacccucuacuuacguuuuuuaauaaaaauaauuaaaacaacaaugaaaauauccgaaugcuggcuuaaaaaguuaacccucuacuucuccauuuauauagguuuccaaucaagaaaagguauccuaaucucucaccugucagacucuucaguccuucugugaaaagugacuggaauucgggagacugcaacuucauugugaauagauacugcuucggaaggcacagccuacuccaccuacgguucagcacuggccugugccaaugauacaggcaccucagcaucuggagaggcagucaccaacuacacaucuacaaggcaaauacacaggcauaccaaugaaauuaaaagugaagguaagugaaggaaaacaaagggggacacauuucaaguuuaucaacucagaaauucaucucuuguucagaugaaaaaacugaaaacggugucaguuugagggauuacgacuaggucuauguaucuaccugguuuuguucuccagaagcacuuacuguggcaggcggggucucacuagcgcaggccuccauaacuguuucaguacugacugacugguugaguuacauauuaaaagcugaaagagccagccagugcccuuaaacaaggcuagaauguaacaaaagccccccaagaguuuugccuaggccuuuccuggaccuugaagcaugauaaaauaacaaaggaauucuuuuuuuuuuuuuuuuuuuuuuugagauggagucucgcucugucgcucaggcgggagugcaguggcgcgaucucagcucacugcaaccccugccuccuggguucaagagauucuccugccucagcaucccaaguagcagggauuacaggcgcacaccaccacauccggcuaauuuuuuauacuucuggguagagacgggguuuuaccacguuggccagacugcucucgaacuccugaccucaagugaucugcccgccucagccucccaaagugcugggauuacaggcgugagccacugagcccggccacaaaggaauucuuaacaggacccguuuagaauuaaacaaguuuuacuggggaucugaggaaacuccccaggccuccacgaacaaguuuauuaggggucugagggaacuccccaaaccuccaugauuuagcaggagagaauauaaggguaaucaccccagcaccuggacccauuuagauuaaguaaauuuacucaggcuccagaggaaggucuucaggacucagaucuuauggguaagaaguuaaucacuuguaucuuuagaucaaugcacacuuacacauaaacauacaacuuacaagguauauaagcucuggaaagcucuguaauucugagucggucugggauauuuuccacgccuucgccccguaccugguuacagaaauaaacuccuuucuuuccuaguuuaucugcaucucauuauugggcagcgagaauaagcagcccaacccucgguuuggugguuuggucggggagcauuaccacgacacucgcaugccacaugguacugugaugacacucuccccagagcagggcuucaggcaguaugagagggaugcgggguucuagaaacucuaaccgaguuucuggucuccaaaacuugucauggucacagguggguaucacccuacuuccccaccugcacucgaggauucacgacccugggauagcuccuagacauuguauuuucccaugaauuuaguuuugcugcccccauuuuccugauucuuuuccugccaucuugcaaucuccucugauuucuggcacaccgcggccuucccuucuacauaucacauccucguucuccccauacggggguccugcccauaaggaggccgcagcagcucucgagugaccccgguguaaaccugcagagaaaaaccauuccauuccacggaagcggguggaggagccgcgcuucccggcaggccacguggggcggaaagacccacucaguuuccucgcaccuccgccucgacuuaggaaaacgcucuggggaaccccagcccugaaaaggcgcgucucaccccccacgccgggugcuggcgacaaggcccagugaaaaagcgucucggggccguccgcgcggaggggaaagugcugagggaagccaaggaauccgcgccugcggucgccggaaacguggcggggacacgaccuccgcgucggggcuauuuugcccacugcugaggaggccucucgccacgucccgcucccgucuuccucgaggaccgggcgcgguggcgccucuggcccacagcaggaaggaaggggcagcaacucacgccaccaacucugccccucugagcggcgcgcgcccgcuuaccggccccgcuguugccgcagccgccaccgccgccacgcgcacuuccgggcuggugaacgcggugacgucaccaac

SEQ ID NO: 191666 - RNA, 106138 nt, Homo sapiens
cacgugaccaaccgggucacauggcccgcgggacaacauggcugcgcccgcacuagggcugguguguggacguugcccugagcugggucucguccucuugcugcugcugcucucgcugcuguguggagcggcagggagccaggaggccgggaccggugcgggcgcggggucccuugcggguucuugcggcugcggcacgccccagcggccuggcgcccauggcaguucggcagccgcucaccgauacucgcgggaggcuaacgcuccgggccccguacccggagagcggcaacucgcgcacucaaaggugcuccaucgauuccuccgaggcgggugggggcugcucgguuccuggacgggguuggaguaggcaaagcaaggcacuaguaggaagggaaguaaagguuauaaccacaccccaaaucgagcaccugcuguucccguaugaggaguuccuucuccgugccucaccggaagacuccauuuaauugaccauuagggaguuugguuugaggguuauuguuacuucuuuacccccuauuucuuucucccuccaaccuguucucuuaaugaggaucucauaauuuuaaggcaaucaaauuaugguuuaaaucaccauuuccucucuuauuaacggaauaaauuaggauccugggucucaguaucuucaccaggguuguuguauacuuaucuguagucuccucgaguacacucugcuugaggacaagggcuugaauuguuuauccugcuauucuuagcacuuuagcacuuaggaagggcuaagcaaacuguaguuguuuuauugcuauuauuuaucugucuugcuuagcgccuguauguguuaggugccgggauauauaaauaacuuacuggccgggcgcgguggcucacaugccuguaaucccagcacuuugggaggccgaagcgcgcggaucacgaggucaggaguucgagaccagccuggccaacauggcgaaaccccgucucuacuaaaaauacaaaaauuagccgggcgugguggcgggcgccuguaaucccagcuacucgggaggcugaggcaggagaauugcuggaacccgggaggcggagguugcagugagccgagaucuugccacugcacuccagccugggcgacagggcgagacuccgucucgaaaaaaaaaaagaaagaaagaaauaacuguuacuucaaucugucugcccgguauuuugcauauugauguguugucgaaacaacuuaugggucuaaaggucaggucuucugacuccuaaacuagugcuccuucuuguuuacuuagcagacacuauccuuuucccauuccauuuuucuuuccuuuggguuaauccugaccaauauuuaggacuuaggugagagguaacauccacaguagguuuuaccugaucuccucuuucucuccccuucaauauuuccguauccugccucaguaguuauguguuuauucugacauaacaauuauuaaagauguuuuucugcugaugucucuccccaacuggacugugagggugauggggucaggaccaugauuuagucucucagguguagaguguaggagguugauaccugggcuucucauuguuuuuccauccuguauaauuuuuggccuuuacuuuuuuuccuguuacccuuagagcauguccugcaguacuguuuaucuuuuguguguugaagacuccugauuacuguuuuaguguguauuggccauacuugauauuaauuccucucuaacuugccugguaauugauaaucaaucucucuuucuuuuuucuuuucuuuuuuuuuuuuuuagacggagucucgcucugucaccaggcuggagugcaguggcgcgaucuccgcucacugcaaucuccaccuccuggguucgaaugauucuccuuccugccucagccucccaaguagcugggauuacaggcacacgccaccauacccagcuaauuuuuguauuuuuaauagagaugggguuucaccauguuggcccggauggucucaaucuccugaccuugugauccgcuugccuuggccucccagcgugcugggauuacaaacgugagccaccgcgccaagccagucugucccucuuucuaaggagaaauccuuacaucuguuuaucuauuuuuuaauagggcagccaucucauuugcauauauacauuggucugucucaaaauuuuaucuagauuccucuggcaagcauugaacauuuuucauuuuuaaacauucuauuuuccucuggguuccagaaugggauguggauguuagaaucuuuuggauuacauuuacaagauguacauuuuucaucccuauagagugguuuugugucuugacuggaugcuauaugggccaucuuuggccaguucuuauagucugcuuucuacaaugcuuaggggcaucucaauuuauuaacaaauuagugguugaugagaauauaccuucaagccuucaagggcugaacuuaaugacugaaacugaagcagucuuguuaucaagacaaugacgucauaggaggcuguucuuaaucucucuauuuuccuugguuucaaauguuuuaguucaugugcagaugacuuuggucuaauucugacacuuuaccauuuauucuaaauucaggaacuccaauauuucaggagaaguaaaugagcauagugguguuucugccuuuuuuccccucuuuguuuucuguuuauuugguuuaauuaaacaaauguuuauuuggcacauuacuauauaacacuuguuauguaagauucauccuaugugcugggcauacagaaaaagacccauacacuacccacauggcauuuacacucugguagguguuucucucucucucacacacacacacacacacaaacacacacagacacacacauaaguaucauuuuucuauagugagaauacuauaggagggauauguccagaguaccuggagaggaagaaagaauuaauucuucauggacaagucgaguagugccucaaaaaaaaaaaggccacauuugagcuaggccuuggaggaaauauuuuucggagcugggaauggaauuccagauucaaggacauuccaagaaggagaauaguaucaacacauggcacauuguggaaaugcguggugugugcugggaaacauaagugauuuaagaucugggagugacauguucacacuuuuuaauguaacacuuuuuagaugagucuuuuuuuguuuuuguguauucauacaaugaguguguguggcaaggugaggggcacagagaaauaacacugggcuuugcccucaagaaauuuucaguuucacuagaaaguuauggcgauuagaauugucugggaaacaauauagauguuuaaaaauuuaauguguauucccucugguuauaaaaauaugauucucauugagaaaauuauccuaauaguuuucugcguggguuaugauuuuguaacaaggaagcaaaauguuuuagucugcuuuuaucuuuuagaagaguuauuugaaaggcauuuaggaucaugggaugcuaagauuguagguggcaugucuguacauauggauaaagucagucuugauuuccugucugaggagguuucugacugguaaugcuucccugggcaaugaggcacaaucgaaugccgucucuuccaugaaaccuuuccaccuccuacaaagaaguaguuuuucuauccucucaguucccauagcuuauuuuguuguuguuugaugacaacuuguauauuuucuucaauauggugcuaguguuuuuuuguuuuguuuuguuuuguuuuugagacggagucucgcucugucacccaggcuggagugcaguggugcaaucucggcucauugcaaccucugccuacuggguucaaaugauucuccugccucagccucccaaguagcugggacuacaggcaccugccaccacgccuggccaauuuuuguauuuuuaguagagacgggguuuuaccacguuggccaggauugucucgaucuuuugacuucgugauccaccugccucugccucccaaagugcugggauuacaggcgugagccaccgcgcccagcccuaauguagugcuaguuuuguaguugucugauauucuacauuggaagcauuuuuagauguuuuaaucucuauaucccccacgugccuuauacauuuuaggcauucuguaauaauuucuugaaugaccuguguuuccuuuuuugguggauacaguauugagaaacugccuugggaauagagaaggucacauacuuuuucaagaaacauuuguaaaguauucuuuugcuguauucauccuccuaagaauccugugagagagaucaucucccacuuuacagaugaggcaacugaggcuuaaaggaaucauauagcucagaacugcaagaaacuuugaaugucauuucaucuaugauuagugucugucuguagaggcaggagggugacagaaugguauagauaaauaagcccuguauagauagauaaggcaggaguuuguggacagauccagagagcaugcuucucuuauucacccagcuuucucaugaaccuuuagcuuauuuuauuuuauuuuuuauuagaggggacucagaacaagagccuuuagcuuuuaauguuaagguugaggagaggaaagaaggaaaaggagaaguuacacaaaaaaguuacguaugagcugauucuauuuuuguguacaagacaaaaaucuuacgguagcaagugaaaaaaagacaagacuggcuuaagcaggaaaaaacuggaagggacauuuauagcuccccuaguugggaaguucaagaguaaauauggccccagacacaccuggauacagggccucaggcagcaucuccaaggccuuucucuuuggcuaucucuuggcucuucugcauagucggcuccauugucagguaaugucccuucuccuacugauaagauaacuagaagagaaaaaguucuuuccugguagcuccagcaaaaguucaaagaugaacuuugauugggucuugggccuaucccuaauuacaucuccguggucaaaagaaugcuaugguuggccaggcuugguggggguugggaaguaggauagagucauccaguaccccugggccacuuagaaagcuuaagaaaugguuuuggaaaggaacuucaguauuuuacaagaaguagagggauugggugccggauggaccaaaauagcagugcccacugcacauggccuaaguguguagcccacauaugguucuguuauuccaaugaauaauagagucauucuuuacuucacuuaugcuucuggcuugaguggcaguggcagaagcugugguguggcagggaagggguuaucucaccuucagauuggaggagauauggauuguuugaauuugaaccuucagugaagaguugacuaaaaugguccuuuuuauguggcuuuggauccuacagagugagacacuugguucucugguuuucacuugaaugacauuugacauuuguaggacagaaaacuuuauuucauuaguauaaaugagaaauuaugauccacucagagugauccaggcuauuuuuaucuauagucuccagaauggaaacuuggcuuauucagcacuggcuaucucugaugguuaaugaaagaaggaaaaaaaaaaaacucggccggaaguucacauggaagucaugauugcauuagcauuguugguacucaccuugagggagaagaagaugagaaaaguuagauaauuguaaaaguucauuagguacaaugggcacagcuuccugugguccuuugagcugagggaugagcaacuguucuccuaacaggaaguauuugccacaggaaagcuuuuucuuuaagucuuuuaugaaaucucuuauuagagccucuuaaucauuuuaagacugcucuugaaacuuuugucugaugucuucaauuuuucuacuucuuuguagagcugcuuaaaauguugauuucuccuuuuaggacuggguuaucuugugucccagcacuuagaguauagugagaauaauggacaaccuaguucgguccuugaccuacaucuguuagacagguuucacugugauguugacauguuaugcaugucuagaacuguuauaaauuaaauagcauuuuuauaauuaugcauaauucaaaugauaaauuccucauuacagucaugaccucauucaauugguaaagauuuuugugucugcuguggaccaugcaccaugcuaggcaguggggauauagaaauaaaagauucauuucugguccucaaagagccuagguucuagggaagaugaaaacacagaauuaagauacuuugggugggaugcgguggcucaugccuguaagcccagcacuuugggaggcugaagcaggaguaucacuugaacucagaaguuggagacuagccugggcaacauaacaagaccucgugucuacuaaaaaaaaaaauuagcaggguguguugguguucaccuguagugccagcugcguagaggcugaggugggagaguugcuugagaccagacgaucaagggugcugugagcugugaucacgccucugcacuccagcguggggugacagagugggacuccaucucuuaaaaaauauauauauauauauauguauauauauacacacacacacucucacacacacacacacacacacacacugugugugugagggcacaugagcuagagggauaugcaggcaggaaaggccuccuggaggagcugauccuugaaccaugacaauauuuaccaagagacaaagugguuuauggaaaugcgggugaaagacagggcaagagagagugugagagaugagcucugauguuuauauauguuauucugaaaggcgauaggaauuccugacaguuuuaaguaggaaaguaguauggucagauugacacuuuauuuuuuaaaacagguaguauauuuacgugguuuaaaaauuuaaaaacauauagaagaguauauagugaacaauuucucauuuacccaguaacuuuccccucagacaaccacugcaugcauuucuuauauauuuccucagagcuauguucugcaaauauaaguaaauacaaaaauaguguaccuguaucccucaaccuacuuucacgcuaaugacagcauaccauacuuagcauuugugcaccuugcuuuguucuuguagcucaucauggugagaucuuuccauaucaauauaucaaaagcauccuuuuuuaucccccucuucuuuuuucuuuccuauggcugcuuaauuuuccauuuuauugaaggcccacaauuuacuuaaaaugagccugcuauugauggacauuuagauuguuuccagcccuuuucaguuggaaaauugcauuggguacaguagacuaacauuuucagaaggauuaguaggggcuuaaauauuuguugaaugaauuauugaauggaagauagaugacuuggaagcagguggggaugugaaaggagacugaagacaggaacaccaauuacaaggguucugcaguuaucuggggguagaaaagagggagagauuagagagauacauauuuaggaaaucuagugagacuagguggccuguguaauauugggaguaggggaugugaguagucaagguugauuucuugggauaguaguaauacauuagacaaauaaaaacacauuuauuacuaauuuaucauaaaugaaaacagcaccauuuuuauugggaaguacacgcauagaaucaaagcagccaccagcaaggaaagccaguagaaauggaaaguagaaucaaugacuguggauuccuaauuucuguuucuucugauguuauuuuucuaaugcuucugcccguauugcuaagugacucucuuuuuuuccaacuaguccaucucuccuugacuucuuuuuuuuccccuuucuaauuugagcccuuguuuuuuaaaauuuuauuuuuaauugacaaauaauuuuauaauaauuugugggguacaacgugauguuuugauauauguuuacauuguggaaugaguaaaucaagcuaauuaacaaauccaucagcucacauacuuauauuuuuugugugguggaaacauuuaaaaucuauuuuuuaauaauugcgaaauauauaaugcauuacuuauuauagucaccacucugugcaauacaucacuaaagcuaauuucuucuaucuaacugaaauuuuguaccgucugaucaacaucuuuccuuuccccaucuuccccucucccccagccucugauaaccaccauucuacuucaauuaguucaacuuuuuuagauuucacauaugagugagaucaucaaggcauuugucauuuugugcuuggcucauuucacauagcauacuguccacuagguucauccaugcugucauaaaugacagaguuuucuucuuuuuuuuucucuugagacggaaucuagcucuguugcccaggcuggagugcaguggcuccaucucggcucgcugcaagcuccgccucccagguucacgccauucuccugccucagccuccggaguagcugggacuacaggcgcccgccaccaacgccuggcuaaguuuuuguauuuuuaguggagacgggauuucaccguguuagccaggauggucuugaucuccugaccucaugauccccuugccucggccucccaaagugcugggauuacaggcgugagccuccgcaccuggccgaguuuucuuuuuaaggcuaaaaaguauucugacauuuauauauauauguauauauaaacauuuucuuuauccauuuauaugauaagggacaucuagguugcuucuguaucuuagcuauugugaauaaugcugccaugaauuugggaguguagauauuuuuucagcauacugguuuuauuuccuuuggccauauacccagaagugggauagcuggaucauaugguaauucuguuugcagauuucugaggaaccuccauauuguuuuccauaaucacuguauuaauuuacauucucaccaacugcaguagaguuccuuuuucucuacaucuucuccaacacuuguuaucuuucaucuuuuugaugauagcuauucuaacaggugugaggagauagcccauugugguuuuaauuugcauuuuccugguaauuaguugugaagagcauuuuuucuuauaucuguuggccauuuguaugucuuuugagcaaugucuauucggguccuuugcccauuuuuaaauugaguucuuuguuuucuugcuauugauuugaauuccuuauauauuuugaauauuaacuccauauaagaugcaugguuugcaaagauuuucacucauucugggauaucucuucacucuguuguuuccuuugccauacagaagccuuuugguuugauacaauccuauuuguuuauuuuugcuuuuguugccugugcuuuuggggucaaguccaagaaaucuuugccaggccugugucauggagcuucuuuucccaauguuuucuucuaguaguuuuacaguuucagacuguacauuuaagucuuuaauacaguuugaguugauuuuuguauaugcugugagauaagggucuaauuucauucuucuacauguggauauucaguuuuccuaauaccguuuauugaaagauuguccuuucuccauuguguguucuuggugccuuuguugaaaaucagaugaugguaaaugcaugaguuuauuucuggacucucuauccuguuccauugguuuuuguguuagcuuuuaugccaguaccaugccauuugauuagguuuguaguauauuuugaagucagauagugugguacuccaccuuuguucuuuuugcucaaaauugcuuucgcucuuuggggucuuuuguugugcuguacaaauuuuaggauuuuuuuuucuauuuccuugaaaaaugacauuagaauuuugauaggaauuacauuugauaggaauuacauuugauagaaauuacauugaauccuggccugggauuaauuucuuaauaucuuuuucagauaguuugucauuaguauaaagaaaugcuggcugggugugguaacucaugccuguaaucccagcacuuugggaggcugagguggguggaucaccugaggucaggagauugagaccauccuggcuaacauggugaaacccugucucuacuaaaaaaaacaaaacaaaacaaaaaaaauauauauauauacacacacguauauauauauauauacacacacguauauauauauacacacacacguauauauauguacacacacguauauauauacacacacguauauauauauacacacacguauauauauacacacacguauauauguacacacacguauauauauacacacacacguauauagauauacacacacauauauauacacacacauauagauauacacacacauauauauacacacacguauauauauacacguauauauacacacacacguauauauauacacguauauauacacacacacguauauauguguauauauacacacacacguauauauguguguauauauacacacguauauauauguauauauauacguauauauauauacacacauauauauauacacguauauauauauauacacacacauauauauauauacacguauauauauauauauauuagccuggugugguggcgggugccuguacucccagcuacucaggaggcugaggcaggagaauggcaugagcccaggaggcagaguuugcagugagccgagaucgugcuacugcacuccagccugggcaacagaguaagacuccgucucaaaaaaaaaaaaaaacaaagaaaaacauggcaucuacagucagggacaacauaacgucuuuguuuccagcuuggaugcuguuucuuucuuucucuugccuaauugcucugucuaguauguccgguauuacauggaauagaaguggcaagaguaugcauccuuggcuuguucugaaucuaacaggcaaagguuuccauuuuuccccauugaguauaauguuagcugugggcuuuucauauaugacucauguuaagguacauuccuucaaugccuaacuugucaagaguuuuucucaugaaaagauguugaauuuuaucaaugccuuugcauauauugaggugaacauuugguuuuguccuucauucugcuaacaugguauaucacauuuguaguuugcauauguugaaucauccuuugauccuagggauaaaccccacuuaauuuugguauaugaucccuuuaaugugcuguugaauucacuuugcuaguauuuuguuagaauguuugcaucuauguucauuagggauauuggccuguauuuuuuuuucuucuaguaguauucuugucuggcuuuggugucaguguaaugcugguaucauaaaaugaguuuggaaguguuuccucuucuucaauuuuauggaagaauuugagaaggauugguauuaguucuucuuuaaauuagaauucugccaugaagccaucugguucugggcuuuucuugauggaaaauuauuauuauuauuauuauuauuugaaacggagucuugcugugucgcccaggcuggaguacaguggugcaaucucagcucacugcaaccuccaccuccuggguuccagugauucuccugccucagccucccaaguggcugggauuacaggcgugugccacaacacccggcuaauuuuuuguauuuuuaguagagacgggguuucaccguguuggccaggcuggccugaaauucuugaccucaggugauccaccugccucggccucccaaagugcuaggauuacaggugugagccacugcaccuggccaauuuuuaaaauuauuuauucaguuuccuuauuuguuaucagucuguucagauuuucuacuuuuucuugauucagucuggguaggcuguauguuucuaggaauuuauucauuuuuuucaagguuaucaaauuuguagauauauaauuguuuauaaguaguuucuuaugauccguuuuauucugugauauugaacccuuguuuauagaugaggaacuugacaauuccuaagcugcugaggagucuauuaauuggcucacucaaaugauuugaaaauaagacauugugucuguaaagaguguauuucugacagaugguaugguugaaggccugugguuuuugaaaaaaguugagauagaauucauauagaaugcaauacacucuuucaacauguacaauucagugguuuuuaauauaguuaugagguguuacaacuaucacugccuaauuccagaauacuucaucaucucaagaagaaacucuaugcccauuagcaaucauuccccauuccugccucccccuagccucuggcaaccacuaaucuacuuugugucucuuuggauuugccuauucuggacauuucauaugaauagauucauacaauauguggcccuuugugauuggauucuuucacuuaauauaguauuuucaagguucacgcauguuguagcaugaaccaauacuuauuuaugucugaauauuauuccauuuuauagauauaccaaauuuuguuuacuuauucaucagcugauauacauuuggauuguuucugcuuuuuggcuauuaugaauaaugcugcuaugaauguuuuuguacaaguuuuuacauggacauauguuuuuauuucucuuggguauauaccuaggagaacugcagggucauauaacucuucguuuagcuuuuugagaaacugccagacuguuuuccaaagcagcugaacuauuuuacauuccuaccagcaauaugugaggguuccaauuucuucacauccucaucagcacuuguuguugugucuuuuuuguuauagccaugcuagugaucaugaaguggaaccucauuauaguuuugauuugcauuucccuaaugacucaugauguugagcauggaccugcauuuuuuaacugaaaauuuucagugucauccucagauccugugcucaguguugggaauagagcugugaauaaggcagccccaauugcugucuucuuggaguuuagaguucaugugggaagguagauaggaacaaaguaguugcaauuaggguuuuuauaaggaauuauacaaacagccccuuaguaaacuuuaaaacuuucuauuuuagugagguaagccuuuuucaugauuguuggaggccaaaauucaugcagugguuauuuaaagauauuauagauugcauuuuuacaugugcuuuuaaaaauaauucaaaagaaacaaaagcauaugcgaauaaaaaauguauaaagaaaaaaguggggcugggcacaauggcucauaaucccagcaguuuggaaggccgaggugggaggaucacuugagcgcaggaguugcagaccaaccuuggcaacauagugagaccucaucacuuaaaaaaaaaaucagcuuggccgggcgcaguggcucacaccuguaauccuagcacuuugggaggccgaggcggguggaucaccugaggucaggaguucaagaccagccuggccaacuuggugaaaaccugucucugcuaaaaauacaaaaauuagccgggcaugguggugggcgccuguaaucccagcuacucaggaggcugaggcaggagaaucacuuggacccgggagguggagguugcagugagccgugauugugccacuguacuccagccuggggcgacagagcaagacuccgucucaaaaaaaaaaaaaaaaauuaguugggcaugguggcacaugucuguacuccagcuguuugagagacugaguugggggaaucgcuugagucugggaagucaaugcuguagugagcccugaucaugccacugcaccccagccugggcaaaagagugagaaccugucucaaaaaaaaaagaaaagugggauauucucgcuaccucugcauucuagccguuagcggcuuggugacuguuauuccagaccuguuuccagugcagguacagauuuguaucaaguagugguuugauuaaggagauuaccuucuuaaagaauuuucacuucuuuuugagacucgugauucaccuucuuugggguauagagagauuuuuccgaauuuuacaguuauuacuguggugaagauuuacaaacuugcgugcuuccugggugcuaggaacuuuaccccuacacagguacaccuuggcugugaugcaugacuuccuguguuucaccuuucauuguagaugguccccaucccugcuggaguauuuacaaugggcacagaugauccucagauaaagcaggauggggaagcaccugcgaggagaguuacuauugaugccuuuuacauggaugccuaugaagucaguaauacugaauuugagaaguuugugaacucaacuggcuauuugacagagguaaugggauuggggaaaggagggagaacuuguucuuuuccagaacuuuuaagaaugcuuuaauagcagcuaagauugacugaccauuuuuacugcauucuguggcagaacugugugaagcauuuuauuguauauauuucaucuuaauuucucacagcaaccccaugaggcagguuauuuuucagguggcauacugaggauaagaaaaguuauuugccccacaucacacagcuaguuggugguagagcugggauuccagccuggccaguuugaccucagaacaugugcuauaacuauuaugcuauauuguguuaaugcuuaaugugucagagaauaccacuguccacuaaggcuuuuugagauaacagauggcauguaaaguaagaccacuuuucuucucaguaaguugcaguuuguuuuuuuccagaagcauuucauauuuuuuaagugauaaaugcagaagugcagcuuuucauuuucgugucuuuauuccaacaccuugacaacucacacaugcugugcuauagcaguuccagacaucaucugguggucacugaaucacaaagcaagguucugauaguggaugcuuuccuaaaugggaauaggaagaggaaagcuuucuagucuaugaauguuuaugucaguuucugaaauauacuuauuuuauaugcuuuccaguuuucucucacgaaaaaccuuuacucuugucuucaguucguggggucccuauucuuuuuuuuuuuuaagaccccaaaugucuuuuuguaaauuauuauuaaaugaauaauuugagagugaauguuuaaaguaaaacaacuuucagauuugguuuugcauugucacauuucuuuggaauuuucucaaauauauaaagugguuagaaaccuuuuuugggccaggcgcgguggcucacgccuguaaucucagcacguugggaggcugagguggguggaucacgaggucaggcgaucgagaccauccuggcuaacacggugaaaccccgucucuacuaaaaguacaaaaaauuagccgggcaugguggcgggcacccguagucccagcuacuugggaggcugaggcaggagaauagcaugaacccgggaggcggagcuugcagugagccgagauccggccacugcccuccaggaagaagagcaagacucugucucaaaaacaaaaacaaaaaaaccguuuuuguacacauucguaauaagcagaaguccuuuuccuuuugguuucacagagauacucucagcucagguuccucaauaguuuacuuaaguuagaagacuucuacagaaccaggguucuccaugaagauuagauagaauaagcagaauuuggggcaucuaaaaacauggauagggaaaaguuauaaguugguacaaaaguaauuacgguuuuugucauuacuuuuaauggcaaagaccgcgauuacuuuugcagcaaccuaauauaucugguuauuuacuacccucgagccacaauguaguauuuucuucaauuaugaugcaaacagcaaaccacagcaguaguagcaguaccucuaacuuuguuaccaguagaaaucacagacauuuuuaaucauauuuuuguuguugcagagaucuugaaauauuguuugcauucauccccacuuugaaauaugauaauuaugagaccugccacuagaucuuauuuaauauauuaaugaagagcauauuuaauacuauagcacugguuuguuuauuaauauuuugauauaaugacuuuucuucauaauacuauuuauuuuauuuuauuuuuuuauugauuuuauuuuaugcauuuaaacauuuuauucugagaaggggguucuuaagcuucaccauacugccaaggagcucaaaaaggaccaagaacugccuuggacaaaaugcucuguuuuuuuaauggcacucuuuucccaucucuccagcuuuacuuuauaucaugcuccucuuguauacuauguucuagcccugcugguuuuguuucuauuccuugaaaacucaacauucuuucccaccucaagaacuuggcccguauuuucucucugcuuggaauucgcaguccucuugcuuaucccccuucugcaugguuggcuccuucucauucuugagucaucucagcuuaaaugucacuuucucaagaaaguuuuucaugacacucuaccuuacaagguguaguaaaguuauaauuauugucuuccauucguuguuuggcuugauuuuuuucugugcucccacacuuaagcacaauaaggauaggggccauggcuaucugauauugaccuuauauccccuaauuuagccccaaacugagcacaugguagguguuugauacauguuuguugaauaacuaaauggcuuagguaguuagucauggcagugucacaagggaaugcaggaagaagauuaggggugaagaaaagauggcagccuccacuccggaaaaggaguuggagaugcuuguaagaucugcaauauaaggauccaguacucaguuaauuucaucuaguaagaacaggacagcacuagagguagagauuugagagucauuuggaguacuggcuauaguuaauuugaugagauugaaaguuguccaucaacaagaaucgaucaguguaucucaaagugcaucucuugaacuacuuguauuagaacaacuagcugugugcuauuuacacacacagacuccuugaccucacccuagacccccagaaugagaaucucugguguuggggagcagcaauauguaguuuuaaccagcugauuacauaaucucaacugcacaaagccugagagccacugguguaguagaauugcagagagccaagggcagagcucuggggagcagcaguguuucaguggcugaaacaagagcccacauauuuuaggagaugaauaagaacacugacaaauguaggaggagagucaugguuaccaagggacaaacgaccuaauuuucagaauaggguuacaugcaacaaaaauaaucagguggaugaagaauugagacacuaauguuaaauaaaaucauuaaaauacagauuuccauuugaugcuugaauuggccaguugagauuuauaagcacauuugaccccuuaguggaacuagaaugugucagaaugugagcaaacagugcuauuuaauucguuuagcuagauucaggacaaaggacaaagauugauuauguaaucucacacguacagaauacuauuucccagagucauuugugauacuuggggaaauguauuuccuucaagaacagucacguucucaaaagcuaaucuuguucagucugcauucuuaucagcuaagugagucuuaaacgaaaauggucucuguaagugacauuaauuuaagaggaagccagagacuuuuaggucauuucugaguccucugggaagucauaagaaagacucaaguucaauuggacaagaggaaucacuuuaauaguguggagagaaaagggcacacaugcaacacauuacuacaaccuuuucuggauuuuuauuuccuaccuuccuuauaggcugagaaguuuggcgacuccuuugucuuugaaggcauguugagugagcaagugaagaccaauauucaacaggcaguaaguaauguuucaacaggcuccuguauuucucuaaggcucauugaaaaggguuugggugaaaaauccaaaccacaugugucaccuuccucucccuguaacaccuaaccauucuccugcugaggauugaccccaaauaauaggcccauggaccaggacaccuuaucuuaaggaaaaugggacaagaugguaucugaggaagugaugggucugccuugaguuucugucuugugugccaaggaacacacaguguugcuagguagagcucaguaggcuccagacacuuccgaguuucauuuacuuauagccauuucuagaauggagggcucaaugagaacauuuuaaaauucuauucuaaaagucuccaucuccucaggugcugguguggagauagagcuuccuuaaacauuuuugaauucaugggaucagaguagcacucaagaaaggagcccuuuguucugaauguucaugaaaaauggagguggugaacugguucuuuacaugcagggguguacccucccauauggaggauccagggaaugcagaugagguguguuuuucucagacauggaaacaaacgguggaguagauuuucacaagcagcuuugugaugaguggaacuugggauucuuguuccagacauuuuagcagguuuguguauguuggaguauuugcuugcuuacaugucucuugaaaauauaagaacaagggaaggagugaggguaagcugggaaguugaggguucacaaaacaaagaggguagagaaugcagaagggauaggagauggugagagagggaaggaaacgggggucugcccacuccagggaggcugaugaagcuagaggcauugaagacgaaggaauccagcccucaucuuccuuuuuaaugcaaguuaccuuuuagcuccugucugcgcuucaucucugugggugggccucacucuguccucucgugagcagcagugcagugcaagaaaaacgaaacuguccuggcuuauguuugcuuucucuuuaauauagaaaaaugugggggaaacggugagguaaaacaagacuugcuuucagaucauauauaggugaauugagccacuuuuuaauauguguuuuagauaaauguuugaaaaaugugauugagcuccauucgaauuucacagcuuucuuugcuccuuacaaguuuauaagucuaauauguaaucugauauuccccuccgcccuacuuuuuuuuuuaaagggcuuugaggucaguugaggcugguguugauuagccagcagcuugggacaugugccuuauuuuaagauacugaguucaggugagggugggcguuugcgcuuauuuuuguaauuugccuuuucagauacagggccucuugucacuugagaaccuccaaacacauuagguaugaagacagaggugggucauugcuaggcugugaaggugccuguugaguacauaguaaagugugugugcuugugacuaggaugaggacaggcagcucucacuggguuguaguguuggucacuugcuuaacugcugauaauggaaaagcaaaccuuuuaagcuuauuuagaaagggcugaacaaguaacauaaaugugucaaugaucagggagagcuaaguuuuuguuuuuucauccuccucauaaggucugacuuaccuucauucacugcaccagaccuuuuuuuuuuuguaacccagugucuccagaagaguaagaugugaguuggccuacgagguaaauuugagcaguaggggagaugauuuugggugguagauuggcaagccuccaaucucacugaaucacauagugagaaagcacuuuccuuuuaggugucuuucaagacuugauuaaguuagaaagaaagaccugaaucuugcaaguuugagugcuagcauauccuuaguacuugacuacacuuuuacucuccuuuuaacauagaagaggccuuggaaguguccucaggcuaccacagcuaguuaauaauaugguuuauuuucauguaauuauuuuaaguguugcauucuauuuaugacagguuauaaaagcgagauaaauucuccuuuuuuuuuaaaaaaaucuuuuuuugguaaaauaagacaaauacagaaaaucacacaacacaaauguacagcuuacugaguuauccuaaggugaacguaccuguaagcauuacccagguccagaauuagaauuuuucugccuaccccagcagccccauccaggugccacauccuaaucaucaccccucucugucccuaaaguagccaguacccugcuucucaaaguagacacuucuuugcauuucuuuauaauauuauuacccagguguacaugcaaaguuuaaucuugcuaauuuaaaggaaauuugugucuuuuaagacucuucuacagguuucccuuucauuguguugcuuccccuuacccccuaguuuuuccuacaaugauuuaucuauugaagaaucuaggacauuuagccuggagacuuuccugcagucuggauuuugcugaaugcccugucauggugcaguucaucuguucucucuguccucuguauuuccugcaaguugguagcuggauccccaggugugaucagacucagguuugaacccuacaguaagacaucagauaauugguggguucuuuccccaugaggcaccugaugucuggugcuucuucuuuuuauaauguuagcggcuguugaugcuuaguaccuaauccauuaauccauugggggcuaucauaagaugguguauuagucucuucucgugcugcuaauaaagacaugcccaagauuggguaauuuauaaagaaaaagagguuuaauggacucacaguuccacaugacuggagaggccucauaaucauggcugaaggugaaggaggaacaaaugcacguuuuacgugguggcagggaagagaguuugugcaggggagcugcccuuuauaaaaccaucagaucucgugagacuuauuuacuaucauggcaacagcacaggaaaaccugcucccaugauucaguuaccucccacugagucccucccaugacaggugggauuauuggagcuauaauucaagaugagauuuggauggggacucagccaaaccauauuagauggugauaaucuaaucuuuuucauuuauuaauggagauacuuucauaaagagauaguuccaucaucuacuauuucuuaaccauuguugcaggucauacaggacagauaggauaaaugcuugauucuuuacuagcuuuuaagauaaugaauugguucccuacuguucuucaaaggugaccaauuagaguauuuuuugauuaaauauuucaucuuaagauaauuauauguucucaugcaguguaagaaauaauacagagagaucugguguaccuuucacccaguuuccuccaaugguaccaucuuauauaacuauaguacgguuucacagcuggaaaauugagcauucauaugacccacuuguuuuugucugauuucaccaguuuuauauuauucauuugugugucuguguauauauuuaguucuguacaauuuugccacaaauguagauuuguguaaucacuggauuuaaaaaagucuucaugaacucauggauuuaaauauauuuuauggccaggcaugguggcucaugcccacaaucccagcacuuugggaagccgaagcaggauguucaccugaggccaggaguucaagaccagccugggcaagagagagagagagagaccccaucucuacaaaaaauacaaaaaauuagccagguaugguagcauguguucauaguccuagcuacuuaggagacugaggugggaggaucacuugagcccaggaguucgagguuucagugagcugugauggcaccauuguacuccaggcugggugacagagugagacccugucucuggggagaaaacaaaacaaaacaaaaacaagccauauuuuauuuuacacugaaaccaugaucccuuuugaagguuugggcauaucuuuuuuuccaacagcuuuauugagauguaauuuacauaccauagguuuuaccauacuaaguguauaauuccauauuuuuuauauaguccaguuucacaacuagaaagcugaccauugauacaacucacuuauuuugggguuguaucaaaaauuuaucuauaucauuacaaucuaauuuuagaacauaucuaucagcccuaaaagaaaccacaugcccauuuguggucauuaccgauucccauccccagcuuuaagcaacuguccugaguccuagcagugcuucaguccuaguaguccuucauggcuucauggcuucauagcuuugcuuuuugugaggccaagaucugcucccuccccuaccccucauccuuaaagccauuucuuuaagaagcucuaguaucuuguaguagaaaacaguauuucgaggacccugucuaggcccuggguaugcucauugcuauuagguuggucauuguuucuaggccucugcaguggacagacugagauaaaaugccaaaaugaguauacacugauacuuccauuuugugauuuuuaguuuaaccuguucuguauuacaucuaucuccuuucuuccacagcaggaauacugguuuucaaggacacaggggaugauagacuagucuauaaucacgcauuuauuuuaucccagguuacauacacaguggucucaauaauacuaaugcuaccauccccaguguaauuacugagaauagguuuuuaaaacucccaaacauuuauauaugcuuuuccuguuucuccccuaguuuuaaaauacuguacuauuucuguauuauugaaacauauguccauuauagagaguacucuuuccauuuuagcucucaacuaaucucaguucuacaagugacuauacauguuuaauacucucugugaucaugucucucuagucauuugaauugaucaagcucauucucaacuagauucuucaggaaguggccaugggaacaauaugcccugaguuuuugcccguugauaacaguuuguuagugcucuuuauacuuuaaagucaacuuuucuggauaugaaaucuuugguucacauuuauuuuucuugaguagcucacauacuuuauuuuuuuucuuuuggaauaaagcauugcuauugaaaagccugaugguaaucugauuuuuuucccuugaaaauuaguuguuuuugccugaauacccaacgauuuuccuuuuucuuguucuuuaguauccagugauuucacuagacuguguguugguguuugucauugggucaguauucucagguaugggguagaagcuuucaauaucuaguuucacaauuuuuuuuuaaacuucaggaaauuuuucuguuauacuuuuuacuauuuuguguguccuuuuguuuuauucuuuaggaacuucuuauaucuuucuuuacauaauucuuuuuacccauuuucaguguuuaucacuuucuuuuuaaucauuuuuuucucucucuuuuuucuuuuucuuuuuuugagaaggggucuugcugugucacacuggcuggagugcaguggcacgaucuuggcucacugcagccuugacuuccugggcugaagugaugcucccaccucagccacccaaguaguggggacaacaggcacaugccaccacaccuggcuaauuguuuugauuuuuaguagagaugaugucucacuauuuugcccaggcuggucucaaacuccugggcucaagcaauccuuccaccucagccucccaaagugcugauauuacgugcaucagccaccaugccuggccucuucuuuuuauuuuaauuuuuucuucucuuuugucuucugugucuuuuaauuaucuguuuauuucugaaaugacuuuuuauuuuauuucuaguugcuacuugacuucucuaccucaucugaguuuguggauucugauuuauuuuguucucucuugcaucauuuucuucaugccauuuaccucauuuuuuaaauuuuuauuuuuugagacagagucuggcucugucaccaaggcuagagugcggugugcaaucuuggcucacuguacccuccaccuacugggcucaagcaauucuccugccccauccuccugaguagcugggauuacaggggcccgccaccacgcccggcuaauguuuuguauuuuuuaacagagacaggguuuugucauguugcucagacuggucucgaucuccugaguucaggugauccaucugccuuggccucccaaagugcuaggauuacagacaugagccaccaugcccggccuaccucauuuuaaaacaccauguugugauuuuuuuuuuuuuuugagcauuucuuccugacugcauuuguuauucauaaggauguuguucugcugcuucuucucuuacuucuuauagaaauuuggauugcauuugagcuugagucuuuucuguugcucauuugcauuugaacucaguuuuucugaacuuuuagaaagagacaugguucaggguagcuuuguaacuucacugaacucccucuuaguuguucucaacauaguguuuaaacgauggccuccugucuucugagauguccuggauuucuuccccuccuccacuacuucucuuuccuuuuucucucucuuuuuuuuuuuuuuccuuuuucucucuugucccucuauuucaggaguuugguuuugucucuugagauuucuccuuggugugaggcucuauucuggaagggaacccuggcaggucaguuucaagaguucaugguggggaggccgaggcgggcggaucacgaggucaggagaucgagaccaucccggcuaaaacggugaaaccccgucucuacuaaaaauacaaaaaaaaaauuagccgggcgugguguugggcgccuguagucccagcuacucgggaggcugaggcaggagaauggcgugaacccgggaggcggagcuugcagugagccgagaucgcgccaccgcacuccagccugggcgacagagcgagacuccgucucaaaaaaaaaaaaaaaagaguucauggugcacaacuguuugagugccuucacacguucuuaccaugggccccuuaaaccuacuccuuauuggagugggcaaaauuccuuccagugugagcuacuguugucaaacugucccuccaugcuuuccaguaaugccuguuggcucuuuugggauuuuccuuuucacaggucugauuuccuguugcuuucuuuucuuucuccugcccaaccacugcccagccacagacaccaugcagguuguauggccguuggcgguuuuucuucaccuguuugcguucuggguuuggugaggauacuuugucacauggauuugcugugcacauuguuccuggguuuuggguauugcucucuaguuguucugucugguuuuauacguagagaggcgagauucaaaagcuuugcugaugcuguugccaucucagcuaguuuucuuuuuauguaguuuugagguaaaacauugagcuagcuuucagaguuuguguguaaaaauaucuuaaacuggugaauuuaaugguuuaaaacagaguauuauuaucgaaguaauaaucaugaauuaaucaugaauuacucaugauuauuauuuggacguuuaauuugagacaagaaucuuaaaagguauagauauuaagucccagaagggauuaaggcaaguuuugcuauuguagcaguguuuguuuuuuggggggauauuauacuacagaucagcaguccccaaccuuuuuggcacaagggacugguuuuguggaagacaguuuuuccucggauguggggcaggggaggggaugguuuugggauguuugaagcaaauuauauuuauuguguacuuuauuuauauuauuauuacauugcaauauauaaugaaauaaugauacaacucaccauaauguagaaucagugggagcccagagcuuguuuucuugcaacuaugcagucccaucugggggugaugggagacagugagagaucaucaggcauuagauucuuacaaggagccagcaacccagaucccucacaugagcucuucacaacaggauucacacuccuaugaggaucuaaugccgcuacugaucugacaggaggcagagcucaggugguaacgcaaacaacgaggagcgggcuguaaauacagaugaagcuuugcuugcucgccugccacucaccuccugcuguuuggcccgguucccaauaggccacagaccaguacugguuugugguccagggguuggggacccuugcuauagauaacccuccuuucuugaaaaaaaggauaguauuuaagauauacuuccaguauuuaagauaaagacuguuuugauuucauaauuguguuauuaauaugacucguaaaacuuugacacaagggauagccauaggcuggguagaaaacaguugcuguuggugggagcuugaggaacaaggauucucucuucauuuguagcuuggcacuuucuggaucaacaguuuaaggaaacaaauuccugacuaaguauccuugacaaaugagaggaguaggcuauuuuaaguucuuucaacugaaagucacuuucauugaaggaugagaauuaccaagcaucuuuuuucccccugcaguaaaaacuaauuucuaggcagucauauccugcccaaguggugcugggugcuuuguuauuuggaugacacuggacugggacagaaggcaaagaauaaugcagucugacccgcuguuauuuaaucacaacugcacgacaacucuaaacuagaaagagaacuguuaauaaggaugcgauccaguuaccugaauguguguggguuguaaugagaaaugccuugagguccagcggaauucuaaggucacacuccccaaaauaauuuuuagaaaagcuuuacuaaguuaacuucaauguaaacuaagccagaaaguauucagaagggcaaguuucaguacauaggaaaaguaaauuaaaauaacucaaaacacauguaagucagauaaauagcucaguaucuuuuuuuuuuuuuuuuuuuuugagacagagucucgcucuuguugcccaggcuggagugcaguggugugaugaucucagcucacugcaaccaaccucugccuccuggguucaagugauucuccugccucagccucccaaguagcugggauuauaggcucccgccaccaagcccagcuaauuuuuuuguauuuuuaguagagacgggguuucaccauguuggcuaggcuggucucgaauuucugaccucacgugauccacccgccucggccucccaaagugcugggauuacaagcaugagccaccaugcccagccugcucagcaucauuuugaauguuugaacuuuuaguuuucuaguaguuuaagcaacaccaucuugaaaacuucaauucugcuuuaagaguuuuuuuucuuggcugggugcaguggcuucugccagcccuuugggagguugacgucggaggauugcuugaggccaggaguuugagaccaguuugagacauacugaaagcucaucucuaauauuaaaaaaaaaauaaaaauuaaaaaauaaaaagaaauuuaagaaagauuuuuuuuucucuuaugagaccacuaagacuuuucuugcccaaacccacuuguuuauuuggaaaagucauaaggaaaagauagccuuugagugagagagauuugguuuugaaucucagcucugccauuuaucaaaugauuuugggaaaagccacuuaacuuuuuuuuuuugagacaggguuuggcucugucacccaggcuggaguucagugguguaaucucugcucacagcauccuugaccuccugggcucaagccauccucccaccucugccucucgaguagcugggacuauaggagugcgcccaccacacccggcuaauuuuuguauuuuuuuguagagauggaguuuugcuguguugcccaggcuguucccaaacuccugaguucaagcgauccgccugccucagccuccuaaagugcuggcauuacaggcguugagccaccacacccggccucacuuaacuucuuugcuauucuuuuuuugacuucuuaaguuuaauacauaguuuaaaauuguugagucuucuuugcuaauguaaacauuuuagucugcauaugucuaagugaccacuuuaguuccacaaguguuauaguaguuuuguaauuguuuauuucuaaauguuuucuaauguccauuaucauuucuucuuuaacacauaguuuauaagauuuuuacuuuuuagcgugcagcuauuuugcuaucauuugguccugagaucuaacucaaugaggcuguaaucagagaauguggcccuuaugauauuggucccugaaauguguuggggcugucuuuagcaccuaccaggggucaacuuucauaaauaaaucguguauuugcaaauaauuuuuuauauuaauugggugcaauauucuauacauauccauuauaggaaguuguuaauuuugcugugcaaauuuucuauauccuuacuaauuuuucccuucugcuugaucuuaguaauugcugagaguguuguuaaaaucuccauuuaagaugauagauuugauaauuucucuuagugauucugucaaguuuugcuuuauauauauuaaagcuauguuacuaagcguauguaaguuuggaaguaugucuuccucagaugaaaaauuacuaagaggaaacaucagagguaaguagggguucuggcucaacuggccuaacaggauucuugcugaaggcaggucagugugaucagacaucaccugggggacugggaaggaugaggaguuugaucagauaucaagggugaucacacauuugaggguaggcaaacugacuuagcaggauucuuggugcagcuggacaaugcagagaugagcuuggaagcccaaaacucagggccuaguugaaaggagaguucagaggagccucauuagaguuuagucaaggagagaaucuuugucauuaaugaggugcaucuuucuuuuuaaucuauguauuucuaugagaucuuuuuuuuuuuuugcucuuauagcuauugaaauuaauauugaaauauuuuuaugagaaaaaaguuuuuaugcuauuuauaaaaugaaauaauuaaaauaguaagaaaagcaugucuuaccauugaauugaacauuuuauuauauagagauucucuuuuacuuugauaaugauuuuuaucuuaaagucuauuuugucugguaucuacuauauagguguacaagcuuucuuuugguuaguauuugucuaauauauacuuuuucuuuuuuucacuuucauuuuauuuuuuuauuuuauuuuuguguuuugagacagucuugcccuguugcccaggcuggagcgcaguggcacgaucucagcucacugcaaucucugccuccaggguuuaagagauucuccugccucagucucccaaguagcuagaauuacaggagugcaccaccacgcccagcuaauuuuuguauuuuuaguagaaaugggguuucaccaugauggccaggcugaucucgaacuccugaacucaagugaucccccuaccucagccucccaaagugcugagauuacaggugugagccaccgugcccagccuucuuuucacuuuuaauuuguaucuuuauguuuuuggguauaucauuguaaauaauauauagcugcauuugaaaguaaugcauucuuugucuuucaguuaagacuuuaguucuuuuauauuuauuguggcuauugacauuuuuggauuuaauucuaccaucuuauucuuugccuucugcuuauucuguuuuugucucuucuuuuuccucaauuucuggccuguguuuuauuuuucuuauuccaacugugcuugucuucuuagaagucauauacuuuauaucuccucauuuaguaguuaaucaauuuuaauacuugaguauaaaguuuaacauuuauuauuccauuaacuuuucuguugaauaaucccaugaccuuacucuagucaucguuauccaacuuacguauuacugguguccacucuuucauucuaauuuguuuucuuccuccacuaauuagacaugguuaauacuuuuuuauguagucaguauuucuuuacuccuauaauuacuaauaucuguacucuccauuccuuucugcgucucagggauucugucugagaucaauuucucuucugccuaaaggauauccguugguaguaaacuuucuuguuauuugaaauaucuuuaaguaccucauuuuugaaagauacuuucacuaaguaaaaauuuuagguuggaaguuauuuucuuuggcacacuaaaggcauuauuucacugucuucugguauuuauuauugccuuuaagaagucagucauuagucaguuggguuuuuuuuguuuuuuguuuuuuguauuuuuuuuuuuuuaggugaugcagcucuggcugauuuuaagguuaucuccugucuuuauuauucuagguguugauuucuuguauuuauccugcuugaguuucacuggguuuccaggaucuguagcauguuaaucuccuucaugaguucugcaaguguuuguggagcuacaguuaauaguuuugcaauugcuuauugcuaaauauuuucuaauguccauuauaauuucuucuuuaacccauacauugggaaguuuuuuuuuuuuuaauuaacaacucugcucuacucuuaaccauuauuuuuuugaauauugcccuuucucuauucucacuuauuuuccucugaaacuccaauuagauguuggcuagaccuccucacuccaucuuccaaugucucuuaaccucacuuuugaauguuuuuguuuauaucuauaucuaugucuauauguauucaguauuccauuguaauucuguugucuauugggcuauaucuuuaguauuauuuuuagugguagcucuaaggauuacaauauaauauacguacauaacaacugacauuauaguguuaacauuuuaacacuuuaaguaaauguguccuauaaccauauagacucuacuaccccauccccuguguuagaguugucauauauuacauguacauacauuggaaaaaaccuagacuauguucugcuguuuuucuugcaauacucauacauauuuaauuuaauuuauuuauuuacuuuuuaaaaauagagaugggguuucgccauguugcccaggcuggucucaaacuccuggccucaagugauccucccaccuuggccucccaaacugcugggauuaucgaugugcaucacugcaccccgccucguacauauuuuaaagaagaaaaauagucuguuauauuuauccaaaccauuucuguugcucuuccuucauuccuaaaguuccauguuuccuucugguaucauuucucuucagccuaaaauaaaacuuccuguaguacuuuuuuuagaguaagccuuaugguaaugaauucucuuaguuuuucuucaucugauguuuuuauuucaccuucauuccugaagggaauuuucugagcuggcagguccuuucuuucaucacuuuacaaauguugauucacaaucuuuucuggucuacaugauugcugaugacagucauuucaaacacuucucuuacauguauuguggcauuauuuuaugucuuccuucaaguuuaaaaaauuuuuuaucuucaacaguuugaugaugaugcauuuggacauguuuucuuagggauuauccuauuugggguuucuugagauucuuguauguguccauuuauguuuuuaaucauauuugggauuuuuucagauauuauuucacuuuuuuuaaacaccaaucucuccucucuuuuugggacuccagugcauaaauguuagaccuuuugauaguaucccagagguuccuuaggcuuguucauuauuuuaaaguagucuuuucucuguguucuucagauuguguaccuucuguugauaugucuucagguucccuauuuucucugagagcucuuaucuuuccauucgagaccauucaccuuugcuucauagccgaugauuguaauagcuccuuuaaagucuuugucugggcccgguggcucaagccuguagucccagcacuuugggcggccgaggugggcggaucaccugagguuaggaguucaagaccagccuggcuaacguggugaaaccccaucucuacuaaaaauacaaaaaucagccgggugugguggugcagccuguaaucccagcuacuugggaggcugagacauaagaaucacuugaaccuggguggcggagguugcagugagcugagaucacgccacugcacuccaaccugggcaacagagugaaagugugucucaagaaaauuuaaaaaauaaagucuuugauaauuccaacuucugggucaucuugggguuggcaucuguucauauucuuuucccuccaguaucgggucucuggggcuuguuacaauucucuagggaauuuuuuuuuccagcaaaaucaaccugguuaggaacagacuguaaguuuugucucaccuaaagcucgugaucauucugcaacucuguucauucauuuuuuucaugccagcacaacauuguaguuuuuuauucacuaguauuuuacuuguuuuaaucaaucucuuauaauaaugcuaccccauagagcuguuacaaagaccaaaucaaguaauguauacaguaccaccugguacaguaccuagcacauagaaggccuuuuaguaaaugacauuguucuaguuucuuccaguggacuaucucuuugcuugauauaauugaaaauuaaguuaaauuuccuuuacuguugcgcauuuauaagauuugguaaugccucauauagcauucugccaagcuacaaugauguuuugaaaagauuuacuauuguggaauaccaaauugugaaauuuacuaugaaauaaauccucuuagauuaucuuagaagccuuggcuggaggaauauacuaauaacauacuuuguauguguguguaugguacacuauacauaacauaaaauuuaccauuuuaaccauuuuuaagcauaaaauucaguggcacuaaguacauuaacaguguuauacaaccaucaacauuaugcauuuccagaacuuuuucaucauuauaaacagaagcuguaugcucauuaaacaauaacucuucagccucuggugaccuccauuguacuuugagccucugugaauucuccuauucuaaguaccucacguaaguggaauccuuguccuuuugugccugacuuacuucacucagcaucacguccucaagguucauccauguuguaguauguaucagaauguccuuccuucgaaccccugcuuucacuuguucuggauauguauggugacauaucucuugaccugucauuuguauucaugccuucuugaggucuguuauccaucagugggguguguucuuugacuucuagugauggaagugagucuaauuccuucugugacaauuugcuuucuggcuuaagauguggucuguguguucagcauacaacucuagaugucccacugucuuccagguacuaugccaaaaugugaaagaaugccauuugaauaucaucuaugggagcauuuaguuuuugaaagcagcagggcucagaccugguaugacccauuucauguuguaaagucagcuuuuccuuggggagagaacacuggccccgucaacagggugaagguggguucacgguaacugaguuauucgggaagggcaggccagggcuggcugacuagaugagauaagaagguaacacugucuuuugugucuuuuuuugaaaagaguaguuguucacuugacuuaggagccaguguguggcauaagcucaggaagcaaaacaugauaacccuggaaggugagaaccuaauauaauaggauaacagggcacacaauauuuuuuucuaaccugcuccaagacaccugaucugaaugagugugugugaggcaugcuggggucccagaggugcagauuugaaauaccuguuuaaugugaccuuaaauuucuuuucaugucuugguucuuuugaggccuaacuuagauuaagagguaacaaugauucugauguucccugccccucgaauauuggacucuguaucgucggccucugugggaaaacaaagguaaacuguugaguagagagucaugcugagggaugucuagcuuuaagagaaacuuaugcaaaaauaagaauuuggaauggaugaaacuuucagaauuaucuggcaaaaaaucuuauagaugaggcaacaauggcccacgaaguggcacaaaaggauaucccacugaaagacuauuuaaaauugauguuuaugcggaagagggucacccagggguggggugggguuuggaaaucaugcaaaccuaaggaacagaggacuuuuuucaugaaaaauaauguuuauccaguauguacuaggggcuagguuguguuuuaagugccauagauacaacagauaacuagaucuaaauccuuauucucauggagguuauaauucuaauaaggaacagacucuaaacagguaaauuuauaacugacugugaugacggacugcgauucaaauaaaacagaauaauggauagaaaaugauuagaguauaaugcaguugugcucuugggucuuuuauuuauaggauuggugauggucucucugaggugaugacaucugagcugaaaucuaaacaaugagcaaggcuagcaugaccaguagggagggauugaggaacaagggggacugugauguagggucaggguuagguuggagaaguaggcaggguuggauuacauagagcuuuguaggccucaaagguguuugguuuucaucugaaacacaguuagaagccauuggaucuaauuaacauuuuaaagagaccacucugguucuguaugggguuuugugauaguccuggugagagaugaugggucugaggaaccaggugguaggaagagagaagcuaagaagugaucugauauuuggaaguaccucugaaagcauagagagaaaagaaaagacaggaaucuaguaugacuccuggguuuuggggagauggugaugcccuuaauuugagauuggaguuccugggaaagguugaauaaauuacugaaccuaaagacuaagaggugaaugaguuaugauuauucuacaaaugucugaaagaugauggaaaaagaacuugaucuauuccaucugaucccugggaaccuagaaagggacagcagagggaaggucuccaggagacagauuucaguuuagcuauagauugggaacucuguuagaaugaucugaacaugacagggacugccuaccaggaagugauaucugucacccaaauuguucaagcugagacugugggaccaucuauucauagacugacuucauaauuuauuguccaaaucaagacacuuuugacagcgaaaugggaugcucuuaauuaugcuuggauaauacugacuuaggacuuuucucaaucacuuuugccagccggagauaccuugcuagcaaugcccuugccccaccuuggucugugacuucagggcuagcuuggccucaccaccauuucugucaugugggguggcugcucugugccggugaagggcagagggccaugauguuacagccuuuucugcuccaauauucagugggucccaagcucuugucucacauccaagaagaaugaggauaugcugacaaucaaagagugaggagggcggagaaaaauuuuauugagcgacgcaacagcucucaguggagaggggacauggggguggucccccauucccacaguugggugguuucucucucaguguggcugagugcagggcuuuuaugggcucagaauaggggaaugcaugcugauugguuuguguguaugcaaagaaaggcuaaagcaaagacaccacucaaaggugggcauggcaguguagaaaaccaauuaggaaaggguagguauauguaaaauuagugaaggauggggaucaaucagaggaaagugugccaaaugggaaggcagguucucaauccggucuguggcuuugacuuaaagcuuggcuuucaggcuuuaaacugucuuccacuuggaggugggguuucaccauugacccaucucuauuugccuaggcauuugucugccuccucccacuaucaacagguauaaaucuggacuucccuugucaaauagggaaugguauucauccuaccuuauuucuguucauccuagagacacuauagaggggaugcuuuuagguacagguuaaaaucaaguaacuuuuuggcauccuuccagaucuaagguucugaagaucuuugguacauuuuauuuaacaaaaaauguugaugcccaaguuuucuggauuaguucaaguacaccuguaauacagguggccuccuguguggaaugcccuucccacuccugcccugccuuacuugcuccuccuucuuaccucccgcaggaagcacugucagggcaucaccccccugacuuugauugggugccccaccuuuggcucccauagcucauugagcuucucuuggccacaguacuuagaacaggcuugaaaucaucugcuuguuugucuucccuucucaaugauguacuuugguucuguauccccgggggcuagcacaggaguggcauagagaagaugcucaccaaguauuugcggaaugcguagauagcaucaugaaccuauucuauagauucguagucaugugccauuacccacauauaccuaacuacauguugagugcuuguuaugguauauccuccuagcgagccuauaugagaaauuuucauaguauacuaauuuuacugauugaggaaacugaggcucagagaggaaagucacuuguccaaccaacauuacauggcuagugauguaauaggagagccaaaauuggcacccagaauuagccacuuggcucaagugccuacuaucugucccguuacucaagacuuaccauacacuugauaagauucucagaaguccugcaauuaaaaauuaguuuaacuuugaguaacccagugcuuuccuaacuacugugacuccuuugauggugggaaccuuuuauucuccguaccuacuaccaucuuauggaaaacugucaggaaacagcuguugggaagugcuugaauaguggaaaaaguucugaauuguaacccugcagccguggguuauuuuccuggcucugccacuaucugccgcuuuucagggccuauuuucccauuuauaaaaugagggaauuucaguagauaucuucucagauccuucccaccuuuaaaguccuuuaaaagcauacuuuuaaaauccuuuaaaaguaugcaaauguucccugcauaguuugccuccaccagcaggagaaucagcagucaccaccuugccacuggugcaguguucugcugcccggugagaugagaugugccaggcuggcagccugaggaauuagcucugcagaauguucagaauuuguucuguguucuuguggcugugggcugagauuggcugguacaguaccagccugucguuugaagggccagcaacagagccaugauguuauauggucaucugcauguguaugucucuuacuguuaauauaaguaggaaguagaucaucucaggcugugacccugugcugccuuugcaacaagagccccugucccuugaggaugcucuuuuuccugucuuuuacaaauaauaaaugagauuauuuauauuguuguuuaccuccaagacaacgugugugggagaauuuccuguucuuaaaaugccuuuucuauguucugucuucucuuugaccucucuucucagaagcuugagagcuuguaaggcgugaaaaaauaacauagaagcaaucagauggcauuccaacuuucuguaauuucccuguuuuagacacuggaaaagaccuguaaagaucuauaaguaagcuacuagcaauguaaggaaccuaaguggagccuucuuacagaguugaaauaaauaccuucaucuuggguguacacgcagaugucuuuccagagggaaacuaaccguaccaucuaauaauauugaggauuuuuguaaaugauuuuuagcaagggcuauaaagacacgcucucagguuacagugaugcuacuuguggaaauuuagcagaagcaaaaaauguacaugaagguguuugaacauguucacuguaguguuaucuauaauagcaaaaaaacaacaacagacaaacuugaacauaaccugaaugguucaauguuaggagaccggaaauuauaguguauugacaagacaaaaauauugguagccacugaaagugaucguuaugaaguucagauaaaacauagaaaaauauucaauaaaaucaaugaaaacauucaauauaaaauuuggaaaaacuguaaaaauguguaugcuuacugaugaagcuggaagaugaauauaaaaauaaaauuuguaauggaaugaugaauauaaguaauuuuuaaugaacauuaauuugauauugcuuuuguuuuuucaauguaaaauuaagucuuagcuccauuaaaagaaaaaacuaaaacuaaaaugaaaauaugaauaaaaaauauguucgcuguagacguuucagacauuaaaaauggaacagggccuagagagguggcucaugccuguaaucccagcacuuugggaggcugaguugggaggauugcuugaggacaggaguucaagaccagccuaggcaauguagcgagacuccaucuguacaaaaauugaaaaaauuagccaagugugguggcaugugccuguagucuuaacuacuuguaaggcugaggugggaggauugcuugagcucaggaguucaagguuacagugagcuaugauagugccacugcacuccaaccugggugacagagcaagacccucucuccagaaaaaaaaaggcacaagaagaacauuagauauacccauaaucucaccacccagaaauaaucaucacaaacauuuaaauauauguucugcuaauauuuucuugggauauguggguaugugggugggugucucuauauauugauguauuuuuaauugaauuuguacaaacauuuuuguaacuggcuuuuuucacuuucaguaaagggcagacauuuauucaaauuuuauuuuuucagcauauaauuuuuaaugacuaugauguauucguucaaaugguaugaaauaaaugauucugaauauugucacauugcuuucaagauagguuauaccaauuuacaguuacuuauuugaugaaaaugaguaaaaauuguuuuuaaauaauaagaaauauuucucucauuuuuguuaauuuuuuuuacaagccccaaaucaguucccccugcccugauaauuaugcagaucuuaacugaaaaugaguaaacuagaucacuuuuaaggcuucuuugaguccauagauuccuugggccauuuuuugcacauucucaauagugccuagaaauucugccuagaauuuccacuccuuucuuaaggacaugaaauguuuugaguguacugauuacugauugugugccuugggaaugcaauguauuauagcaugagggauuucacuaagaacugaaccaaaaaguauugaaaaguucaagucugccugaaguuucauaaauauuuuuacccuguuugaaaaagcaggcauuuuucucucccaugcagucuauuaagucaucaggguaccugauuuaggauuuaauuugaaguaagcugucagacuugacuaccuacuuucaugaugaauuuguuuuuagccuuuauucaagccucauucuuagcuuuccauacuuguguuggguacugaggaaauauuuuuacugugugcucuuuacuccauuuaauuccuucaguugcuaaauucuccucugguuuuauuuauacuucaugaauuugagcagaucuguaauuucucauuguucacugaugccaguugaaaaauucucccggguuguuuuuauagggguagcugucauguuuauacuacguuucaagaaacguccaucuuuuaaauuugcuugucuaaaugcauuuaauuuuuaagagagcaguuguaaaguugugcacuugacaucuuuacacuugaguaugcauaauuauacagagcuuucuuuuuccugugcugauuuuauucugggcuguguguguauaagaagcauaauuugccaccucuggcaagaauaaaggcaccuuugcugucuuguuuccuuuucuuuaagcugcuacuacaagucugguuauguccccagggagaggugggaaacaugucuuugcucucugaaguccauuucucaaggggaccucaaaacucacguggguccuauuuacauuguaauuggucacuggcuggcucauacagcuguuucaacuuaaacccuagacaguugcuauggagaugguugacuagaaauaggucauguuaaaguccuuuuuccucuggauauaagggagugcuguaacucuggaaauugucucaguugagcagagaauguguagguggacaaccacauccaaaaaaaauugucucuuuuuagguugagguuuaucauagaugccaguccacucaugcugcugcuucugcucuguaaacaacacaccugaacacuauuccuguuaaaaggaauuauagaugucacaaucugcaguauagccuugaugaaaugccuaauauaugacucuuaaaaguuguuuguuuuguuaaguuccuaaaccuaguagaauagcacuuauuuucaagacagaaucaggaguucaagaacaaguuauuugaaauguuuagaaacagugacacuuggaaaaggaaaacgucuagugaguuuggaugggauuugcccuaaauuugaccagaaaauauuugacauuccaagggaaacuugcgcaggaugaauaaggcccuaccucugauuucgucaguccucaguuguggggugacuuugauuacuugucucuccuucuucaugugugaaaugggaaaaugguuucugacucugcaucugaccaucacaguggugacuuaugaucugucuuacagacagacaaguguguaguuugguucccuuacaggggcccaagcuuucugaaguuuggagguugaggaauguggauaccuccuguauucuguuuaccccucacacccucccugauaugguuuggcuguguccccaacuaaaucucaucuugaaugaauuguagcucccauaaucuuuacgugucaugggagggacccggugguaggugauugaaucauggggcuggguuuuucccacacuguucuugugagagugaagucucaugagaucugaugugaucucugagaucacauggugaugguuuuauaaaagggaguuccccugcacaugcucucuugcccucuugccugcugccauguaaggcgugccuuugcugccccuuuaccuuccaccacgccaugauugugagaccuccacagucauguggaaugugagacaauuaaacuucuuuccuuuauaaauuacccaguuucagguaugucuuuauuagcagcaugagaauggacuaauacacuccccuugcccuacccucauggugcugcuugcuuuagagaguggguuaguuuauguguagaugguucucacaucaugacugugauggaagaugguacaucuucuugagaagucuuuggaagugacacauguuccaauacuuccuucaccccuuagcucuuggucacuuuucucaguugaucaguacucugaaaagggugaacugguggguggagggggcucaagcugaacagauauggggguagauuuucacuaauuagaauauauguucucugaaagcucuaagagaauauuguaacauguaauaacauaaaugaauaguaguaauaaugacagcuaauacucuguaccagguacuuuucuaagcacuuuacauguauuuuuaaauuuaauccuuauaacauccccaggaaguagauaguauuauuuuauccccacuuugcagaugaguaagcugaggccugaagggguuaaauaagcagcugaagaucuuguagcuuguaaaaggugauacuguuguucaagcuuaggcagcuugacuccagggucagauacucuuaccacuaugcuacuauaaacuguguauuaauauuuaagaagaguaaucuuuuuuucccuaauuaucauaauacaguagauaauuugcucuccucagaggacauuuagcaaugucuggagacauuuuugucugccgcaguuggcaugggagaagaaggaugcaacuggcaucugguggguagaggucagagacacugcuaaacauccugcaauacauaagacagucucccauaacaagguauuuggccuaaaauagcagcagugcugagguugagaaaaccugugauagugacauacacucauucuaaaaaugucuaauaguacucuccugauccuucgcuuauguuaaguuuauguauauucuuccagacauuuuuuuccugaugauacuaacaaacauuguuaugcauacauuuuauagaaacggaaucaaauguguauucuauagguuaccuuuaugacaguauauuauuuucauauuuccaugucagaguguauuuugauaacuagccguauaguauuccuuuuuucauggacaccaaggacaguuggguuauuuuguaauuuuaaguuagaaacuauauuaugucuagauuuacuauacauauaucuuugcauacuugcuucaggucuuacuauuuuggaccaaaacacuagguugcggccuuuggucaaggauaguguugucgugguguccucuuucucaugcuuuggccacaguguguucacguguuuuuuccaucuuaccgugcaccucauugagauuggugaucaucauauagcuccaugacguuaaguaaguaguguguuuuggguugcuaggguagcaugaaagauuucagaaagaauaguugcugggaaaaaagaaaagcgggugucuagaaugagagaaagugugagugaguagguguguguauagcagagggugggguagcggguggaaggagauaaaaaaacuauaguacuaauauguguagggugauaucuggacccaucaauuugaauuuuagagacauuuaucaaggaaaaugagaugacuaauugcacauuuucuaugccaauuauugcaacugaggaauuaauuuuuguauuaagcuguuccugcaauugcuauaaagaaauaccugaggcuggguaguucauaaagaaagaggucuguuuggcucaugguuuugcaggcuauacaggaaacguagcucugguaucagcuuuuggggaggccucaggccuuucgaucauggcagaagacgaagugggagcaggcgcuucacauggugaaagcaggagcaagagagugagguggagggaggcgccauacacuuuugaccagaucuccugugacacagugagagcucacucaucaccaaggggacggcccaagcaauucauaaggguucugccccagugauccaaagaccucccaccaggcgccaccuccaauauuggggauuauauuaauauuucaacaugagauuugaguggggauaaauauauaaacuauaucaauuauuauauguaaaauaaauacuuuuaaaacuauuuaauauaccaauugucuucagucauacucugaggauuccugggacuuguagauccccuccaagaaucagguucagugcuagccauacagucggugcucaauaaacauuuguaaccagauugaauugagaggaaaaggagaguagaagaguaugggcugagaggucacuagagagaagcccuagggacuucuauacauaaacugacuugagggaaagcuccccuuugaaaaagggguaggcuccaaucccauccagguugcugugaaugccguuaauucauucuuuuauggcugaguaguauuccauuguguguguguguguguguguguguguguguguguguaucacaguuucuuuauucacuuguugauuggugggcauuuggguugguuccacauuuuugcaauugugaauuaugcugcuauaaacaugugugugcaaguaucuuuuucauguaaugacuuccucuggguagauacccaguagugggauugcuggaucaagugguaguucuacuuuuaguuccuuagggaaucuccacgcucuuuccauuauucuaagugaaguaacucaggaauggaaaaccaaacaacauauguucucacuuauaagugggagcuaagcuaugaggaugcaaaggcauaagaauggcacaacggacuuuggggacucaggggaagugauaaaagacuacaaauuggguucaguguauacugcuuaggagaugggugcaccaaaaucucacaaaucaccaccaaagcacuuacacauguaaccaaauaccaccuguuccucagaaaccuauggaaauaaaaaguuaaaaaauaaauacauaauuuuuuuuaaaaaaaaaaaggaagaaaagaggguaggaaauggcaggggccuucuccuguuuaaggcuuguguuugccucuacuaaagcugugcacauguguauucuaggacucagcuguuccacuccaccauguacugucggcagaaaugcguacauauauuugccaaaagccacaaacucuuuuaagaauauugauagaagcaguacuauucauaauagccccaaacuggaaacuacccaaauacccauuaguaguagaauggacaaacaaaucauguuuuuuuuuuuuuuuaaaucacuaaugaugaaauauuuuaagacacaaaaggguaugagaagaaaagucauucauggagguuaacauauugcuauauuuugucauucuuuuaagcuuuuuuauuuuuauuuuuuaauuuaagaacuagaaccuucuggugguggugcuuaguguuggggacaggguagaguuggaagaaugaucugaggauccuccugaaacacaagugugggcugaccugagcuuucacugcagcuccucccuugacacugaaugaauuaccugucaugggcaccuaaaccugcacagcccagucagugagaacagcccccagaggaacuucuacagcgccacaaaugaaauagaaagaagccaugccucuucacuccccuguucucuguaaaauaaaacaccuugcuauagugucauuuaaggaccuaaugccuucuuuuguugaaauauuuuaaaaauuggguuuucccaucaaauugugauugagauaucaugaauguucugauuguguugaugugaaaagagaaugaacaagaauggggcuugguguuuucagugauugcuguaauuguuagcagggacauauucucccuuaacuucuacucagacaagcucaaaaggaugaaaacaaucaaagaguaacauuguuguggggauaaccuugagucacuuucuuuuguauuuguauuuguauuagaagaaucauuugcaggccaggugcaguagcuuacaccuguaaucccagcaccuugggaggccaaguugggcagggaucacuggagcccaguaguucaagaccagccugggcaacauggcaaaaccccaucucuacaaaaaaauacaaaaaauuuagcugggcauuguggcgcacaccuguggucccagguacuugggauggugaggcgggaggaucacuugagcugaggaggucaaggcugcagugagccaugaccgugccacuguucuccagccuaggggacagggugagacccugucucaaaaagaaucauuugcaacaucuguucuuuagcuaguauuagcaacaaugauuaguuuuuguggcucuccuugugacugagugucauggggccauagugagacugguucccuuuacugagugcuugcugagucauuaaccucaguugcuaagggcauagucauaaguccuguaugcguauuauauuuccuccuuguaauaacccaagauauaggugcuguuacuaucuguauccccacaugagaaaacaggcuuggggaaagagguuaaauaaguugccuagggucacaccgugaacagcagagccaugauucaaaucucauuuugacuggcuccaaagccuguguuccuaacuaaaccacucacuaaaugaggacuccugacuguuguuauuuugguuaacagaaccauaaaguaggaguuaagguucuaguuacuguuugcugagcauuuuccaaucuuaccucacuugaccucuguauucugaguuaggugaggcaggugggugugcucccauuucacagacaaggacuaggaggguccagacaaguagugaacuugcccagggucacccagcuaauguuggguuggaaguugaaucggggucuuuugaaaauacaccccauuuuuucuucugugcuucagcuugaucucugaccaccaugguugaccuuuagccucacauuuaauuguaggguuaacucuguuuccucaucuuuuaaauaggagcagcacuaccugucucacuuguuagagauuauagaggauuggcuagccaugcacuuuuuaaaaauucuuacagaggccgggugugguggcucacuccuguaaucccagcacuuugggaggccgaggcgggcggaucacaaggucaggagaucgagaccauccuggcuaacagagugaaacccugucucuaguaaaaauacaaaaaauucgcugggcuugcuggcacgugccuguagucccagcuacucgggaagcugaggcaggagaaucgguugaaccugggaggcggagguugcagugagccaagauugcaaccccugcacuccagccugggcgacagagcgagacuccaucucaaaaaaaaaaaaaaaauucuuauagauauacaccauuuaaauacauauguauuuguuugcugugaggcuuuaugauaugaaguaauacuuuuuuuguuaaagauuuauuuacauauaagucuuuauuuugguauucuggcaaauguauuuguuugguaauccaaauggaaguugaagacauugagauuuuugcugcauguacugaguugauauuuuucuagaguugauguuaguagcuaacaucagccuguucuggguugcuuugagguugcagcugcucccuggugguuaccugugaaaggcgcuaacuggagacacccagaagggccugacucuacuauucugcacaggugaggcuggucccucuuuccccaguugacaaguuccauugcaaaauagguacccuuugcucuugcaaaagaacucagugggcaucuucaucuauaaaaugauaagaaugacaaacuguaauugauugguaggaaaauaagauggugggaaauaacguauguaaagacccaaacacugcaccuugcucauaagaaagcucuuaauuaguggccucuuucucuccucauuuggcuugucaaagaguugccucuucccaguuucccugcuccuuuugagaggccuauuccaaaccucaugacauguuuaaucuuuacauucuguuuccauuauuagcgggucuaugaggaagaagacgucugucuuauggauaaguaauuguguccucccagguugccacuguggaagcccaggccuuggguauaggauucacaugaucuugaguuccagauuggaauucuuugaagccaccaucuaacuggaaaaccacagagagccaagucggucagcaagucuccaggguggcaaggaaauaauuaucucaagcaaaaauagaguaacacuuuaaacccuggagauugagcaagguuuggguuaggacucagcaucucagcagcccaagaaaccugcucuccuaaccuaauuuuucagaugcaguuuuuaagucucuauuuuuaacaacauuccugguuauugcccuuauugucggggagcugcgaguauaggaaguucagcuuuagggauauagccccuugacaaaugucaaacaucuuucaaagccucaauuggaagccgcugugcugcaauuaggcuucgagguggaaagucauaggauuccuggguuucucagguggacuuggcuucuuagcucccaguuaauaucugcuuuccugaauuuaguaacagaggaaaaugcuaagggaggaaggaaaacccaaaaggggaauguauguuauccaugcagucaacaccgauggaucuucugagaagaguaccucuguugucugugcuggaaacagugacuggcacaugauagguacucaguagauguuuguugaaagaauaaaugaaaggccugguguaauuacuguggggaauucaaagguguauaaggaauggacuaggaauuuguagcccacuuuuaaaaaagugagcagggaauucagccaaagccaucuagugcugggugaaugagucuauccccuuuuucucaguuuuuuuuccccaaacuuccacacccuuuauacccucaggaaaaaaagaccggccucuuguagaggaaaaguagaaagacacagaauugaaagccaagggucacagguuggguucucuggaaacagaggcugaaacagaguuuaggaugcagaauguuagggccccacaccuguagaaagcaggggccagagcaggacugggcagagggagaagucaaagccacaaugcagguccaaccaagcuccacccaacacaggggccucuaggguguauauggcccauagguugagccacuguaggcugaaauggcuggcucuguaugccccugcugugguugguuagucacugguuucucugagauggcugucagcucugcugaaccccaaaggagcugaaagcuccugcuggcccuccuagcagcuggaguaucuccgcaucugccauaccaaugacauucugugggaauccgagccuacaaagugaagaaauguuuugagucuaguucccaguggaacuguaacccauuugggagccuggguugucagaaaccguugguggagcaugacagauguagcauggcugggguuugacuuaaggaccaggaugaccucagugucacagauugaacugagggggauuaugggcgcuuugcugaagccagcuccugcuucuuguucugauuggugucacuuuucauucuacuuuugcucuuccccaggccggaucauccaguucuccauguguccuggaaugaugcgguugccuacugcacuugggcagggaagcggcugcccacggaagcugagugggaauacagcugucgaggaggccugcauaauagguauuuagaggaucucauuuugccugacaauauguuggucauuugaacaaacaaacaacaacaaaaaacuccauggaacuuacuuugguuagaaaguuaauaacgacaauaauucuuuuucuuauuuuuccacgaaauuacuuagaagacacuggagaaugggucacaaaucuuuuaucaccccuaaaccaagugucuggccaagugggcucccuccagccccaaagcaagucuuagcaauucaacccccuugaguuacauaucacugcuuagaacuucuuggcagacugcccugcuuuuagcauuuucuuauuuuaggcaucuccugaagcagcgguaugucucugcuucuagagccaugagacagaaaacucauguuggguucacaucuucuaggaaaggcuccuuaaaauagcccaggcuuuauaaaaaaguguggugugguggugccugaucacacuaccauauaaguccaaaaugaggucuacucucccagcuuucuauaaguccuucuuuuaguuuugugauuuauuucaggccuccugaguaccugggcaagacugaggcuguuguggacgugacaugagaaguuauaaggaaauugaaaauaaauccugauuaaaagcuuuauuuauuuauauauauauuuuaacuggcucacucagaacaagcaagcaauguucucuuuuucauugcaucccuucucuugacuuucauccaaaaccugugccuguuugacaggcugaugccugugucucuucugacagacuuuuccccuggggcaacaaacugcagcccaaaggccagcauuaugccaacauuuggcagggcgaguuuccggugaccaacacuggugaggauggcuuccaaggaacugcgccugugaguaaugagaccucugcaggaggguggcagcugcugagaacugaggcucccaguagacauggggugaaaggcauugcucacuuugugacucacacgguguucccuucguguaugcauucacuguugcacguagcaaauacuaauaauuaaacagauuuucuuuuuguauaauggauuucccuuucugauuccauaauacuuacuguagauuauuuggaaaaaugagaagacuauaaaggagaaagcuaaacuguccuggaauucuaccacccagaaauaauaccuguuagcauauuggugcauuucuuccccauuuguucucuguguugaugaugcuaauaauggcguguaguuauugagugcuugcaaugugcugggcauugugcgccaaggcauuugcaugaauugucucauuuacuguccauucaacucuguaagguagguacuauuauccccauuuuccaggugagcauucugaggcacagagagguuaacuaacuugcucaagguuacacagcuggaaagcggcacagcuggaauuugaaccaggucgguuuauuuccaaagcccaugcucuuaacuaccguauuugccagcauauguguuucugguguauauguaucauauuuuuuuacauauugcauuuagguaagacuggauacaguauuuaaaauccuacuauuuuuuccugccuauaucagaaacguuucaucugucauuagcaguaugccacaaauacauugucuuucagcagcuggauaaccugucauaaauaaaccccaauguauuuacuggaaacagguuauuucuguuuuuuuuuucuacagugaacaucuuguacauaaauauuaaccuacgucuuugaugauuuuugaaagauagauuagauucccagcagugaaauaauucaaagucuagaaaacuuucuggguaagaguuucagauauauggccaaacuguuuuccagaaugcuuggggcauguuuuccucuauugguguauaagaaaucuuuucucaccguucuuuugcuggcauaaucauauacucauaaagccaugucuuagucuuagucccuuugugcuacuguaagaaaauacuacagacuggauaauuuguaaacaacagaaauuuauuucuugcaauucuggaggcugggaagucuaagaccaaggcagcagcaugauugaugucggcugcauccaccagaagggacuaaugcuguguccuccccuggcagaaggcagaaggcgggcaaaagagcacucacuucaaccuugagccauuuuauuuacuuauuuauuuauuuauuuuugagauggagucucacucugucacucaggcuguagugcagugguguaaucuuggcucacugcaaccucugucuccuggguucaaccaauucucccauuucaaccucccgaguagcugggacuacaggugcacaccaccacaccuggcuaauuuuuguauuuuuaguagagacaggguuuuaccauguuggccaggcuggucuugaacuccugacuucaggcgauccucccgccucagccucccaaaguguugggauuauaggcaugagccaccgcaccuggcccuuugaugauuuuuuaaagauagauucccagcagugaaaugauugagucaaagguuagaaaacuuuucuugguaagaguuucagauauaugguugaauuauuuuccagaacacuuggggcauguuuuccuuuauggguguacaagaguuccuuucucaccauucuuuuguuggcauaaucauaugcucauuugaaaugagcuccauuccaaagacacaggugauggcuuuuguggcccucauuuggacaagaccgugauaaucauuucuuuuauuuuucugucuguuuuuuuuuuuuuuuuuuugagauggagucuuacucuguugccgaggcuggagugcaguggcgugaucguggcucacuccaaccuccgccuccuggguucaagugauucuccugccucagccuccuuaguagcuaggauuauagcugugcaccacaauaucugacuaacuuuuguauuuuuaguagagacaggauuucgccauguuggccaggcugguaggugauccucccgccuugaccucccaaaaugcugggauuacaggcaugagccacugcgccuggccugugauaagcauuuuugaugaaccaaacgaaugauauaagugccuguucauuuuaacaaaaggccaugacaggguuuucuuggacaguuaugcauauuugacagcacuugcagcuacaguuucuuuucuauuuaauuacaugagcuaccaaggaauauagagccauuuacucuucuaaaaucaguguaccuuuucaaaaaauacaauguucaauaugaaauaaggacacucuacagauguuuagaauuggaauauuugacugaaaguucagcauaugugugggaaauugaccugaagaaguugccauggaaguuacuaaaacagauuagaacauuuacugggaguccuaaaggaaccaauuugacaaacaggacuagaggagaaagcaagcaagccagccagagagagacagcugccaucuguguuuagaaugagucuuaaugagaucucuaucuuauggcaaucguuuacacguaguaucucaaguccaccuaagcugcucuuuuguguccacaugcucuggucaacuggagcaggaauuuaacuuugauaaugagauggacuacagggaaauagcucccugaccugauauuucauguauuuauuauuucaggucucauuuuauuuauuugagacaggguccugcucuguugcccaggcuggagugcaguggcaugaucacagcuuacugcaaccucagccuccugggcucaagugauuuuuccaccccagccuuccaaguagcugggacuacaggugcacaccaucaugcccagcuaauuuaaaaauuuguuuggggccaggugcgguggcucaugccuguaaucccagcacuuugggagucugaggcagguggauugccugagcucaggauuuugagaccagacugggaaacacagugaaaccccgucucuacuaaaauacagaaaaauuagccgggcguggcagcaugcaccuguaaucccagcuacucaggaggcugaggcaggagaauugcuugaacccaggaggcagagauugcagugagccaagaucaggccacugcacuccagccugggugacagagugagacucuaucuuaaaaaaaaauuuuuuuuuuguggaggugaggucucauuguguuucccagauuggucuugaacuccuguccucaagcuauccuuuuuccucagccucccaaagugcugggauuacuggcaugaaccaccacacccagcuagaccugauuuuauacugagcaaacuauuuugaccacagugagacuaaagaauuuacauuuugccauucugcuuguuacacaaugauuaauuuuggcuuuaacgcauaucagcuuauucaucugaaaaugugccaggaguauucucauauacauuuguuugcuuuugagguuccugagaggaagcuuuaguuaguagauugguuuaauagcaggcaguuaacauuuuuauuuuccuuaguggcauacucaccuaugguaauuuuagggguggugaccuccacauucuacuucacuuaaacaucaaauuauuuaagguggguaaagaaaaaaauacccaaacccuugaguagguacuauuauuuuucccauuuuacagacaaaauagcacccauauagguuaaguugcuugccuaguguuagcuguuaacuguuggugucacugggucuggugccucaugcuuauaaucccagcacuucggaaggcugagacaagagguuuguuugagccuaagaguucaagaccagccugggcaacaugaggagaccccaugucuacaaaaaauuccaaaaauuagucgguugugguggugcacaccuguggucccagcuacucgggaggcugagcugagaggaucgcuugagccugggacguugagguugcagugagcugugauugcaucacuguacuccagucugggugacagagcaagacccugucuaaaaaaaaaauaguauugaugcacacauaggaccucaggcagacugauuugagagcaccuccaccugugcucuauaagucuggaaaaugauuccuuccuccaguguuuguuucaucuguuuuuguuuguuuguuugagacguaaucucgcugugucacccagccuggagugcaguggugccaucuuggcucacugcaaccucugccuccuggguuuagcaauucuccuaccucagccuccugaguagcugggauuacaggcgugcaccaugcaccugccuggcuaauuuuuuugguauuuuuaguagagacaggguuugaccauguuggccaggcuagucuugaacucuugaccccaggugaucugcucaccuuggccucccaaagugcuaggauuacaggcaugagccacggcaccuggccuguuucaucuuuuaaccgcacuugcuccucuggcuccuuuccuuguauuccugaaauaacugaauuucuucuuuuccuuccuaccucucccagcuauuacucuaccaugcucuuuuugaucaucuccaaauuguugaaaaaguuguuuaugccuguggccucuucguucucuuuugaacucugagcccuauuugaaaucugcccagacaacucuacuuuuguaaaggagaaugccuucagccagaagcuucucucucuugcgaguuucucugacauuuuauuucccucucuuacccuacucaucccauucugcauuucagaguuggauuuugaguuuuggguauauucuuuuuuucucccucauuaaacuaguugaggucauucauuauuuguuauugaagcccucacugucuuuagucacugugcauggaauuacugaaugaaucaaugaauaaauacugcuguuuccauaaugauugcugauuuuggaagcaguguggugagaauuuucagcuuuccaacucauccagauuaaguucuuuucacacuagcuucgugacuuugauuggagugcucugaauugcccaagcaucagaugcuuccauauucauggguagaugugaaaccaucugaagccacagggaaugaauuuuaguuuauucauuccuuccauucuacuucauuuagucuggaaaaagcauggauuuacaaaaagauuuuuaaacccccaaggauuacuugauauacauauauauuuuuuucauuuuaaaaaugaaauuuuucuuuauguuugagaauuuccauuuuaaaauguugggaaaaauguuaagccauuaagccagcaaaacuauucugcauuuauuauuguucaguuaaaguuuuuuuuuuuuuuuuuuccuccugcucuccccccuuuuauaaaaacucugcacuuugguccuguguuugugacaguauuauguggcagacugucugaccugccuuugaaauguauaauuuucugcugaagaaugcauacuguuugccucagacucagguuucagagacugaaaacccuguauuaccaauacacuugauaauggauucacauuuucuuuauaaaaagaaauccccuuaaguuuugaggcuuaagguaagaugaugaguuggcagaaacuuguggagaggacagagcuaacugacuuggggucgcucagugcugaaagacauuguguggccaggaaagcugagcugugaugacaagacucauauuggguccaaugggauuuuccugugaaugauuuugaaagucuaaguaucaucuauccucucccuacucacccaauguuugacacaaauuuuugauugaugauaauauuaguaacucuauuaggaauaauuucucugacuuucauaccauuuaauaugaacucucuuuagguuucugaauuccucuaagagcucaaagccaaaaaaaaaaugccccuuucuuugucuuuauguuggucaaauuguacuuugacuguuggaauaaaacccaacauucauacucugaaauuaaagcucuugcugcauuucugcacugaagauguuuuuuaaaccaggugaauaguuugacagcauuuuuccugucuuuguuuuuagguugaugccuucccucccaaugguuauggcuuauacaacauaguggggaacgcaugggaauggacuucagacugguggacuguucaucauucuguugaagaaacgcuuaacccagugaguauuauucacagagcaugugucuuggaaugguggcaucuguccucugggcagucugcagccaggcugucauguguuuccgagggguauuuacauacucuggaaauuaaucuugggauuucccuaaaggcacauuaagcgcauguuucuuauuucaaccucagagcauuuuguaaaaaugucugugagcauguuaucuuuuccuggauugugauggugauaacuauuugaggaaaucugccuauaacuuuagaaauuguauucagucucguaaauuugaucaaagcaugcaugauauauaaauaacuauaaaguuuauuacuguuuuauuaugaacuauuaagaucugcuaggugguauuuaucaugccucuaguugccugaguucugauggguugaaauuuugauucagcagcauuguuuggagagaaagagaaaggguguuuucugguuaaauguugaagcaggaaguugugucauuuagugauuaauuccugaaccucuuaguaugucagaccgaugcaccuuauaacuuaggaacagaaggcaaccauguuuguccaaguuuuacuuauucuggcaugugaaaaauguugaaugcaaauaguauacuacccugccucuaaaaccaagcuaccccagcagaauguauacaaauugagacacuacauggacauguguguggaaagugcuuccuuuaaaaagaacaucucugaauauuuuuuauggugugaacagauugggggggagaauaucaugcaaaaucccaucucuagcaaaguagucauucauaagucaguuccaagaauguauauuuauaaccaaacuagcuagacugguuacuugaugugcuuaauuuuaaaccugaacuuuuugaaaaggcucaaaggguaaugauaaagaaaauuaauucuucaauaucuucucaauauaggauuacagagcaauugaagaaauagacucugccugaggcucauuuuucagaauacgggaauaaaguuguuggauaugcuuaauuuuucuucacagaauaacacaugggcugcucaugaauaaucuagagaaaacagaucuacuuuuugagggcugcagauaaaaaagcugaguucuuuagaagccgucaucccuccucaguuucuuuuacuuuccagcggggcugguggaaguaguggucaaaaugagaauaagguuguaaaauucuagguggguuugugguugggagaugucauucucuaccggcaagaugugacuuggcauuugcugucagaaucagaaauagaauuuuuuucaucucagauaaaagcaucugcaugcuuggaagggggugcacaaggccuuagaaugcuggcaaguugugaauguaucuaucugaccaucugguguggagcugagcgcuuguuagcuuucaguuuuagagcuacuuguguuucuucuaaggauuuacagaaaaauucacauuuuucuuuucaccaaucccaggcuuuauccuggauguugcccuugcucuaaugaaauuguucucauuuuagguuucucuuugucccaguggccuccuuugcuuccucauuugacugggauauaauuuaacaguuuugagaacuaaaccccaaauccuuagacaauucauacuccauaauucaggucuuuauagcuuuucuucauugccagcagaaaagccaugaucaucccucaucuggguuacugcagcagccucccagagggcucccugccuucccucucuuugccacauugugacuagacugaucuauauagagagcaagucacaugaggucacuccccuguuuaaaauccuuuaaugccuucuuauuauccaaagaauaaaguguaaaauauuuuuuaaaaacuuaauuacuuuuaucuuuuuuuuuaauuuuuauuuuuugagagagucucgcucuaucccucaggcuggagugcaguggcgugaucucagcucacugcagccucugccucccguguucaaucgauucucaugccucagccucccaaguagcugggauuacaggugccccccagcuaauuuuuguauuuuuaguagaaacgggguuucgccauuuuggccagacuggucucaaacaccugaccucaggugaucuacccgccuuguccccccaaaguucugggauuacaggugugagccaccacgccaggucuuguuacuuuuauuuuuaauuuuuguggagauggggucuugcucuguuacacaggcuggucucgaacuccucgccucaagcaauccucacaccuuggccuccuaaagugcugggaguacagaugugggacacugcaccuggcugauuaaguauaaauucuugcacaugacuucugaaggcuaacauaauuuaacccuugcugaucccucuagccacaucuuuuuuuucuuuuuuaaacaguuaauuaugaaguguuacaaaaauucagaauaguacagaaaauaguguaauagauaacuguguaccuacuacauaauguuaacaguuuacuguguuuacuuucucuuuuagccaaagaaaaagaacaaaaacuguucuucucaucaaugcuugauaucgucaauauguuuuauuuaaggugcucuggucagugugcagggcuguuucacuguguuuuucagucaucauuuuuaaacguuugucugauaacucuaauaucuggccaccauguugaucuguuucuguuguucuuggcuuucagucaugucuuguuuucucacaugccugguuaguuuuggcugacuagcagacauuuuaugugaaaaauuguggagguugagaucuagauagugugaugugucucuggaaaggauuuaccuuugcuucuagaaacuucuauuucagauuagcuuuaaucuagucaggaauugagaugauuugaagcagagcuucagucccuguaauggccagucuauuuccaguucccccuggguauaguucuucagggugccaaccaaaagucuagggguuuuaccauagauccuccaccuuggagggccuuaaacuccaauuuuuuauauccucaggccaugagucuauugaaaguucugcucagcuucucagccuuacaucugccauuugaggcaauagaucucuaaggaaaacaguuucaccucucuaggauuugagcccugcaauucuucacagcugugguaguucucaucuggucugguuaaguccuauuucucuuugagaucuuaauuuauuugcuuuucuucccuaauggacuguguaucucuagugcuuagcaaagaaccuguauauaauuauugacccuacaauaauaccaauuccagauauauggaauugggggaguuuggugacuguccagacuccauguguuccauaagcagaggcugguuagaagagacauuuucagggaacguuuacaaccaaaauauccacgugguuaguaaauauuucaauucaggaacugaccucuucuguguuauguauuuauguuaguucugugacuaacucauaauggcaaauaauuuuaaagcuucuucagagagcuugggaauagucagugcccuguaugcaaaggcuauucaggaaauauauuuuucuuuuucagugauuuccagggagcaaaaguuaaucauuaguuuuuauuuuauugggcagucauuuauggcaaaagcagguuguggaaacagccaugugugcuuuguacacaucugagagaagaugagguauuuggccaugggaaaaaaaggucagcuugguguuaacgugugugugugugugugugugugugugucccauguguguguccuguggaggugccacauuuagauggccucauuccccuccucacagauacaaccuaguaaauggccagugcugugauguaucuuaacccaaucauaaugugguuuuugaaaauguaguuugugguuauuugcuuuucaguugccuaagucugagacggauauuaaucuguggugcuauguagugcuuucaguuaaagaaauauguagagguuauauaacauucuaauuucccacaucugcauacucacuuucaguaccaagguaccaugcugacuuguucaguugaugaugugacaggauggggugaucugugauaucuuucccucucugugagggacacaauugcauuuagguggcuucuuuuucucagagaaagaacucuccuuuuguuuuuguuuuauuuuguuuuauuugagauggaggcuugcucugucacccaggauggagugcaguggcacagucuuggcucacugcaaccuccgccucccagguacaggcaauucuucagccucagccucccgaauagcugggauuacaggugcccgugcuaccacacccagcuaauuuuuuuguauuuuuaguagagacggggcuuuaccauguuggcuaggcuggucuugaacuccugaccucuggugauccaccugccuccgccucccgaagugcugggauuacaggugugagccaucacacuuggcugucaggaaaagaacucuaauuuuggaauaaaccaaaguaacuuggauuacagcucugccacuuaauauuaaaggacuacugcuaaauguagaauauaucuucaguuuccuugucuacaaauuagaaauaauuauacuggaugaaauugugugacauuuaauuugucauuguaugugcaaacuuuauaucacuuucagaggaauguuguuauuuuacuguuuuuguuuauauuauguuuuggcuaucuaauuauaauauugcuuacuuccaucagccgaguuaaugagaaacgcuggccuuuagaagcauggggcgggcgguguggggcgaggcagggaaaaaagaaaaaaagaagcagagggaaagaaaacaauauuuauaaauagugauugcugauauuccucuuacccuuaccuuuuguuggcuuaucacauacucauucucuccaugaaaacuuugcuuaugcuuccuggaucaucaaagcccagucagaucaaaguuuccaaaauguauuccuccucugaaugaaucucugcuacuuaccacauuuuagccagagauucaguuuguuuugcuucuguuaauguggaauuugauugucuaauagauuguauagcucuagacacauuuuggaaaguguccucuguuucucaggguuguuugauguauggaauugaccucggauaugcugggugcaguggcucaugccuguaaucccagcacucugggaggcugaggugggaggaucgcuugagcucaggaguuugagaccagccugggcaacauggcaaaaucucaucuuuacaaaaaacacaaaaaguuagcugggcaugguggcacaugccuguagucccagcuacccggcagauugaggugggagaauggcuugagccugggaggcagagguugcagugagcugagaucacaccacugcccucuagccuuggugacagagccagacccagucucaaaaaauaaaacaaacaaaauacacacaaaaaauagaauugaccugggauaagcccuccuugucugucuccuguggugugcagaggccaccccucugagcucuugccuauccacacauagcacauuaaguacauuuggggcacauaccaguucucuggccagagauuagcauguauacucaugcuugcagaugccacacuuguugaccccacucagauacuucuuugccauugcaugauaggacuuagggcauggacucacaguaguuuuuuagauccucuaaacuccacacuugauuguuccccuucccugugauccucuggccucccaccacugugucucagugugcaacagaaacaugagacuguuacuuagcuugccuccugauccuccucugcccaggcgaugagacugccauuuucucagucuggcaaaaaccgguaaauaucauaucaucuuucuccuuaguuaagacuuucauacccauugauggucccaucaacagccucaucauuucaagcaagcauucauugaguaccuaguaugugcugggggcugggggaggaaguugauugagaauuuuucgcugcuauaagaccuucacucauguguuuuuuguuuuguuuuguuuugaguuuuugagacggaguuucguucuuguugcccagacuggagugcaauggcacuaucucagcucacugcaaccuccaccuccuggguucaagcgauucuccugccucagccucgcaaguagcugggauuacgggcaugugccaugugucaccacgccuggcuaauuuuguauuuucagucgagacgggguuucgccauguuggucagguuggucucgaacuccugacaucaggugauucacccgccucagccuuccaaaguacuaggauuacaggcaugagccacugcaccuggcccacucacauguuuuuaaucaggacauucugaggacaugaauaaaucaguuugauagagaacuaaccuaauguucaaaaugaaaaaaagcacgaaagugauaaugaaguucaccugauaauaaauuuaauacagcuacaaguuauacagaguaagugccaaggggaaagcaaggugaucaaaauaucagccuuuugggacuaugcuugggaaaauaauuuuaucuccuucucccuaguggaagaugaaugucuucuggaggaaguacuaauguuuacucauuguaauuuuucacuguggaucaguugcaagguucuucauccaguaaaauagaacuauugagaaauagaaauaaacucaaauguaugguucagauauuuagauccugcagacacauuucaaacacguuauccagacauaugcuucuugcuugaaaagagcgaauucuaauuccaguuaccauuuggacaauguuagaaauaccguuuguuuccacuucaggacaaaaugacccucagagccucauguuacaacuacugauucuuccugagcaaagagagcagaacaccaaaauguaccauggccuccuuaguuuggagggucaguggaucugaaaggugggaaauggaaaccuccucuaaccucucccccugugggaauuccuucuuugauaccccugacagcugugguccugcagccucuugcuaaaagcuucuuggugaacaguaacucuccaacacuuggggcaacuuacugcauugucagauguucucacugaaguuuccucuguccaacucaaauccuccuugaagugucaacucaguggcccucauucugcuguugcugagaauaagaauguaucuuccuucugccuuguacagacaagcucuucagauaccuaagaacaguugucgcgucuccccugccccacccaucuuucuguuucuagauaagcauucccauucuucugcugcaccugggauaacuggguuugcaauucagggcaacccaguuacauuccucugaauaacaugaauugggggaaaauguccuuuuuuauaaauggacacccagaauuauacacagcauucuagauguugucugauagaugcaaauaauaguggagcuauccuuuuuuuauucguucuuucucaucaggucucagauuacauccgcaguuaagaguuugguuaguggaugccaaucaggcuggguuugaaucuugucacuguaacuguggcuucccagaugugugacccugugcaagucacuuaacugcucagagacucaguuuacuuucuucuuaaauggggaugaagauuucuacuucauagaguuguaaggaagugagagaguguaguaugggacuuagcaccauguuuggcagauagcaugggauacaugguagcuuccauccuaauugcugucagugcuauccuacugguacuacaggcacgccuacuguuacugugaguagcagcugcaguaguaaugaagaacaguaucucacugaugguucccguuaagcuuguagccaaauaaaacuugcauuuuucucccguguugaucucaggcuaggucuccccaaauguuguuacacagcgauuuuuuuuauguagcuauuuuuuacaugcaguuauuuuuuacaaaaugauuuuaaaaauuuggaaucuuuucuguuuuguaugugcauuuugaaacuucaugcaaugccuaucucaacucuccaugagauuuuauuuuguuuauggguuucaaccuugagagacagcuuauagaaaucauucuggcuaucagugcugucuuugaugguggucgcuuucccuuccaauuuauuaucaccaacagauuugguuguuuuaaagucauugauauaguaugaaugggacagggcccaaggcaaagcccuguagcacuggagucagccuacauuuccugaguauccacuguaguaucgggcuauaucuacucuugggauacagguaugugaaacaccagucuugcuguuaagaagcuccuaguuuguugaggaaagauugagugccaaucagaugaaucaagaugcacuaugcuaagauuuguuauggauaugauugagguagagccuuggugaccucuguucucuaccaguuggagcugugaaggcuucuuggaggagguaccuuuagaaaggauggcagcaauuggugagguaacuaugauagguccaugggauccaaagaugaagaagacaggguccagccuuuugaggaauucaggguaaguggugaaaggauuuucuucuuucuuuccccacuucuuuuaguuucuuaaguaaaugccuaaucggugcccugagccauagcugcccuccacuugcccuuagcccugaagugugaugacuuuuccauacccaaaguaaaugcagugaggggagcaugugugugugcgcacuucuuucuucuuguuuuucugcaacauauuuuccuacuucuuauggagcaguagagcuguuucaagaauuuccuuaagcuuaccagcuaggggcuuuggagagugacuuguaaacugucuuccuuacuucagugugcucaagaaaggggcuuuuauugguuaccuuuucacaguguaucacgcuccugggaagggagagccauaugcuauaagauugggauggcagcaguucagcaggauggguugggcuuaucacagaaccauuaaaagaaaagagcagagaguuugcuagugugguuauuugucauucucaguaaaguucuuucugcugugcugaauaacagagccaugguuaagugaugaaagugaggucagucgccuggguuuccaucugagauuuagcuuuaaaaugucguggggcccuaggugagucaugucacccuuguaggcuuagugcuucaucuguaaguugugcugaggauguagcaagccauucccacggguacaguaaauccggggaacugcccuugggucugcugcuugcuuggaaaguaggcagugauggaggcugcagcugacaguaacaugguuaagaggguguuuuuaaaaugauuuccaccgaguguaaacuaguucaaccauuguggaagacaguguggcaauuccucaaggaucuagaacuagaaauaccauuugacccagcgaucccauuacuggguauauacccaaaggcuuauaaaucaugcuacuauaaagacauaugcacacguauguuuauuguggcacuauucacaagagcaaagacuuggaaccaacccaaauguccaucagugauaaacuagauuaagaaaauguggcacauauacaccauggaauacugugcagccaugaaaaaugaugaguucauguccuuuguagggacauggaugaagcuggaaaccaucauucuuagcaaacuaucacaaggacagaaaaccagacaccucauguucucacucaugggugggaguugaacaaugagaacacuuggacaccgggugaggaacaucacacaccagggccuguugugggguggggggaggggggagggauagcauuaggagaaauaccuaauguaaaugacaaguuaauggaugcagcacaccaacauggcacauguauacauauguaacaaaacugcacguugugcacauguacccuagaacuuaaaguauaauaaaaauaaaauaaaaugauuuccaucuagguccacaucccagcucugcuaucuuggggccagggggugaaauccuuugcuucuguuuccuugucuauaaaauggaguaauaguaagauucaacaauauugaacuguucugaggauuaaaaagagagguuaacucacugugcccaccacacagcaagcacuugguaaaugagagcagauuacgguuucuaagcgccucuugguuggaacaucucccuuuggaaaauccuuuccccuucagcauugccucuuguuguuuaguagaccagauuauguuauuuuucuuucauuuguuuaauagcauuuuugagcaccugcugugugauaguggcaaacauaaacaucacgcaguccuugccuccagagaauuugaaucucagaauuccuaauggugguuucuuaucauuuccaugguaauaggcacuuuugcuccacugaugcuuaggaagccagaaccaaagcccggguuuuuuggauuucuuucaaucaaaagauuguuuauuccuuuccuauacuuuucuucaccuggaaaggccauggggaaauuucagggugagggcuugaaagccugucuuucuuggcucccuuaguugcauccacagcuggcaggccaugucugagcagcuuuucugggcagaggagggguacucugggaauucagguagaauucggcccccaguuugggucgguugcuugaggaauuuuaucucuugucuuggugugguuugagguaugaaucgagaacagaaauuuaggcucucggcugggugcaguggcucacgccuguaaucccagcaucuugggaaggugaagugggcggaucacguagccuggcuaacauggugaaacuccaucccuacuaaaacauacaaaaauuagcugggugugguggcacgggccuguagucccagcuacuugggaggcuaaggcacaagaaucacuugaaccuaggaggcagagguuacagugagccgagaucgcgcuacugcacuucaggcuagauggcagagcgagacucugucucaaaaaaagaaaaacaagaaaagaaaagaaaggaaauuuacgcacuguuuugagggccagacucugccagaguuggcauccugucuuccacuuccgugggccuuccuuuccaucuuuuucaugaccugggcucucccuggacagauuguuuuuucuuggcagugaauuacaguuaacccuaaauguucccgcacugucucagccugugauugcugcuuaauauuuucagauagggcucugucucaucacucuuggcuguaagcaaagauuaauaaacauauauauuccaacucaauaauucucuucuuuacauuuucucacauagaguaguccauguucauaaagaguuuucccacaguacuccugagucaucacaaaugguuugggggggaagaguggucuccgucaacuuaaagauggcccccaagcccuuccccacuguagcuuuauagauuuuuagggugaaauguguuucggguuaaaagaagauauaugccucagacccugcaucccuguauaauauaguccugacuuuacuccagacugcugugcuucuggggugaacaaaacgaggagugaggaguaaagucaaugucuuaaagcuuugcauuuguaugggacuuuucuccccugaagagcucgaaguguucacgcaugcguuuuccccaucccuccgcccccucucguucucauauccucaaaauauuccugauuaugcaaaaaagaagauguggucuuggacucauuuuuuaugguguggagcucuagagguuuugacuuuggcccggauuuugaacuugauuugcagucaagauuaaaucccagaucuucugauccccagacuuguuaauguuuacuggauuccagauguuauuucaaauacaaaacaugaaaagcuacuuauuuccuuguaguaguauuuugucacaagccacauauguuaaaucaggcaucucaagacuuguuauaaauauaaagauaauuuaagagaugggaaucgcuaugucauacaguggcuucuuccaaaagcaagugggaggcagugaauuuuuccuaugguuuuugaucucuugagauuuuaaaucaguuucuuguccuucuuaccuuccuaaccucuuauuuccauuaaauuauuuuuaaaaauuauugauuuggcaagcuaguuuuuguaucugacgucugacuuguuaaugagcuguaaaguaauauagugccauuucccauuccuauagcuuacuuuuagugacuuccccaugucauaguaugacucauuuguucuuucucuaaggaucuggaaauaaaaccagguuauuaagaagagaaaauauauaguuaaguuaucuuuuuuuguuaccaaauuaugcugugauuuuuuucauguggauguguggaugccuuuuuaauauaggaauaugcauauccacacguagaaguuuuauguaaggguauacuucuguccauucagcaaaauuuacuggcaagcuacugaaugccagauuuguaugcuggguucugggaaucuaacagacacaauccucuuuucuuaaggagcuugcagauguuaaaagagcaagcaaacccaccucgguggguuuacauacauauacauuuauugcuauaaaaguauaaaauuaaggaggaaguauagcaugaugguuaaaagcaugcaguuuuggagugggaccuggauuuaagucauagcucagccaccuacuagcugaauaaccuggagcaaguuaguuaaccuuucacccagcuuccucaucuguaagugaggaaauaguaauacccuuuaugggauuauuggagguuucaaggagaugcuacagagaaaaugucuaggguagaggcugucauguaguaaacauuugauauauguuaauuaugaguauuauguuuuacguguaaugaaaauucaaaugaaauaagcuagcaagcuaugaaauuauaccuuacucugaaaucuaauccauggaagacauuuuuuuggaccuuuuuagggauguggaaaggagauaggccaucugguagcaugcaauuauaaauaacacuucuuuccauggacagucuccacuuuauacucaguaaaggaaguaaacauggcaucuaaucaagcagcagaacauacagaauugggcacuuagcacuuauccacuuucaaaacguccaaauaaaaucauggaagucuucaagugguucucugaaaauaaugguuaagugaaaaugccauuugguauaagcuaauugcuuuauucucucauaacuugcuaaugaauugucacugaagaacacagaagauugugagaauaaaagaaugugauagaucccuagugagacuaaaccgugucuacuuuucucacuucaaguaauacuuagaaccauaugcggcccugcacucaggacugacaguuuuauacaguuauucuaagcaauauaagugauugauucuggagcaaaucuuucagugaauguagucuguacccuguguugguggugguuugguuuuaguugaccuagaaguugccuuugcauuuaggaugaugcugcuguauaacaugcauugcuuaggauaaaacaaacggauuucucuauaauuuagaucuaauccaucugaaauuggauagagcaggcauguuccuuuguguugcauauuaguguguuacacuuucugaaguuaaagaaccaccugcauuauuaggaggcuaauuccaucuagcagucuacugcauuccaucuggcagucuaccacuaccaguagaugaugagaaaguuucuucuuuguugcagaaaucuaaugugauauguguuuucucuuaauaguugcuucuucuguguuuagguugacugguuuucagcacauagaugcuuuauagccuuguguuucacagcuauaauaauucaugcuucuuaaacagagcauauguaucuacuguuauauaggucagagaauuaaucauucuccuggggccucacucuuuuuucuacucucucuccuuccugucucucaguggggagagaggcuguaaaacuugaggcccucgaaugaggcaccucaaagaagauuguaguugcuuaucucacaccucagcaagaaaccaugggaaguuccuugaaggaagugaaacaauuugggauggagaagcuccaagauaaaaggauuuggacauguguccaccagcucacaucaaaugguugguggggaaggacccuauaaggucucuagaggagcacaagugagggaacucaggccagaagggaaaggauagagcccagacuagauacugguucucccaacuaccuggccugugcgguaggucccguggugaugccuccugccugggcucauccuguggagucucugcagguuauuuugcagacacuuucuauuugcaaucucuuguaagacuuuuuauugugugcuuuuauggccuuguggaacucgugaacuauagagagguuugugugucugaaacuagaauagucgaaugauuuauucgaaaaauguuacagucuaugaguuaguucagaaggggcacauggcagaauggccgacuaugaugcugaagccagacauccuggccuucagcccagcuccucugcuuucuagcugcgugaccuugggcacacuauucaacuuuucuguuccuuaguucuuuagcuguaaaauaaggccaaugaguggguguccaaacauuccugguuuauaucugugccuagcacaaguguuaauaguuccaccuuucaaucucuaaaguauccuuauuuggauggucaauuauaugucugccauaccaauaagagaaucuguaucaaaaauuuguuuggaagacuaaaaauauagaaaacaauauccaacuguaaugugcuugguaaauauuagcugcuauuguuuauuuaugugcuauuuauuuuacaaguagacugguauuuuaaauaccugauuucauguauuacuccaggagcaagaacgguuaccauagacuuuggggucugaaagugacuuauauuauuggaaaaucaggagccaccgugguauaagcaaguguaauacaauuucaaaaauucucuucguuucuaaucuggugugggugaaacaaguagcauggaggaaaugacuguuuucauucauuucacuaaaaugguaaucaccacaauggcaugcugguuuuacagagaaaauacaguggagguuguuaauuugauucguguguuuuacugcgcucuucuuuccaauuugaucucuaguuuucuuucuuugaccuuucuuugggcgucaccuuuuccucucaugcaggagaggcuaaugcuaauugcagucccuucuucauugguccuuguccccagagauaaauaaaauuaaacauaauucaaaaagcuuuauuugaaguaaugguuucaucugcucacucuuaaaauauuuuuucacguuggacauuagguaaaaaaaaauacaaauuauugguauuuugacuguauuuuucacaaauauguacuuuggguagagaugcugcugaaccuagaagauacucuaucugguuaggcacgggggugagauaagccugcaggugccacagugugauggacuuugacuccugguucucucgcuugcuaccugugugaucuuggggaugccauuuauuucaucucucugagcuucaguauuuucauccuuaaaaugaaaagaaugauacuuccugcuuuacagggugauuaugaggaugaaauacgaugauaaggauuaguauacucucaacaaauggaugguaugguaauuaacagagacgucagucauuuuaaauucuagaauauuugaaaacaaagaguuccuuucucgaaagaugguugaggugauugaaagaggcuucuuuuaggaggaagaugugcagaggcugugucucugaugauaaaaauacuuugaugauguggauuucauacaggagaagcuagugcucuucaucacagagcuaaauacagaccugcccaggacccagagaaacuaaaggaggauauagggucagugagaaacagcugcagccuugccuggaucccuuguaucagucuucugagaauaaaaacacuauggcuauugcuacucuucugucuucuagguugcuuaguaaaugucuucuguagcacauccuaacgagaaacauaaagggaagagaauucugggaaaugagguucagucuagccaaggugacacauuacaaagcugggacauuaacaguuauccaaucuaguuuaaucuaacaccuuugaauuacuuuaaaaccaaccccaaauacuauguacuuuuuucccuagaaaacuucaguauguggcugggugcuguggcucaugccuauaaucccaacacuuugggagagcgagaugggcagaucacuugagcccaggacuuugagaccagccugggcaacauagugaaacaccgucuuuacccaaaaauuuaaaauggugcaugugucuguggucccagcuacucaggaagcugaggugguaggauugcuugaguccaggaaauugaggcugcagugagucaugaucacgccacugcacucuacccuggguaacagaguaagacccugucucaaaacacacaaaaaaagcacuucaguaugugacuguaaaagcuaaacacucuuuuaaaaaaauaauaauaaaaacaaaacuauaaugguauuaucaaaucucaaaaaaaaccuaaaaauaauuccuuaauauuaucaaauacucagucagcauuuacauguccuuaauuaucucaugaacauuuuucuguaauuggcuuguugagaaucaggauccuaagaaauuccauucuuguugugauccuaauuacauuugguugaguucuuauuuugguaauugcaauguaagaggucaagugauucacuaauacagaaaacaaguacaaaacugaacaaaauuguaaagaaaaaacacacacccaaccacuggaaacugaaaauccaccaaagggaggugauaaauugagaaguguugauucuugagaaacuucuauagcuuuggccaagaaugggugagaauauguggcguucuugcuuggaacugauuccauauccucuuucugccacacucuauuauuaaaaauaauaauaauaauaaauaaauaaauaaauaaaaggccagucaugguggcucacuucuguaauaccagugcuuugggagacugaggugggaugaucucuugaggccaggauuucaagaccagccuggucaauauagugagauguugucucuauaaaaaaauaaaauauuaggcgagugugguggcauaugccuguagucccagcuauucaggaggcugagaugggaggaucacuugaccccaggaggucgaggcuauggugagcuaugauugcaccacugcauuguggccugggugacacagggagacccugucucuaaaacuaaaauaaaaauguaacugucaguucaggacugguggcgaaaaccaaagccuuacagccaaagauugacuugauucaggguggaggaugggggcacugaaagccuguggcuuugucagcuaaaaaagcagacucacguuagaauauuuugggaaauccugcagcaugacuagcccacgguagcaguugugaugggugguagaccagccagaaauuuaacagggagaucgcgcaaguaacagagacauuaaaggugugaaauaagcuuuucuaggcuuucugggaaacuaaacauaagcagggaagacccaagagagcccagcaaaaagugaaagccagggagacuugagaugacugccacuuugaaugccauuucucaauccauacaccuugguucaugaaaggugaaagcccaguggguucaaaguaucugagauagccucugucuaaauuauuggucagcuguucaaguaugcaacacaaauaugaccucaauggaauugaaaaaaaaaaucugaacagagacaucaguggguacagaccauggggaaugagauucuacaguuuauauucagguaaguuaccaaaacaaaacaaaacaaaacagaacaaaaaccuucaggaaaauaggguaaucaagaguugcuguuacauauacaugugcucucucucucgcucucuuucucucuuuauauauauagguagauauauauauauauauauauauauacacacacacacacacacacacauauauaucugaacauauaaacauuuaagauuauuuaagauuauauauguaaucuuaaauuaugcauauuauguauaaucuuaaaugucuaguuuucagcuaaaauguaauaaacaugcagacuaacaagaaagugugacccauacuaaagaagaugaguauuuaaguuaaaacuaacucccaaguaggcccagaugcuagauuuaacaaagacuuaaaaauagcuauuaugauuauauuuaaagaacuaaaguauauuugaauaguugcuauaaaauacgccaacugugagucaacaaauagagaaucaaauagaaauuuuaaaaaaagaaccaaguagaauuucuagaauugaaaaguauacuacuaacugaaaugaaaaauucccuaguugaacacaagagcagauaagaaaugguagaagaaagauucagugauccugaagguagaucaagagaaaguauccaggacaggugcaguggcucacaccuauaauccuagcacuuugggaggcugaggcgaguggaucgcuugagccugggaguuugagaccaacccugguaacauggagaaaccaugucucuacaagaaauaaaaaauuagccagguaugguggugcacaucuguaguccuaacuacuugggacgcugagguggcaggaucaccugaaccuagggagguugaggcuguggugaaccaagauugcaccaaugcacuccagccugugugacagagcaagacucuaucucaaaaaaaaaaaaaagaaaagaaaagaaaagaaaaaggaauuauccaaaccaaugagcagagagggcugggcaugguggcccaugccuguaaucccaauacuuuuggaggcuguggcagguagaucacuggagcccaggaguucgagaccagccugggcaacauggcaaaacccuauauccacaaaaauuacaaaaauuagucagguaucaugguaugcaccuguaaucccagcuacucaggaagcuuagguggaaagaucuccugggcccacgaagucaaggcugcagugagccagaucauggcaauacacuccagccugggugacagagugagacccugucucaaaauaaauacauaaaaauuuaaaaagcagaaaaaauuucagagaaaaaucaagacagcccugugcaacaacaucauguguuccaacauaauuuuaacacauguguaaagggaaucucaaauggagaggagcaaaagggacaaaaauuugaaagaaaaaucugaaaauuucccaaauuugaugaagauuaucuauaaauccaagaagcucagugaaccucaauuaggauaaacugcaaaaacaaaaacaaaaacaaaaacaaaaaaccacaccuggacaaaucauauugacacuguugaaagacaaaaucuugaaaauaacaagaggaaaacaguucaucacauacagggcaacaauaaugugauuaauagcugauuucugaucagaaacaguggagaccagaggaugauggugugacauaaucaaagaguagaaaggaaaacaaacaaaccugucaacuaagaauucuauauccaggagaacaauccuucaaaaaugaaggugaaggagguuugacuccugguucuagaaagauggagagauggaguagauguacauuuuucuauuccucuuacuaaauacaacuaaaacucuggacacugcacauaaaagaauuauaagcagaccauggaaaguuaaagcagaguggcugaagaccucagaguccuagaaaugacauuauggugagcccaggaguucaagaccagccuaggcaacaugacaaaaccuggucucuauaaaaaauacaaaaauuagccagguaucaugguaugugcuuguagucccagauacucaggaggcuuagguggaaagauccccugggcccaggaaguugaggcugcagugagccaagaucgugccacuguacuccagccugggugacagagugagacccugucucuuuuauuuccuuuuugcugcauauaucccugacuuggagcuagggaagcaagcaacccagaaaugcuaacagguguagacaaaggaagucucaacaaaagccuguucucucuagccaaaggagcaaguaggaaaugggcagucuaacaauacagaaagcuuuuagacaguaaccacucuacucuuucuaaacaccaaagaaaaaacuguccagcaaaggcugaguggggagucuaggcuuguacccucaugcagcuguauuuaggugccagagaaggccuagccaggucuuucuuauugucuauuaguaaagugguuaccccuaccuugcuguauacaaccagguggggagccaaaacuccuacccacaucuaguaguaaugaggggucccuucugaaucguuaauagaggcugagcaaggaaccugaacuucugauucugccuggcaguaacaggaucacaccuucucucuuccccugccagggugguaucagagaaagacagcuaaaacaggguguuaauaagauccagagucuuuuaacauaauaagaacauguccacguuuaaguugaaaagucacuugccaucccaagaaccaggaagauaucaaagugaauuuaaguagauagcagaugcccacacugagaugacagagauguuagacuuacccagcaaagauuuuaaagaaaccaugggagaaaaaagaaaucagugagcaacuaugaucgcacuugaaacaaaugaaaaaauugaaagcuucagcaaagaaauagaaaauauaagaagaaccaaaugcaaauuuuagaacugaaaauugaaaaaucaaacuaaaaagcucaguguaugggcucaacagcagaauggagggcacagaggggggaaaaaucagugaacugucaacuagaacaaaagaaauuacccagucugagcaguggaaagaaaacaguaaaugaagaaauguugagagccacaaggaucuacgugauuauaacaaaaguucucacauuuacguauugagaaucccagaggagaaaacaaagaagacagcaugagaagaguccuucacaaaauaauggcugaaagcaccuccaguuugguaagagacuuaaacccacagauucaaggagcuaagcaaaccccaaugaggguaauucugaagaaaucuacaagaagacaccguuauaauuaaacuucugaacacuaaagacaaaacuuuuaaaagcagccagaaaaaaugacaccuuaccuauagggaaaaaaaaaaaaaacaauuugaaugacaauggauuucccauuggugaccaugaaggccagaggaaauggcaugauguuuuuuaagugcugaaagaaaaguauuguuaacccagaauccuuauccagugaaguaucuuuuuggaauaaggagaaaucaagauauucucagauaaaggcagacugagagaauuuguugcuagccagccuauccuaaaaggauggcuaaaggaauguucuuaaacagaaagaaaaugauuaaagaaggaacuuuugaauaucggacuggaaggaagaacaugguaagcccaaauaugaguauauacaauaggcuuuccuuccucuguggaguuuucuaaauuuuauuugacaguugaaacaaauuauaacauugucugauaugguucuaaauguauuuaaaggaaauauuuaauaugauuauauuauacacaagagaagcuaaagggauuuaaagagaguuacgguuuugaugcuucacuggaacuguuaaaaugacaugaguagacugauacauuuaugacuauauguacacacacaaguagagugauauguuuaugaauaugcauacaccuuuuagcagccacuaaaaaagcuacacaaagagguaugcucaaaagcacaauaguuacauaaaaauggaauucuuuuuuaaaaguuuggguaacccacaggaagucagaaaaaggaaaacagagacaaaaaaauagagaacagacagaaaacaaaaaauaaaaugacagacuuaagucuuugacauaccaauaauuauauuaaaaguacauugcuuaaauauaucaguuaaaaagacagauuggcauaguagauuaaaaaaacaaccuaauuauaugcuguguacaagaaacuucaaauauuaugauauauaagcaaguugacaacaaaaugaugggaaaauauauauuauguaaacauuaaucaaaggaaagucagaguggcuauauucauaucauguaaagcagacuucaaagcaaagaaauuuaccagaguugaggaagaacguauauaaugauaaaaugguuaauccuucaagaggacauaguaauacuguguaugccccagagaauggagcugaaacaugugaagcaaaaaguaauaaaauugaaaggagaaguagacuaauccacaauuuuaguuggggaccuuaccacuccuuucucaauaauugauaguacaauuagacagaaguucagcaaggauauagaagaacucaacaauaccaucaaccaaaggaucugauagagauuucuagcacugucuacccuauaacugcagaauaccccuuuucaguuaugcauggaacauauaccaaguuagaccauauccugugccaucagaugaaccucaacaaauuuuuaaaaauugaagacauacagaauguguucuccaaccacaauagaaucaaacuagaaaucaguaacagaaauauaauaggaaaaucuccaaacacauggaaacuaugaaacacgcuucuaaauaauccuuaggucacaggggaagucccaaggugaaucaaacagugcacugaacugaaugaaaaugaaacauaucaaaauuugugggauagagugaaaacagugcuaagagggaaauuugcagaacugcaugugugcauuagaaaagagaaaaagucuaaaaucaauauguuucagcuugacccagaagaaaaaggagaaaacuaaacccaaagcaagcaaaaguaaggaaauaauaaaaacagaaaucaaugaaauagacaacagaaaaacagagaaaaaucaguuaaaugaagaacugggucuuugaaaagauuuauaaaauugacaaaccucuagcaagucugacaaagcaaaaagagaauacccagauuacuaauaugagaaaugaaacaagauaucagugcaaacucuguagacaucaaaaggauaaugagggaauacugugaacaucuguauacccauaaaugugacaacuuaggcgagaaacaacacuuccucaaaaaacuccaaauaccacaguuuacccaauaugaaauagauaauuugaauaguccuauaacuauuaaggaaguagaauuagaaauuuuaaaacuucucaaaaaacaaaucuccaggcccaaauggauucauugaagaauuuuacuagacauuuaaagaagaaucaacaccaauucuacacaauuuguuuuagaaaaugaaaagaagggaacacuuucuaaucauuuuacgaagcuaguauugccuugauccccaaaccaaaagcaguaaaaaaauagaagguuacuacaggugaacaucccucauaaauagagacacaaaaauccuuaacaaaauguuagcaaauagaauucaucaguguauuuuuuaaaacaugauaauugagguuuauuccaggagugcagucugguuaaauauuuaaaaaucagucaguguaaucuaccauaauaagaagcaaaagaagaaaaaaaaaaaccacaugauuauaucagugcagaagaagcauuuaacaaacuucaacacucauuuauaacaaaaauucucaggaaaauaggaauacaaagauuuucucaaacuuaguaaagagcaucuacaaagaaacuguauaccuaccauuauacuuaaugguaaaagaccaagugcuuucccacuaauauugggaaaaagguaacuaugucuguuuccagaacucuuauucaacauagugcugggauuucuagccaguagaauaagguaagaaauggaaauaagagguauacagaucagcaaggaagaaauaaaacagucccuauuugcagauauaugaguguuuguuuacauagagaaagucccaaggaaucuaccaaaaucuucuuaaaacuaauauuucaguuuauaaaguuuauaagacacaagaugaacauguuuauuuuuguaagacuaacaacaaacacauggacauugaaauuuaaaauacaauacauuuacagucaccaaaaccaaaugaaauguuuauguguaaaucuaauaaaauguguuuaguacaugugugcuaaaagcuaugcaacacuaaugaaagaaauaucugaauaaaugaagagacaaugcucaugaauuggaaaauucagccuaguagagauaucaguucuucccccaauuguuuaauguaauuccuaucaaaaucccagcaagauuuuuuguagauauugacaugauuauucugaaauauauauggaaaggcaaaggaacuagaauugcuaaaacaauuuugaaaaauaauaaugugagaggaaccaaucuacccaauuugaagacuuacuacuuagcuacaguaaucaagacuguuugauauugguggagggauaugcuuauagaucaguggaacaaaauagagaauccagaaauaggcccacacauauaugaugcccaacugauuuuugacaaaguugccaaagcaauuuaaugaaggaaagaaaggcuuuucaacauauggugcuggaacaauuggacauccgugggcagaaaaugaaccucuaccuuagucucacaccuuacauaaaaauugacuccaaaugaaucacagaguuaaaauuuaaacugcaaaacucuaaaaccuuuagaaaaaaacacaggagaaaaucugagaucuaggccuaggcaaagaguguagagacuugacaccaaaaagcaugaucacccacauauggaaaaauaaauaaacuggacuuuauaaaaacuagaacuucuuuucugugaaagagccuguuaagaggauauaaaggcaggcuacagagugggagaaaauauucgcaacccauauaucugacaaaagccacauauauuuacaauacauaaaaaacucaacacucagcaguaaaaaaccgaacaauccaauuagaacacgugcagaagacaugaagagacaccacagaagaagauacacagauggcauggaagcacaugaaaagaugcucaacgucauuagcacuggagaaauacaaauuaaaaccauaaggagauacaacuacacacguaucagaauggcuaaaauuaaaaaguagugacuggcuaggauacagagaaacuggaucauuuauccauugcuggugguugugugacagaguacagccauucuggaaaacaauuugacguuuucuuuaaaaccuaaacauucagcugggcacagcggcucacuccuguaauccuagcacuuugggaggcaaaggcaggcugaucucaugaggucaggaguucgagaccagccuggcuaacauggugaaacccugucugugcuaaaaauacagaaauuagcugggccugguggugcgugccuguaaucccagcuacucggguggcugaggcaggagaaucgcuugaaccugggagguggagguuggaaugacccaagcuuacuccacugcgcuccagccugggcgacagagcgagagacccucucaaaaaaaaaaagaaaaaagaaaaaagaaaaugaaguaaacauucgaccacuauauucccuccuuuggcauugauuccaaagggaugaaaacuuauguucauacaaaaaccuguacauagcaucuuuauucguaauagccaaaaaaacuagaaacagccgaaauguccuucagugggugaauauuuaaacaaaccgauacauccacaccauggaauacuacucaauaguaauaagggauagauuguugguaugcagagcaaccuggaugaaucuccggagaauuaugcugaguggaaaaaaagccaguuccaaaaguuuacauacuguaugauuccacuuauauuaauauaacauucuugaaaugacaaaauuauaggagugggaagggguuaguguuuuccagggguuaagaagggguugggguugggaaggaaguggucguaacuauaaaagggcaacguaagggauccuugugauggaaauguucugugucuugacugugucagugucaacauccugguugagauacaguacagaguuuuggaagauguugccauuggggaaaacuggauauagaguacaccaauuccucuguuaccuuuuacagcuucaugugaaucaacgguuacccauaauaaagguuuaauauuuuaaaaugaaggagaaauaaagucauuguagauuaacaaagacagugaaucugcuagcagaucugccauacuaagaaauacuaagcaguuuuucuagacugaaagggacuggaacuagcugauaccucagauagauacacaggcagaacugacaagcaggaaauaugguaaauagguaaguagaaaagacugcauuuauuuuuucacuucauuccuuuuaaaaacguaagauuguuuaaagcaauaauggucacacuguguuguuaaguuuuucacauauauaacuguaauauguaugacaguaauacuaugcauuuuguuuguugauaugucuuugucaagacuaugaagagucugaaauuuuauucuguuugcaagcucaugaguuaggccacuacagugucauggaugcuggcagaagacaugaaguuucugugucagaguuacagauuuuucuagucacagcacagcaggcaacaugcacuucauguucacaucgcuuccccuugucucccaaaucccauaaggaugacacaguaggucuuugucacagccggagaauccugagcuuaggagacuccagucuuauaaagagguuuauaauaaacauacccaaccuuugacauuauuguucuggccaggaaacaaaccugccuucugucaucuucugagacuguugguuacacaaacauccuucaaaagauaauccaggacaaaaacugccacaaggcauauagaauugccccgugccaccaccacgaccagaggauauuuuaagccucucaauuuauaacuucucucuuuuuccucccuugcuauuuauuuguugaaaagaugucugaucucuuuuuauuuuuauuuauuuauuuauuuuugaguuggaaucuugcucugucgcccaggcuggagugcaguggcacaaucuuggcucacugcagccuccgccucccggguucaagcaauucuccugccucagcaucccuaaaagcuggaauuauagguguguaccaccacgacuggcuaauuuuuguauuuuuaauagagacaagguuucaccauguuggccaggauggucuugagcuccugaccuccagugauccgucugccuuggccucccaaagugcugggauuauaggcaugagccacugcgcccggcccugaucucuuuuuuuuuuucuuuuuauuauacuuuuuaaguucugggguacacgugcagaaugugcagguuuguuacuuagguauacacgugccaugguggugugcugcacccaucaacccgucaccuacauuagguauuucuccuaaugcuaucccuccccuagucucugacccccugacaggccccagugugugauguuccccucccuguguccauguguucucauuguucaacucccuccugugagugagaacaugcgguguuugguuuucuguucuauuguuaguuuguugagaaugaugguuuccagcuucauccaugucccugcaaaggacaugagcucauccuuuuuuauggcuacguaguaucccaugguguauaugugccacauuuucuuuauccaguccaucauuggugggcguuuggguugguuccaagucuuugcuaucaugagcagugccacaauaaacauaugugugcaugugucuuuauagcagaaugauuuauaauccuuuggguacauacccaauaaugggauugcugggucaaaugguauuucugguucuagaucauugaggaaucaccacaaaugaucuauuuuuaaaagaauuucccauggccuggguuuuguucauugcaucuucguggaaucauuuuaguauauucuucuaccccuuguauuuccuacaaucuuuguuuagauuuaaagucuugauuauauuuaggcuuuagguaggaugugugugugugugugugugcauguauguguguguguauguauaagaguaauuaaaaauacuucauagggcuguguauauucuuuauaucauaucaggaggcauaguaugcauggcuuuuaucgugacaccgauaagauuauuuuuguuaauaagauugaucaguauuuaaguaggcauugucagucugaaccauccguuacgaggaucuucauuagccuuucacucacugauuuuagcagccauugauacucauugccuagauucaguucuugaggaagguuuuuuuguuuguuuguuuguuuuccugagacagaguuucucauuccuguugucuaggcuguagugcuguggcgcagucacugcucacugcaaccuuugccucccaagcucaaaugguucuccugccucggccucuugaguagcugagacuacaggcgugccccaccacgcccggcuaauuuuuguauuuuuuguagagaugagguuucaccauguugcccaaggccggucuugaacuccugggcucaagcaaucuucccauacuggccucccaaagugcugggauuacaggcaugagccauugcaccuggccaagauuuuugacauagugauauucuauuacucuuucugcauuaauuaucuggaauuccucuauaaagaacauucacucauaacucuucuauuuuccugaggcauaguuugugugaggaagucagaauaaaugcuugaugcuguuauuuucuuaguaaaaagugauaguaaaguguacacauacagaagugccucauucuuuguagugggugcuuagcauuucauuacuauggauugugucaaaugacauguuuauuauuuguuuuaauuuuuuuaauuuccguugguuauuggggaacaggugguguuugguuacauggguaaguucuuuaguggugaucugugagauuuuggugcacccccacccgagcagugcacacugcacccgauuuguagccuuuuauccgucacccccuucccacccuuuccccgaguccccaaaguccauugugucauucuuaugccuuugcauccucguagcuuagcucccacuuaugagugagaacauaugauguuugguuuuccauuccugaguuacuacacuuagaauaauagucucuagucccauccaggucgcuaguggugccuuuugacuguuugcugagugauggaaauuugucacacucuccaucccuucuguugcuuuccuugucaauguauugggcaugacgagggaaagggaaaugucucuugacuacacagagugcagucguugugcugugaaaaauguccugguagccgugagcaggcuggcuaccccucuuccuuacagacucauuccuccuccaaacaagccagucucacugauacgugguucuguggcaucuccaguggauucaacucauccuuaaagacuuacaugcccucccagguguuuuaaacagggguagauuucucugcacuaaugcugaguguugcuucuucaucacuuuucccgagaacuuuagcuguaccuuggccuuuugagauuauugggacuguuauguagaaaccuguguguuuugcuguucuugcgaccaugcaagcauuggagacauguugauauuuucgugucuaugggacuagagcaguuacgggcaguaguaccuuuggagacaggauucacgaugguuccugccugguuguaggcggagucccuauguuccauauguuuuuccacugagacuuuguuuuucuuuccaacuuucauuuuaagugcaaaggauggaugugcagguuuguuacauggguaaauugugggccguggggguuugguguagauaauuuugucacccagguaaucagcauaauauucaguauguaguuuuucaguccgcauccuucucucacccuccaccuugcccaaauaggucccagugucuauuguucucuucuuugucuccauguauauccaauguuuagcucccauuuauaagugagaacaugcgguauuugguuuucuguuccugcguuaauucacauaggauaauaauggccugcagcaccauucauguugcugcaaaggacaugagucauucuuuuuuauggcuguguaguauuccaugguguauauguaccacguuuucuuuauccaguccacugcugauggauaucuagguuaauuccaaguggauucuuaugcauccccaagacucuugagcacaggagguggaggugguagggcccugcagccgcucuuccugcugugguauacaggcaaacagaugagguguuuaaacaccaccaccaauagccacuuaaguuguuuuagccugcagucauaaacuugaucaugagagacacuguuaauuuugauuuauuaauguuuucuuucacaaaugggaauggagauaccccucuuccccaacucucuggauuaaucugcuagggcugcauagcaaauuaccacacuuaguaucuuuuuuuuuuuuuuuuuuuuuuuuugagauggaggcucgcucuguugccaggcuggagugcgguggcacgaucucggcucacugcaaccuccgccucgcggauucaagugauucuccugccucagccucccaaguagcugggacuauaggugugugccaccacgaccaguuaauuuuuguauuuuuagcugagaugggguuucaccauauuggccagggugggcuccaucucuugaccuugaucucuugaccuccaucucuugaccaucucuuggccucagccucccacucuuagugucuugaaacaacagaaauuuauccucucacaguucuggaggcuagcagucugaaaucaaggugcuggcugugccacaccccaucuggagucucuaagggaagauccuuccuggugacuuccaggaauccuucucauuccuuggcuuguagccgccucacuccagucccugccuccaucaccacauagacuucucuguguuccucugugcauccucuccucaucuuauaaggacaccagucauuggauuuagggcccgcccuaauccaauaugaucuuauauuaauuacaaaaauuacaagucugcaaaguuccuauuuccgaaucaggucagacacuagggcugugaaugagcauuaauuuugggaacacucuucaacccacuacacccuccuaguaauuuuucuguuuuuuggcaaaguggcaagcauuucaaacaguuuuaguuaauuaucauguuguuugcuagcaaaaauaguuuuauuuauaagaagcagcugagcagucaccuaaauugaggacuguguuaggugccacaguugugucagccugggaugacugucauuacuacuugcgucacugugauaagugucguaguuauugauugcagacuuaguucauugaaguugaugaugaaaggcaacuauuuuguucccaugccuucccauuggcaaaucaacuccuucuuguuccuagaucuacuugaggagucuaaauugcacgcuagcagauacugggagagacuugaaucacaauuugauacauuguaacagagcaugcagagaaccaccuaaagcaguguaaugcaagaauuguuaagcgagaaacaguguaggagaguguggccauuacaugggagaguuccacaauuauaaaugcuuucauugcugcuacagugaauucuugguaauugucuuauagaguaauaaacugacucagaguguuugucagauucuagauauuccugggaagaaaacugcugccagccauuauuuugacacguagcuuuucacguuugcagugugccuguuuguaauuaacaaaaguuuauuaaugugacauuaagcauuuaaggccuuggaaauauuguagcccugcaguugaaggaggaauagccaauggcuuugucugugauaguuucuaagcacagacaguccccuacuuacaaugguuugacuuaagauuuuuuuugaguuuacaauugugcaaaagugauaugccuuugguagaaacugugguuuaaguauccauacaaccauucuguuuuccacuuucaguucaguauucagcaauuuacaugauauauuccacaauuuauuauaaaauaggcuuuguguucuuagaugauuugcccaacuacagacuaacaugaguguucugaacauguuuaagguaggcuaggcuaagcugugauguuggguagguuaggaguauuaaaugcauuuuugacuuaauaauauuuucaacuuaugauggauuuaucaggacaggaccuaaucccaugcuaaggagcaucuguaccuggaaaugcuuagaagguaaugugcacuucugcccacaugguuuacauuugcaagaaaguacauuagccaugcuuggagaaaacgugauucuuuuaauuucugccacuuaaguaagggugcuuuugggucacaggagaaggaaaaacuaagauaggagugggguugucccggccucuugcguuuuuggagcaaauaguagacaggugugugauuaauugucuuuuugaacaaaaaaaggagauaaaucccuuuccccauagacuccccugauacgguucuggcuuauuagagccuauuuauugguaccucucagaugcuguguaugccuuaccugauguugaggcuuuuaucuuggcaacugaugcuuuaggauuuucauuuccuuugaacuuuuaucugaagcccuuccuagaaaaaagucuugccauuauacuggcucuguguagauguuaauucuuauuacagugguagacgcugcucuuccuugccuccuuuuaagcauugccuaauuuccuacacuucuugucucuaagugggagcgcaguggagugccucagagcauggacucuggagcaaggcugccugacugugccacuuauuuuaccaguaacuuaaccuaccuccaagguuggauggagaauaccugaguuaauauuuguaaagugcucaaacugugccugguucauaguacguauaugugucuuuuuuuuuuucuucaagauaaaccauguuguaugucuugauugugguagcgguuacaugacuauauauguuugucaaaacucacuggaacugugcacuuaaaaaggaugaauuuuacuguauauuaauuauaucuuaauaaagcacaccuaaauuuuuuuaaggcuaacaagcaaacucuuucauucaaucagcaaacuauuuauuaaguauuacacagcgggauuauaaaaacauauaauucuggcuuggcaugguguugcaugccuguaaucccagcacuuugggaggcugagguaggagggucacuugagcucaguaguucaagaccagccugggcaauauagcgagacccugucucuacaaauaauaauuuuuaaaaauuagcugggcauggugguucaugccugugguucuagcuacuugggaggcugaggagggaggauugcuugagcccagguggucaaggcuguagugagcuaugaucacagcacugcacuccagccugggugacagaaggagacccugucucaagaaaaauuuuuguuucaaaaaauaccaugcaauucaaagaggcuugccaguguagaugaguaaaccaguuauaacacaggauaaauuugcaucaugacaugguaagaggugcagccaagcagcuuauuagucaucuaggcaagaaaugcuguagggacuuagagacaggauugcuuccuguaguuacgaagacuucaccaaagaguggaaacuugaggugggccuuagaagauggguaggauuuggggaggugagcauuugggagagcccacgaauacagauacaaagccuagggguggaaaugcauguggagaguuuaggcaaccaugagagagcugguuggaucaaaguggauucucucccacuguguaaggggcagcuuugccuucuggucuaacauagccuuuuuucuucaucuguagaaaggucccccuucugggaaagaccgagugaagaaagguggauccuacaugugccauaggguaagucaugucacuaaacuguuuugccguucuuguucugauagcaguuuuauggauccauuguaaaugauagccccaaaugucucauucacuucugcaaaugccuaccuaaccccacugaaaccagaaaaaaaggaggacagucaucucaaauuugguuacaagcauggagaaaaguaacacaaguaacaaagguugugaaugaccuauugucaaccaaauuucaucuauugaaucuugccccuuugagagaccuuuguugucccacgaacugcacagggguggguguauauaacuuuuccagcauguaagucugaaagcacacccuuaauuuauuugagaauccuguacauuucuggauuuucuguugagauucaggugagaguuauguauggagggcagauugugauauacugaaauggaagcaucccguguucuagguacaaagugugccuugugaaauaagcaucauucccagagaguguuucuucucuuugggcuaugauuuuagugucugagcuggcuuucuucaucaguuagagugacuugguguuuccuaaauaaccuuuauaaggaauuuggaaauagaauaccaucccuucccuuuuuucuuugagucauauauuuuucacgucuccugaacuccagcuuucuaucccugugcagagauggcauuuugcagauuguuauugccucaaagcuuccccuaggaauuuauucaguccaggugguuagagacuuaaaaccaccuauaauggcuccaaauuaaguuacuaauuugauaaugauggcauuaucaaauuuugucuuaaacagugguucucaaacuuuauuccacauuguaaucaucugggaucuauauaaaauacugaugucuggcuccucacucacccccauucugauuugauuuuucuucagugugagcugggcauugcauuuuuuaaagcucuccaggugaugaaaacauacagccaaguucgggaaucacuagccuaaagcaaaucucucuagauuuuauguauauaugugaguuuguauguauguguaucuucuguauuucuuagaauuuuuaauccagugauucagguugaaguucauagagcagagcucaauugaugcuuuagaccuacauugguaauaagauguagaccaauuuauuuucaugaaaucuuuuuuuuuuuuuuuuuuuuuuuuugagacagagucucacucuucacccagacugaggugcaguggcacaaucacagcucacuacagccccgaccuccugggcucaagcgauccucccaucucagccuccuaaguaacuuggcuaauuuuuaaauuuuuuuuagagauggggucuugccauguugccuaggcuggucuugaacauuugggcucaggaaauucuuccugccuuugcuucccaaaguguugggauuacaggcaucagccacugugcccggccuaaaauccuaguuuuaauuuuaaauuaaaagcauugucccaggucuucccaauauauuuacauguucacguauacaucagagucuuuaaucccagauugcuucucuauuugaaguuauugcuacaaauguaccuggaucuucuugccaggaaaccagacuuccauggaaaacaggugaaucucucuuuguacaguaguaucucaaaauccuaauugucaccaguuaugucucuggcauauggcacuuuucuaaauucagaauccauuuacuuucuaaguaauugaggaccagaagauuuuucaucaagaauaaaugggguaacagaagcuuguaaaaaacauuuuaagcaaguaaaggacauuaacuguccuaauuccaugcguaugaauguaucuacuuucauguuuuauaacuuuuagcuuauuuguaaucuacauuuuuauaagcuucccaguagauucuuuaaaaauaucuuuuaaacuccuacauacuuuauuaaguacacuuacaugguacugauuuuuuauguucaucuugagucuugcaaccuugcaaaacucauuuauuaguucuaguaauguuuuuguaaauuguaucauauuuucuacauagcugaucauaugaucugugaauaucgacaguucuuccuuuuuaaucuagaucccuuuuauaacuuuuucuugcuguaugucauuggcuagaaccuucaguauaggguugaauaggaaugguaagaguagaccuucauaccucauucuugaucuuagggaauaaacauucaguuuuucaaaauuggauauguauuagcaauagcuuuuucauagaugcaugcccuuuacagcuugagaaaguuuuuuuccauugcuaauuuuuuagaguuuuuuaucagcaauggauguagauuuugcugggagcuuuuucugcaucuauugagaugauaauaugauuuugcuuuuucuaucuguucauauggugaauuacauugauuuucaaauauuaagcuauccuugcauuccugggauauguaucauuccacuuagucaugauguauuaucuuuuuuauacauuuuuggauuugauuugcaaaaauuaugaguauuuuugaaucuaguuuauucuguguuuucuuguaaugucuuuaucugauuuugguuucaggguauugcugacuucauagauugaguuguuaaauauuaacuuauuuuaaauuuuuuugcaagaguuuauguagaauuaguguuauuauugaaauguuugauaggauuccuuggugaaugcauuugggccgagaguuuuaacuauuaauuaauuaauuuagagacagggucgaauuucugaacucaagcaauuguccugccucagccuccugaguggcugggacuacaggugugagccaguaugcccauuuuuuuuuucuuuuacuguaggccuaauuuuuuaaauagauguaggacuauacagcuuaucugcuucuucuugaguacauucuaguaguuuguaucuuuuaaggaauuuguccauuucauuugaguuauuguauuuauuggcauaaucucugccuuucauuggguguuuagaccauuuauuuuuaaugugguuuuuaauaugguuggguugaaaugugccaucuugauuuuuuuucucuuugucucaccuguuguuguucucuguuugucuucuuuucgauuacauacuuuuuaucaccccauuuucucuccuuaugcuuauuaguuguaacucuauguuuuauaaucuuagugguugauuuaaagucuauauuaugcauuuuuaucuuuucuuagcuuacuugaaggauuuguuuuaauuuagucagguuccaugugauggggauaacauuuuagaagaggagaauagcagauugacagaacugagugggauccacaggauuuuccauagaaaaauggcacuuccaggaucuuggucaaaugaauuguuuauuagguuggucuuuaucaucagucugguuauaucuguaagguuaggaaaauagcauagugucgguugugaauuauuuucagagugcuuagccuuuccaguagaugaagaguaacagcuuuuacuaaauuauugagauguggauuagggaauuacaucuggauuggaguucuauaucuguuucuugccagguaugugaccuugggcaaauuacuuaaucuuucuaagccucaguuuuuacauuuguaacauaauauaauuguacccauuauaagguucugaugaggaguaaaugaaccaacauauauaaguucuugguacagugcuuagcuuaugguaaaggcucaguaaaaguuaguugcuccuaucagcaucaucuuuauuauaauuagauuauuuccccucuucucuuuugaagaaggaaccaacuaauaaacucccaacuagacaggcaaaagcaauguucauggcauaggugaaaaucaauaaaaggaaaaaaaucaauaaaaagaaagaauaauguuauaauucauuuuuuaaaaaauuuucuuuuuuagaugaugacuuauuuuugaucaugggccaacaccaguuugccuggcuaaaguaaauucuuuuuuuugagacagaaucuuacucugugacccaggcuggagugcagugacaugaucuaggcucacugcaauguccgccucccagguucaagcauuucuccugccucagcuuccugaguagccgggauuacaggcuugugccaccacgcccagcuaauuuuuguguagagaugggguuucaccaaauuggccaggcuggucucgaacuccugaccuuaagugauccucccgccuuggccucccaaagugcugagauaacagacaugagccaccaugcccggccugccuggcuaaaguaaauucugaugaucauucauaauuuuuugaaaaucuauccaaaguauagcuucaauaaggagaugggggcacagaaagaaaaacuaugaggcaacaugucaucugguuaagggugcagacuuuggaaucagauugaauaggcuagaaccuuggauccaccauuuauaaaccaugugaccuuaggcacacuauuaacaucugugugccucaauuuuuccucauguauacagugcagauacuaaugaugccuaucucauaggauugcugagaggauuaagugaauuaauacguaguaauacaguucacauaguaaguacucaagaaauacucauuguuguugauguuguuagauuaaucccucugggucuuuagcucagccuacaacauuaaggaaauccucaccauccuaccaagaugaagagcaaaaggaguuggucuaguguuaguggcaagagcaacggacgggaaauugagaccucuguucuguuguggcauucucuauaaugauuucguuuaacaugaguuacaauuaucuuuaaaaugcccuuuguaccaaaaagucucccucucauaaaaaccauauugcugcuccccuuuacuuugaagccccaaggcugguaagucauuaucuuaaauggauuguucccaaguccaggaucucauucuuagcacagacauggagaucaauuucacacaguaauuagccaucuuaaugaaauaggacuaaaacagguccuucccacuuucccuguucuuaauuaauagaaugacccauuuuucagccaccuaaagaccucacauccuuaagaaccacuuuugcugcuaaaaauaaaguugguaaaaaagaaagagcaaugaggacauuuauaaugaggccauuuaccucuuuaauuaugugcuuuauuaguuggaauuuaaaauaaacgacuuauuaauaaauguuugcugagugaaugagugcauuugaaauggaaugaugugugaauugacuguuuucucaagugauggcccugaccucgcaacacuaacuuuuguagugagucuugcuuuuuaggguuuaauucuuuauugucauuuugguuaauggacagucucagggauugcugugaucuaauaaagaacuaaauuuuggugguggggaagggagaggcacugauuuuaaacuuuucauuauucaaagaaaacauuuucauagcauaaaauuuagaaaauacauaguaaagaucaaaaugaaaauaagaucaucaugcuuucuaaagaaaacaauugauaguauuccagcaaacuuuuuguguacuuaauuuuugucuuucaagaauggaauuauucuguauauaccggggucuucagauauggcccugggaauaaucucuuguauaugucuuuucacuauccugugucgcagcuguagaauccucaacccagugcuuugggcagaucccaacaguucauuugagugguuauaugcuagguuuuguggcauaugaauaucaucuuauuuuaaaauaguuucugauauaauuuaagagauaagugacagguagaaauaugccauucaacaaaaaccuaaguccuaugcccuaucaccagagagauuucuuaacuuucccauuuauguagcaaauguauauccacauucagaugcuggcagggcuauuaccaucuuccugcaguugaacacaagguuucuaagaccugcuuagaagcuggcuaauaccuuuguuguuuuagugaggaagccaguuaccccaaagacaucauuaaccaccuuugugccagucauuacucuugccuggaauucucaugcuccagaucuuugggcaacucagcccacaugugaucuucucagagaggccuuuccagaccaccacccuaucgaaaguagccacccagucacucucaguccucuuucccuauuuuccuuccugcagaggugacugcuccuggaaaccaucuugaauguaucgguuuauuuauugucugacaauucccuuuugaaugucagcucccugauaacagcuaucuuguuugucuuguucugauuguauccgucauaccuaaaauagcaucuggcauauuguaagcucucauauauucagugaauaauuaaaccaugcccugauaugaucaggcucuggccuugcuauccucucaacuuccccucuaaauccuauaaacuaguguuacucaaaguguggcccaugggccuguagcaucagcagcaccuagaagcuuguuagaaguagguucuugggccccauacuagacuuccugaaucagaguuucuggauguauggccuaggaacauggauuuaagcaaccuguauuggccauucuuauguaugcugagguccgaggaccacugccaugaucauggaaaucucauccacaucaauuuuugccuucuaaaaaagcguguacguuuaugggacaagaaugacaugucaucuguguagcucccccugaaccugaucuuuguugcaguguggaguuugcuacacaugcuuggcugcauggggcccuggauuauccacaggaacuugauucuagaaauaccaaagcacuguuguuucacagcagcccgacgaguaggcccugcauggaaugaggcuuuugcuaugucuuccugcauggucaccucuagucauuugagagcuuccauugcaugcagaucacacauaguaggagaugccaucaauuuaucaauuauuucaagcacacuuuaaauucaucuuccuuuugucuaccugagaauugcuaauguuauauuauucacugaccacaaggaaaaugagaaaauugguugcuaucauuucacuaucuauagaagacaaagcacugucuuuauuuuuacaguagaagugcucuaaagaauuucugugucaacuugagauacuuuucacaaagacaagaagcauuuuacuuuucugagagaaaagagaauaauuuaaaaaaaaaaaaaaaccuuuugcaugccaacuuaucuucccccugaguccaaauuaucgcuucugcacagauucuaaaguuauuccacauguugcuuugugaaacuucuuuaaccaguuugcagggacuugagcuguacugggccaacucagaguuuaugcucauggcacacaggaugacuaguuuauuuuuauucuccguuuuuuuggaucggagaacaauccuagggcacaagaguuucaagcgugguuauuuuuggcauguggaggcuuuugaaguaaucugugguuaaucacugaauaccugcuagguagucagggauaugugcguuaggcucucuuauguuuaugcaaguguacaagugcaugcagggcuuguguauugggcagugggaaagaagacaugagucgugauacucuuccaugguguauaugugccacauuuucuuaauccagucugucaugguuggacauuuggguugguuccaagucuuugcuauugugaguagugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacagugcaaaagugucucuauuucuccacauccucuccagcaccuguuguuuccugacuuuuuaaugauugccauucuaacuggugugagaugauaucucauugugguuuugauuugcauuucucugauggccagugauggugagcauuuuuucaugugucuuuuggcugcacaaaugucuucuucugagaagugucuguucauguccuucgcccacuuuuucaugggguuguuuguuuuuuucuuguaaauuuguuagacuucauuguagauucuaaauauuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauuacuuuugguguuuuagacaugaaguccuugcccaugccuauguccugaaugguaaugccuagguuuucuucuagaguuuuuauggcuuuaggucuaacguuuaagucuuuaauccaucuugaauuaauuuuuguauaagguguaaggaagggauccaguuucagcuuucuacauauggcuagccagguuucccagcaccauuuauuaaauagggaauccuuuccccauugcuuguuuuugucagguuugucaaagaucagacaguuguagacaugcggcguuauuucugagggcucuguucuguuccauugaucuauaucucuguuuugguaccaguaccauguuguuuugguuacuguagccuuguaguauaguuugaagucagguagugugaugccuccagcuuuguucuuuuggcuuaggauugacuuggugaugcgggcucuuuuuuaguuccauaugaacuuuaaaguaguuuuuuccaauucugugaagaaagucauugguagcuugauggggauggcauugaaucuauaaauuaccuugggcaguauaaccuaagcagcugggaagcucgaaauggguggagcccaccacagcucaaggaggccuggcugccucuguaggcuccaccucugggggcagggcacagacaaacaaaaagauagcaguaaccucugcagacuuaaaugucccugucugacagcuuugaagagagcagugguucucccagcacgcagcuggagaucugagaaugggcagacugccuccucaagugggucccugaccccugacccccgagcagccuaacugugaggcacccccccaguaggggcagacugacaccucacacggccggguacuccucugagacaaaacuuccagaggaacaaucagacagcagcauucgcgguucacaaaaaucugcuguucugcagccaccgccgcugacacccaggcaaacagggucuggaguggaccucuagcaaacuccaacagaccugcagcugaggguccugucuguuagaaggaaaacuaacaaacagaaaggacguccacaccaaaaacccaucuguacaucaccaucaucaaacaccaaaaguagauaaaaccccaaagauggggaaaaaacagagcagaaaaacuggaaacucuuaaaaagcagagcgccucuccuccuccaaaggaacgcaguuccucaccagcaauggaacaaagcuggauggagaaugacuuugacgaguugagagaagaaggcuucagacgauugaacuacuccgagcuacaggaggaaauucaaaccaaaggcaaagaaguuaaaaacuuugaaaaaaauuuagacgaauguauaacuagaauaaccaauacagagaagugcauaaaggagcugauggagcugaaagccaaggcucgagaacuacgugaagaauacaaaagccucaggagucgaugcaaucaacuggaagaaaggguaucagugauggaagaugaaaugaaugaaaugaagcgagaagggaaguuuagagaaaaaagaauaaaaagaaaugaacaaagccuccaagaaauaugggacuaugugaaaagaccaaaucuacgucugauggguguaccugaaagugacggggagaauggaaccaaguuggaaacacucugcagguuauuauccaggagaacuuccccaaucuaacaaggcaggccaacauucagauucaggaaauacagagaacaccacaaagauacuccucgagaagagcaacuccaagacacauaauuaucagauucaccaaaguugaaaugaaggaaaaaaugcuaagggcagccagagagaaaggucggguuacccacgaagggaagcccaucagacuaacagcggaucucucggcagaaacucuacaagccagaagagagugggggccaauauucaacauucuuaaagaaaagaauuuucaacccagaauuucauauccagccaaacuaagcuucauaagugaaggagaaauaagauacuuuacagacaagcaaaugcugagagauuuuguugcuaccaggccugcccuaaaagagcuccugaaggaaacacuaaauauggaaaggaacaaccgguaccagccacugcaaaaucaugccaaauuguaaagaccaucgagacuaggaagaaacugcaucaacuaacgagcaaaaucaccagcuaacaucauaaugacaggaucaaauucacacauaacaauauuaacuuuaaauguaaauggacuaaaugcuccaauuaaaagacacagacuggcaaauuggauaaagagucaagacccaucagugugcuguauucaggaaacccaucucacgugcagagacacacauaggcucaaaauaaaaggauggaggaagaucuaccaagcaaacggaaaacaaaaaaaggcagggguugcaauccuagucucugauaaaacagacuuuaaaccaacaaagaucaaaagagacaaagaaggccauuacauaaugauaaagggaucaauucaacaacaagagcuaacuauccuaaauauauaugcacccaauacagaagcacccagauucauaaagcaaauccugagugaccuacaaagagacuuagacucccacacaauaauaaugggagacuuuaacaccccacugucaacauuagacagaucaacgagacagaaaguuaacaaggauauccaggaauugaacucagcucugcaccaagcagaccuaauagacaucuacagaacucuccaccccaaaucaacagaauauacauuuuuuucagcaccacaccacaccuauuccaaaauugaccacauaguuggaaguaaagcucuccucagcaaauguaaaagaacagaaauuauaacaaacugucucucagaccacagugcaaucaaacuagaacucaggauuaagaaacucacucaaaaccgcucaacuacauggaaacugaacaaaaaugacuacuggguacauaaugaaaugaaggcagaaauaaagauguucuuugaaaccaacaagaacaaagacacaacauaccagaaucucugggacacauucaaagcaguguguagagggaaauuuauagcacuaaaugcccacaagagaaagcaggaaagauccaaaauugauacccuaacaucacaauuaaaagaaccagaaaagcaagagcaaacacauucaaaagcuagcagaaggcaagaaauaacuaaaaucagagcagaacugaaggaaauagagacacaaaaaacccuucaaaaaauuaaugaauccaggagcugguuuuuugaaaggaucaacaaaauugauagaccgcuagcaagacuaauaaagaagaaaagagagaagaaucaaauagacccaauaaaaaaugauaaaggggauaucaccaccgaucccacagaaauacaaacuaccaucagagaauacuacaaacaccucuacacaaauaaacuagaaaaucuagaagaaauggauaaauuccucgacacauacacucucccaagacuaaaccaggaagaaguugaaucucugaauagaccaauaacaggcucugaaauuguggcaauaaucaauagcuuaccaaccaaaaagaguccaggaccagauggauucacagccgaauucuaccacagguacaaggaggaacugguaccauuccuucugaaacuauuccaaucaauagaaaaagagggaauccucccuaacucauuugaugaggccagcaucauccugauaccaaagccgggcagagacucaaccaagaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaagucugguucaauauacgcaaaugaauaaauguaauccagcauauaaacagaaccaaagacaaaaaccacaugauuaucucaauagaugcagaaaaggccuuugacacaauucaacaacccuucaugcuaaaaacucucaauaaauuagguauugaugggauguaucucaaaauaauaagagcuaucuaugacagacccacagccaauaucacacugaaugggcaaaaacuggaagcauucccuuugaaaacuggcacaagacagggaugcccucucucaccacuccuauucaacauaguguuggaaguucuggccagggcgauuaggcaggagaaggaaauaaaggguauucaauuaggaaaagaggaagucaaauugucccuguuugcagaugacaugauuguauaucuagaaaaccccauugugucagcccaaagucuccuuaagcugauaagcaacuucagcaacgucucaggauacgaaaucaauguacaaaaaucacaagcaaucuuauacaccaauaacagacaaacagagagccaaaucaugagugaacucccauucacaauuacuucaaagagaauaaaauaccuaggaauccaccuuacaagggacgugaaggaccucuucaaggagaacuacaaaccacugcucaaugaaauaaaagaggauacaaagaaauggaagagcaauguauuuuuaaaaagcaauguugucccacagccuuuccuauguuugauguuccuagacuuguuguuuaauuuuuugccgaucuacuggcauuaaaugauaucauaaauaugauuuagauaauaaauaauaucauaaauauuauuuagguauuaaauggugucuuaguguuguucuuaguauuuuuucaguggccaucuaucacuuauuacuugguuuaauuucaaaaauuaauauauauucuuauuguauuggaauacugaauagguuucauauaggaaacaugaaacucagauugcuugagggauaacuacugugcacauuguggugcauucggaaucuuccagucuuuucuucuuggcacauguaguuaucuacacuguggucauaccacauauacaccuuuauauucugccuuuuucauuuuaacuguuuuuuuuucuuuuuuuggacacaagaucuugcucugucacccaggcuuuaguacaguggcucagugaugguguacugcagccucaaacacccaggcucaagagaucuucccacuucaaccucuagaguagcugugacuacaagugcacaccaccaugcucagcuaauuuuuuguagagaugggaucuugcuguguugcccaggcuggccucgagcuccuggccucaaacaguucucccauuucagccucccaaaauguugggauuacaggugugagccagugcgccuggccucauuuaacauuuuaucaugaaaacuuccugugucauuaaauacuauguaaagacaugacuuucaauggcugcuuacuuuucuauuauauggaugugccuaaacuuaggcaaucauugguuguuacauuuuucuuuuuugcuguuauaucuaaugcugaacaucuuuguacuauauccguguuacauuuauaaggugaaggacguuggaaaauaugugguuaguucuugaaugugcugcccuuuuuaaagcauacauguuaaguauccauacaggcaggguuguggggaagcacugucuacagccggugcaauaugcaucugauggguuagagccuucagcugagagucccaguagcacuuaccuugcucuuucucucuacacagucuuauuguuacagguaucgcugugcugcucggagccagaacacaccugauagcucugcuucgaaucugggauuccgcugugcagccgaccgccugcccacuauggacugacaaccaaggaaagucuuccccaguccaaggagcagucgugucugaccuacauugggcuuuucucagaacuuugaacgaucccaugcaaagaauucccacccugagguggguuacauaccugcccaauggccaaaggaaccgccuugugagaccaaauugcugaccugggucagugcaugugcuuuaugguguggugcaucuuuggagaucaucaccauauuuuacuuuugagagucuuuaaagaggaaggggaguggagggaacccugagcuaggcuucaggaggcccgcguccuacgcaggcucugccacagggguuagaccccagguccgacgcuugaccuuccugggccucaagugcccuccccuaucaaaugaagggauggacagcaugaccucugggugucucuccaacucaccaguucuaaaaaggguaucagauucuauugugacuucauagugagaauuuauuauagauuauuuuuuagcuauuuuuuccaugugugaaccuugagugauacuaaucauguaaaguaagaguucucuuauguauuauuuucggaagagggguguggugacuccuuuauauucguacugcacuuuguuuuuccaaggaaaucagugucuuuuacguuguuaugaugaaucccacauggggccggugaugguaugcugaaguucagccguugaacacauaggaaugucuguggggugacucuacugugcuuuaucuuuuaacauuaagugccuuugguucagaggggcagucauaagcucuguuucccccucuccccaaagccuucagcgaacgugaaaugugcgcuaaacggggaaaccuguuuaauucuagauauagggaaaaaggaacgaggaccuugaaugagcuauauucaggguauccgguauuuuguaauagggaauaggaaaccuuguuggcuguggaauauccgaugcuuugaaucaugcacuguguugaauaaacguaucugcuaaaucaggc

SEQ ID NO: 191667 - RNA, 86280 nt, Homo sapiens
gacguaaugcgguagcgcggggaauuucgagugguguuggagcgccggaggcuaguggguggcugacccccagcauccucgggagcgaccauggacucccuggccgagucucgguggccuccgggccuggcagucaugaaggugagugcuucggggaguuugggagcucccgggugucugcggggggaggucccucccuuugaggaggauguccucgccuuaaggagaaaggaugaggcgcgagcgucgcacugggcccggguauccggcucugcccugccacuagccgaccgcguggcucugggucucaguuuacuccucugauaagugacaaggacaagccuggugagcugagguuggcagucuuauggcaccagcuauucugcgauccaaucccaacaauaacauggagaaaaacaguuauuccaaacaaugacaucgacagcuguucuuuacugaaagcuuacuuugugucaagcacuaaacagugacaccggacaugauuuuggguggacacuuuaucagauaacauguauguaaucacguagccaagcagguagucuccuuuacaggcucuuucauuucuucugauuauucucaauaaacguagugcucguuuguucugacauacugccccaacuccucucuaacacaccuucacucuucucuaacaauugcucaugucucuuaaacagagaucaggacucaggcucagcgcugaucuugcauugcgucugauuauuucacuuaaauaacauuuauuuuuguggccacuuucuguuuuggcaaggcauaccaguuuccauuuacaguaguggugggcccuggauuugcucaagagcagaugcacuuugcugugcuggauaaagaucaguugcuugguguuucuucuugcucugugauuauuuccguuucucacaguggcuaagauagccuucuucucccucaguuuuguagacuuggggauuauaauaccugucccacugacucauaaauuugacuuuagaauuaagugaaggcuaaaguaaguagaaggccuuguucuuccugcugucaucagugacgucuagagugcuuggggacuugagauaucugcaugaugagaagcugacauugugaaaugauccaggaaagcuguaguuuuggaguugugggcuuggcaccaggaugcaguggagaagagcacagauuugaguuccagugguccugggugaaaucuccugucugccucuugacuguaugaccuucgguuaguaacuuaaccucucugagccugaauuucuucaacuauaaauuagagacaaaaauaacaguucauaggauugauuaaauaaauuaguugauguaugugggcacagauucugcuguguauucacugugcuuacugcagugccugacaccaagugggugcucaaauauuauuugcugcuugauugaaaguaucuggaauguaguaagcauucaaugaauauauuuuauuauuauuagcacuguguuaagugcuucuuuccccuuuuaauuuguugucaugaagcuugacuuggauaaggaaaguaaaagagcucuguaaccuguaaagcuccugcuuuguagauuuaagcacacuuuacauauucccacaauuucaguguucuuuagaggcggguuccaugucuucucugacuuugguaucucaccacagcacugaauguagaguuuggcaccacagagcguucagugaguguucaaccagagaguugauugagcccguauuuuuuugcucacauuggaaucauggaaucuuaagguuagaaaaccagccccuuucaguauuuuaaucuccuuuauaacacaucugccaauuucucaccuaauuuuugcuugaacucuuccaggcacaaagaacuaucagaucccagaagcagaucugacugaaguuacuucuuuuauugaauagaagucugacucagaauccaugguugcuaacuuaggauucacagaaagacuuuggagucucaaguuauuuguaaaauuuuugcauguauguuuuucugagcagagaguccauaguugucauccauuuuucaaagggaucuguaaccccaaaaacuuaagaguauuuuuguaauuauuacguuuuuccacccauuuucuacuucucccuuucacuuucucucucucuaaacuaaagaaauuuuggggagucugcugaccacucucuauucaggcaucauuuuuuguuuaguugguugaggcgcaugugauaugcauguuacugucuuggagugacaugacaagaaauuugaaccagaaauggcucaucugauguagugucaacuuccacaauugugcucugcagaucuuucagaaucauuccuccaccagaagaggauggcauagauaagaaagugugauauaauagacugguucuggcuucugggccugccucugcucuuaauugaucuugaacauaacccuuuagauuuuugugucugugacagcuuaccauccacaauaauggaagauuuuggcauuuuauuauuucccugguuuuacuuuaacaaaaauuuacuguuuuuggcauauuguaaauguaauauguguacacgguagaaaaaaauuaaaauucagaauaagauaaaggagaaaaauaaaaccauccauaauucuaccacccagagaaccaguguuuaacauuuuaccuuauuuuccuuugguuuuugugcauuuaaaauuugggaucacuguggagucaacuucuuggguuugauccagccaacuuaggaacucuguagacuuuauuuuuaaaauugggauacugaugcuguggacuucauaagauugcuaugaagauuaaacuacagaguuguuauuauuauguauuauuggcauagguuuguuuucugauuuuuauuuuccuagggcauuaauuauucuuugaaagcauguuuuuuaauggcugcauaauauuucaucauauggaccauuagcgacauuaguccuuuuuuguuuacauuuuuaaaauucagguaauagguucacaugguucaaaauacacauaaaauaaaaaguaaaagucuccuucuuaccauguuccuggcccugaucauuauuuaugacuucuuguuuaucuucucauuauuuacauuuacaaugaaaauagaaugcauucuuuuuuccuuuuuuucuuuuuugagauagggucucacugucgcccagacuggaaugcaguggcaaucacggcucacugcagccuugaacuccugggcuaaagcaauccuuccgccucagccuccugaguagcugggacuacaggcaugcgccacuacucccaacgaauuuuuaaauuuuuuauagacauggauuuuuguuauuuugccaggcuggucucaaacuccuggacucaagcaguucuccugccuuggccucccaaagugcuaggauuacagagccaccaugcuaggccuauuagaauacauucuuacucaccucuuccuuuuaaacaaaccguagcauaguauauguacugucuauaccuuauuuccuuuuuucacuuaucuuggcaaucuuuucauaucaguaugauggagagcuuccucuuuuuuuuuuuuuuuuuugagacaguuucacucggucaugcaggcuggaguauaguggugcgaugugggcucacugcaaccuacgccuccuggacucaagcgauccucccgucgagagcuuccuccuuuuaaaaaauauuucuguugaauggaauaauauuuuauuuuaaacaauuugaaagauuuuagguugccagaguaguuccguuccuguuuggauugcauuccagguuggcacacaucucucuuuccaaguuguccacuuucccuuccucugcuuucacugccccagcucuuuccaggcuuccucauuuggcugcauguguaguaccaugccgaaagcacuggacugccagacgggagacaggaauuuuggucuuggcuugacugaugccuacuauugugugccugcuuuugauaccaguuuccucuuuugacuagacaguuucuggaguuuggcuuuaacauucuuugauuugauucuuaacuugugugguggcaauggccaccuuucacccaauagugacuauaggcuagguguuggagucugaagaggaggaggcuuggaguaagagcuggaagcgcauuagaaguggaacagaaguacaguagcccuuaugugaagggaugacaauauggcacaagaaucggugugccaucaucuuuagcugucuaaagcaauuugggcaaccugagacugaauguauaagagucauaugagagaaguuuuuauuuauuugucaagaucccuugcaguuuaucuggaguuagcuuuugaauuuguguauuugacaaagaguuugauuuuuuuuuuaggggauagagaaaaaguuuugugacaggacuuccaauuuugaugucuuucugauauguauauaugcauauuugcauuucagacaauagaugauuugcugcgguguggaauuugcuucgaguauuucaacauugcaaugauaauaccucaguguucacauaacuguaaguauguuuuguuccugugaguuaguaaauugcgauuuuuacaugagguaguguuaauuuaacaccaaagauaugugcacauauuuauguuucaccuuuagcucuucuaucuuguaguuuuucagaaggucuuuuucacugccuuccucuugaauauugaagguuuuuacaaggcuucuauauuuucuaccucguuccucuuugauauuuuuaugauucuuauagcauuuauggcaguaaaauuuuuggucacaauaagugguucuuuauuugccaaguguuuuuugacguuaaguuucagaauuuuuguuuuuaacaggauaacagauaggugguuccaccaaguaguacuugauauagaauuucaaaguuuaaaaaucuguaacaauaagaauauugccccagugggagaauucuaccacugacuuuauuacagacaguuuuauaccuuaacugcuaugugacgcuggaaagacucauguuggaauuuguuuguacuucucuuuaagagucuaguauauaagcauuuaaaaauaucguaccuuaagauauuuagugcauagggguuacccuaucauuguugaggagcuagacauacaguuuauggguuauucagguucaugaucuuucuuguccucuauuuucaaguugauuuaucuuggaaaguuaaaaacagucaacuuaggccuaagaaauugguuuuaguugguaguagcuuugguggaaaaguuucuguggagaagacauaguaagaggguagcagugacggcagcacgggcauugcagaugcccuugggcuugacucuugaaaaucgggugagaauuuacuacuuuagaaaauguuugugagaauuaaaugugcagaacucacuguccggcacauuaugaguccuuaacaauguuaguuuucuuccagacaagauucacauuaaaaaccaagauaaguuuuggagauuguuuuaaaauauauuuuaacaucaucuuuauuuggguguaauuuacauacaauaaaauacauccauuuuaagugcacauuaagguauaaaaguguucaugaauuuugacaaauguguaugcuguguuacuacugcaauuaagauacugaacauuuucauuaucugauaaauuucuccccaucucagucaguaugaccucagcuagccaucuguagucuauuucuggacucuucuauuccauugaucuuagaaacuuaguaguuuuucaccaaaacuacugcccacuaaaaccaauuguuuaggccuaaguuuacuguugcuuuagcuuuccaagauaaaucaacuugaaaauagagaacaggaaagagcaugaaccuaaauaaucuguaaacuguuugucuaacuccugaacaaugauaggauaaccccuauugcaguaaauaccucaagguacaauauuuuaaaaugcuuauaugcuagacucauauaugucuauccuugugccaguaccacacuaucuugauuacuguggcuuuguaguaagucuugaagucaggcauuguaaguccuccaacuuuuuuuucuucguuuuuuuuaggaucguugcauuuuaaaugcauuuccauguauaacuuaaaaucagguugucaauuucuaccaaaagccugcugggauguucacuggaauuguauugaaucuagagaucaauuugggagaauugacaucuuaacaaugccgagucuucaguguaugaauaugauacacuucucuaucuuuauuucucucaacaguguuguuugauuuucauugcacagaccuugcacaaagaaauauaacuuauauugaccuuucgucuucugacugcaguaaauucacuuuaauuccagcaucuuuuuuguugauuccuuagaaauuuuugcauacacaaucaugucauuuguggauaaagacaguuuuacucauuccuuucugaucuauaugccuuuauguuucuuuuuguuacacaggcugguaccucaacuacaguguugaaagugguguggagggacauccuguccuuacucuuaauuuuuuggggaaagcauucagucuuuuaccauuaaguaugauguuagcuguaaguuuuuuuuauauucuuaauauguuuucauaaaccuaccaaguugaggcacuucucuaccccugguuaggcgagaggauuuuuuuuuuuaaaucaugaauggguguugaauuuugucaaguauuuucugcaguuauggagaugcucauaugauuuucuuccuuuauuuugugacauagcuaauaacguuguuuuuguuuuguuuuguuugggagacagggccucacucccucacaguggcuuuguuacagacuggcuuuguacuguaguccccccuuaucugugauuucaguuaccuguggucaacugcauucugaaaauacuaaaugggaaauucuggaaauaaauaauucauaaguuuuaaauugcacucuguucuaaguaaagcacugaugaaaucuugugccguccugcccaggaugggaaucaucccuuugucaaguguguugauguuacauaugcuaucuaccguuaaucguuuagugaccauccugguuaccagauugacuguugcagcauggcaguaauugucacuguguugcagaacacaguaauugugucaaguagcgcuuauuuuacuuaauaguagccccaaagcacaagaguaaugaugcuggcaauucggauaugacaaagagaaaccauaaaaugcuuccuuuaagugaaaaggugaaaguucuuaacaaggaaaggaaagaaaauuguaugcugagguugcuaagaucuacaguaccaucuacaguacagcacaagauauuuugagagaaagaccacauuuacauaacuuuuguuauaguauauuguuuuaauucuauguuauuguuauuguuccuaaucucuuacugugucuuauuaauaaauuaaacuuuaucauagguaaguauguauaggaaaaaacauaguauaaauaggauucaguacuaccugugguuuuaggcauccacugcgcuuuauggaaugucucgccuguguauaagggggcacuaccauauagagaaagaucuuuacuagucagcuugacugcagauucuaggggcuucguaagccuuuucuguggaugugucuucccuggacuugugauuauaaauuuccaagccgagagauuuggucaguuuuuucauuagcugcuguuuuucucucucaugugucuguccaugguauugcagguucuccagaguugcuguaagccaucagccucuuuuuuuguuuucagcugcccucaagcaucuaaaguaugcugauccaaagcaccccaaguugagugagacagaaaccauucccuuaggcaguccuuugaaaaguucaaauguuggucacacacuccacuauucucucccagccuccccucccaagauaagccgcagagcuauaucagccucugucugcucuauggguccuguggaucaguagcaagcaacccagcuuuuuuuuauucuuagcaguccccagucaccuagaacaugcaggguucaugcuuaguggggugagacagaagccaguccucuggccagcucuuggaaaagcuagaacauuggaccguguuucccuucuuucucuccccaggcagaaaguuggggguuucucuuccuugcugagccugggggaggcacacuggccagugagugugguacuaguccagaccuuugcuuuuguucucaguggcccucaaccugguucccuuuucugucaguguauagauucaggcagcucagaaaccaguuucucaaguagcccccgcaauguaagugcuagucuucuguuucucucccuagggauacauguuguuugcucacuucuucaugacuuauagcugucacuuaugccauucuuuaagaggaagucaguggagggaaguuucaguaaugaugauuuuuuauuuuaugagcacuuuuuuuucacuugugaagucucaguauucaguaggccucuucuacuaaacaccaguugucacaagucccgucaugucuaaaauuugcucugggucuuuaguguuuuaaugacacaaaacccccagggcuguaguggaagccaggucugucauguucugguaucaucuuggauugacuagaauuggugauccagaauccuagguauuuauuguugcuucuuagauuuuucaugauuuaucauuuuuaaaucacuuuauuuuguuuuguucuguuuagguuuuuggauaugaguaauaaacacuacauuuguaguucugcagguacaaaggugugaguggggugccuuggcagaaugcaggucaauuaaauugauccaaauuugugcuauuaaagaguauuuugggggcgagagggagcagacuuacuccaacccauaaaacaccauuaagugagaaauggucuugcuaauagacuaauaugcccaagugccaauuuucuuugcacuugcuauaauuuuucucacuucauaauggaagaugaucaaaauauuuagcaauuggcuggcuuucaaacaucaaaagagucuagcaucuuaauaguaaaaaggaaauuucuaaaacuuaaaugaauccuugucaugugaaaucuuaaggacuuuaugaaagaaggaacuuuuuagaaagaaacaucuaaaguguccaguuaaaagcaaaaaccagugugaaaagaacaggagguccaagaaagcugaaaagguuggcaucugccuccaguucuaauguuaagggacaguuaguugguaagagaauaacaucccuccaacuaaagacuagcauuucagaauuuccagaagugcagcucugcauaauuauaucucccuuuuguguguguagcuauuucucuucuccucugccuuguuucacagugcuacuucaugagaauauaaaagaagauaaacacguuuauuauuugccuaauagaaucuuauguugucucuugaauuagcaaagguuucguaaggggaacauuucauauuucaguuuguuuuaaaaaaugaaauaaaauugcuuuuuacuucuacacaagcuuugauuaauuuuuuuugagucaaaauccacaaaaggaaaaaaaaaaaagauugcuggccaagcuuuaaaauagugguaauuuaucaguguccacaagccaauuauuuuaucuaggaucuugcuugggauuagagaugcccccucucccaaggcuuggauauuucugugaaacuacucuuuaauucauuguuguuauuguaccuuccuccacucugcccacacaucuuuuuugggcucucuuggauggaaagacaaauuucauaggugauuuaaaugaagcccucugggaauacaugaauucaaaacucuucagcuguucuucuuugaauggaaggguugucauaguugcccacuagagaauaaauuaugcuggucugcagcuuaccaguacauauuugguaguagucuaguagagugaaauuaagccuagggcuugaucuacuuaggacuccauaucugguucuccucauuucaaaagaaaagaagaggaaagauauacaagauuaugcagaagagaaagcaguagccuuauuauaaauacuaauuuaaaagguacaugugaccuuauuaauuaaauguuauuuauugauguauacauaauauauauaauguauacuuauauagguacaauuacauauauaauaauguauacacuauauuguauaaguauacauuauauaacuauacauaguacauauuuauauaaguauacauuauaguauaaauguacaguauauauuuauuauaaacaaauguuuauagauauagucagucccugacuuaccaugauuugacuuaggauuuuucaacuuuacgauggugugaaagcgauacacauucaguagaaaccauacuuugaauuuugaauuuugaucuuuucccaggcuagagauagguauauuaaauacauuuuggcuuaugauauuuucaauuuaugauggguuuaucgggauguaaucccauguuaagucaaggagcaucuguaauuuuuaauaauuaauauauuaagagucuggacucuggugcuuuccuuugccacauauuaguuccauuaucuuuggcaaguuggcugagcccugugcuucauuuuucuucuugucaaaugugacuaacauugguaccaaccucaggguugcugugaggaucgaaagaguuaauacauguaaagugcuuagaacagagcacauacuaagugcaguguuuauuugaaccacaugaaauugccaauauuuguccauuuuugacuuaaccaaaaaugucaguuucauauaauucaacuuaauagugacaacuuauuaauuuuuuaaaaauuguugccauuguugaaucaauauuacauauuaagaaugugauuuacugaccaaaauccauugaaucacuaugacuggggauacagccugggaaacuaaguuaaaaccagcauaaaucucccuaggugacugagcugagcagcuagguuuuaggauuucuugacuuacaguauugcucaggagacuucuuauaguauaaagagaacagcauugauaauuaagagaaugagucuggacaggaauuuuugccucaggaugauucauaccuugagucucauccauaucugauuuaggugauauuuagaugagacuuuagauuuuagacuuuagaguugguacuggaauaaguuaagacuuuuggggcuguugagaugggauggauguauuuugcauuugagaagaacaugaauuugggagguuaaagguggaaugccuggagugaauuuuauccccccuaaaguccuaugucgaagccccaaccccaauguguugguguuugaagaugaggccuuugggagauaauuagguuuaaauuagguccugacaguggagcccuagugaugggauuaguguccguaugagaagagauaccggagcuuauggucacuccucacccccucaugggaggacgcagugagcaggugguugucuauaggccagaaagagagcuuucagcauaaacuuaccauauuggcaccuugaucuuggacuuuuagccuccagaaccaugagaaaacaauuucuguuguuuaaccugcccagucugugguauuuuguuauggcagcucaagcuaagaaaugcuuuccuguagucuuuuguaccauugcugucauucauuucacuuaugcauaagcauucauaagcgugcauuuuuauacgcauauacauaauaagcaucuauaauugaauacuucguuauuauuuuuguacaaaguguuaucuguuaaauuaacaagaaaaaguuuuuauuacaguuucacauauuccuucuccaguacucuuccuuucuuuacguagauuggaguuucugaccuaaauuauuuuccuccucucugaagaauuucuuuuagcauuucuugcaagggaagucuacugaaaacagauuccuucaauuuguguuugucugagaaaguccuuauuucucuuucacuuuugagggauaauuucucaggauauaguuuuagguuggugaugauuuucucucaacacuaaauauuucggugcacucucugugguuugugagaagucaggugucauucuuugcuucucuguagguaaggcccccacuacagcuucuuucaauauuuuuucguuaucuuugauuuuauguaguuucaauaugauuggcugaggugucuauuuguuuuguuuuugcauuuauccugguuaguguucuccgaucuuccaggauaaguaguuuaguguuuaacauuaauuuggagaaauucuuagccauuauuauuucuucugcuccuuucauucuucccuuucugguauucccauuauguguauguuacaucuuuuguagucauccugcaguucuugguuauucuauuccauuuuuccugucuuuuuuucucuuugcuuuucaguuuuggagguuuccauugacauguccuaaagcucagagauuccucagccguguucaaucuauuaaugaaccuaucaaaggcauucuguuauagcgguucuuuuuaucgcuagcauuccuuuuugauucuuccuuagaauuuccaccucucugcuuauguucccaucuguucuugcauguugucuacuuuuuccauuagagcccuuagcauauaauuuuuaaaaauugcugguccgauaauuucaacauuucugguauaucugacuuugguucugaugcuugcucaguuucuucaaacuguguguuuuuccuugugguuuuuuuguuaauaacuggaaaugauguccuggguaaaaggaacugcaguaaauaggccuuuagguaugggcagaggggacacauucuauaguccuaugauuaggucuuuuagcgaacuuugccccuggacugugaauguuacuaacgcuccucaguuuuccccuccuuagaugggacaggauggcuagagggcuagaguuguguauuuccuuuuuccagagucagcugggcucugauaaaacuccaguagauuaggcucuguaaaauaguuucuucugagggagggcuuuguugagaacagacuacucugggccagugcaguggcucagaccuguaaucccagcccucugggaggccgaggugggcggucaccuauggucaggaguuugagaccagccuggccaauauggcgaaaccccaucucuacuaaaaauacaaaaauuagcuggguguggugugguggcgcacaccuguaaucccagcuacucgggaggcugaggcgggagaaucacuugaacccaggaggcggagguugcauugagccgagauugcgccacuguacuccagccugggugacagaauuagacuccaucuugaaggggaaaaaacaaaacaaaacaaaaaaaacagacuacucuggcuuauuuagaaaugguuacuuuuacccuccuacuccuggaaggacugggggguuuuucuccaauauucacugugagaacuuugaagaacuccuggaacuaaaacucacagaagugugaggacauccucuccaugccugcaaugacaggguucccuggaguuuuugacucucagacuugcccacacugagccgccagcaauucgucaauuacagcucagguucucccaccccagcacugguuccagcacagguuucuccucugguucccauggagguuucuguuuguggguuucuguuccaguaaguugugauugucuguauuaccccccucucucucuccaguucggggagagcaguuugcccugugacccugcuuuucugcuggaucuacgaaaaguuguugguuuuucaguuuguucagcuuuuuacuuguuaggacagaguggugacuuccaagccccuuacaugcugaaucgguccccuguauucaucuuugcuuccuaaaagaacucaaccuguugucuguuuuauccuuuucauaauauguuucuuuguuuuuccuccuggggugcucuuacuuaggcuggcaagacuugcuuauuuccuggauauccauaccauugaaauuaugcugucuccuccucaacuaaacgaauccugaauuuauacaguguacugaaauuguacugucuccuccucaacuaaacagaauccagcugaauuugggcuacuaguaaauuagcuuagguaauuaguaagguaccauucuguuagucacaucugcuuugucuuugacugggagaacauuuacacugccuugaguguggugaauuuaguuugugcccauuuccugcuuaaauuguuaggauauauuaugcggaauuaugcuguaauugcuucacuauuuuauuagcuccuugaggucaagaaccuuccuuuauauauauuguucuuagugccugccacaaaagugcuuguuaaaugugggacagaggacauuauuuacagaauuaagauauagaagucccuaaugugauaaccuggauauauauuuuuucuuaauauguguauauauauuauuucaaaauuuauauuuucaaaugauaagcaguagagauaucuggcagguuuauacaguacccagcccaaguguauguuuccuguguuuugcagauggaggacacagagugauguauguugcuuguguaguugugguauccuaaagacuuacaauauuuauguuuuccuuuccuuaaaaugcuguuuaaucacauguguaagugugcauagaguagagguacuagaaauuuaagcuuaugaugauauaccuuagaugacggaaauagucuagggcuuaagauuuuguuagaagucauauuccuguauuauuaauauagcuuaauuaacauuauguugcacuuuguguuuugcagacugcucucucuguauaagaaaauuucuguccuauaaaacucaguguccaacuugcuguguggugaguuuuuguuuccuuuuuuuaaaacuuacugacugcugcaaauauuucugcuuuguguauacguaaaagccuguguauauauagggugauguguaguuacugaauuaagcuauaugaaagacauuuucagaaaggaccucuaaaguacauguaagaagagcugggcuuuguucaguuuuuuuguuaagauuucugaaaaccuaaauguauuuuaggaaguagcacucuuuaauucuuaugacccauguuuuuauggcuucucauuuuuaauaauuucucacuuugguagaaacucuggugguaugauuauucauuugcaaagaacugucuaaguauuugugcagaagguaaauaugcauggcuguugggcuuaauccggccuaucuguucccuuacaucuuuccccuaccagagcuucagggaaaacccuagaaaguuuguuguuauuguuucugaaacuuuucaaguagugggaacagguggaaaaguagacuaaaaggguaauuaaacauaagugggaauaaagaaagaagagacaagugaggucugacagagccgacacuaggacuagguaaggaguuugguuaguuuugccucucugguagguauguggugucagggugucacugaacauuucgaacuauuucucuauguaagaaauuuugugauuuggcucuuaagucuaagaucuuuacgauauguuacacugcuuuugacaagauggucucaucgcugagauaaacuguguaccauucaugccaaauaaguacuggguuugucacuuuucucuugcauuccugaaaaccaaucuuacuuuaaaauucuccuugaacacuuagugccucucccaguguuagaacuuaaaagaacauuucucuucuguuuuuccggagaaauuucugagaaagcugagugcuggcauuuugaagaaagauucuugcuuauauuagguuugauuguagucaguacagaguauauaugauuauaagagaagcucuggagagcuuuuaucagacuuccagucagcagauacugauucacuguuuuaaaauuucauauuagcaugagauaaaugaacuuuauuuugaggcugccuuagaagacuuagugggauggagaaccucaggaggaugggucagacauuuucaaaaacaagauuaugacaaguugauuauuguuuuugaccuuuuuccaucuguuguuuguuuuuucuagacugucacagagccggaucugaaaaauaaccgcauauuagaugaacugguaaaaagcuugaauuuugcacgguaugauuuaauuuugugacuaaccucuaacuacuuuugccuuuuauauguguucucucuuuacuuugugcaccuuuggauuagggaaugcaggguugcauauuuuauagucaaagaagggaaguaacagucauuauucacacauggaaaauuuacuagaguaagauuuucuuccuuuacuuaacagaaauucuccuguaguauagaauaauuaagaguuaaaacgcagauuugaggacuuccuuacuuuugggugcucugaagauacuccuuuuccugcccaagcccuagaaucagccauuucuccaaggagcuccucuucuuggagaauaguauuuagagaccaggaucuggugcuggguaugcuuguugcuacuggggugucauugcuucuaggcccucucaauggacagagcuaaguaauauauguauguuauauauauguauguacuaacucauguauauacacauaucuauaauugauucugucugcuauauauuaaucuguuaauucuuaaucggauuuauucagcauguauuaaaugguauggcauuugaaauauguaauugcuuguacuuuauaaagcucagauaugcaacuuuacuuccugucaaaugcaugaaugugugaaagugaguuuggucacccaaagggauaugaaaaggcauguuucaauaucuuggauuacuuuuaguuuuaaucaugcaagucaaacaagaauuuuuaugaaggacguacugguuuagauaguggucaggugccccuguaguuaaguguaaucauguguugcuuaacagggauguguucugagaaaugugucauuaggcaauuugguugcugugugaacaucauacgguguacuuacacaaaccaacaugguauagccuacuacacuccuauucuauauggcagggccuauugcuccuugguaacaaaaccuguacagcauguuacuauagcuaauacgguaggcaguugcaacacaaugguaccuauuaguguaucuaaacauagaaaaaguacagggaaaauaugguauaaaagauaaaaaaugguacaucuuuauagggcauuuacuaugaauggagcuuucaggacugaaaguuacucuugaugagucaaugagugagugauaagugaaugugaaggccuaaggcccuuaccauacacuacuguagacuuuauaaacacuguacacuuagacuacacacuaaauuuauaaaaaaguuucuucaauaauuaaccuuacuguaacuuuuacacuuuguaaacuuuuauauuuuuuuaacuuuuugacucuuuuguaauaacacuuagcuuaaaacacaaacacaucguauagcuguauaagcaucuuucuuuauauccuuauucugugagguuuuuucuguuuuuaaaaauuguuauuauuuuuuccuuuuuaaacuuuuucuuaaaaaugaagauggaggccgggcuugguggcugacgccuguaaucccagcacuuucggaggccgagguggguggaucacgaggucaggagaucgagaccauccuggccaacauggugaaacccugucucuacuaaaaauacaaaaauuagcugggcaugguggcacacaccuguaaucccagcuacuugggaggcugaggcaggagaaucgcuugaaccagggaguuggagguugcagugagccgagaucacgccacugcacuccagccuggcgacagaguaagacuccgucucaaaaaaaaaaaaaaaaaaaaaagaagauggaaacacacacauuagccuaggcccacacaggguuaggauuaucaagaugucacuuagcaaugggaauuuuucagcuccauuaucgucuaaugaaaccaccacuguguauuuggucucuuguugaacaaagcauguuggaacauucuaugagguaccuuauguugcuuuuaaaaauauaaacagauuucuuucaauagaauuacacauuucuuuauugguuugcauucuaaaaacgaucaaauuuaguacaguugucucucaguaaaggggauuggucccaggaccccugagaauaccaaaaucuguggaugcugaagucccugacauaaaauggcauaguauuugcauaugcacauccucccuuauacuuuaaaucaccucuagguuacuuauaguccuaauacaaugcuauauaaaucguugucauacuguguuuuuaaaauuuauauuauuuuucauuguuguauuguuacuuuuauuauuuuuugaacauuuuugcucugugauuaguugaauccacagaugcagagcugguggaugggaagggccgacuacaguuuauuguuuagccaaaugguucuagacugcuguuuacauguuucugaucagaacaagcauugcaggacuuuaguuacagaaguccauggaauugauugcauagauuuaauggcugcccaugucuacccaaaggccuauuuugacucuugauucuuagccccauucugaagagguaagguuauuguauaguuaacagauggacaagacuuuuccuuccuuccuuccuuccucccucccucccucccucucugcuuuccuuucuuccucccuccuuuccuuucucccucccuccuccuuucuccuuccccucucuauuccucccucccccgucuauuccucccucccuuuccuucccuuccucccuuuccucucuucuucuugcucuguugcccagacugcagugcaguggcaugaucaugguucacuguaaccucgaacucuugggcucaagggauccuccugccucugccucccaauuagcuaggacuauggguaugugccaccauguccacacugaagaaauaaacaaagcuuccuuaaauaugugguagaauuuaccagugaagccaucugggcuuggaguuuucuuuguggaaaaguuuuaaauuauagcuucuguuucuuuaacagauaauaagggcucuucagguuuucuguuucuuugucaguuuugaugaauagugcuuuucaaagaauuuguccauuuuaucuaaaauuuaaaauuuguuguuuuaaaguguucauaauauccucuaauuaucuucuuuauaggauuuguaacgaggucuucuuuuaauucuuuguuuugguaauuuguauuuucucucauuuauuucuuguucagucuuaguagggauuaacaguuuuguuaauuuuuucaaagaaccaauguuuggcuuugcuuguuuucucuuguuaucucuucuauuucacuaguaucuguuauuaguuucucucuucuuuggguuuaguuugcuguucauuuccuaaccuuuuaaguuggaagcuuagaguggugguuuuuacuuuuucuauuuucaauaauuuucccuccagggacaguuuuggcaacccuucaugcuaucguucaguuuagaauauuuuucuaguuuucauugugauuugacaugcgggguuauuuagaaguguggugcuuuauuucuuaacauuuggagauuuucuaguuauuuuucuguuguugcguuucauguaaauucgguagugguggaaucuauggguugauuuuuuuuuucuaucagauuugaaaauucucagccauugguuuuucuaguauugcugauuucccauucuuucuuucuguuccuucugggcuuuuaauuaugcccaauaucucauacuuuuuuguguuugucuuuuucauucauuuuucucucugugcuugguuuggauauuuucuauugaccugccuucaaguuuguauuguguguuguuauacucauccaauuuagauaugguauuuugcaguuguagaauguucauuuuauucuuuuuuauggauuuuauuucucauaauacacuaucuuuuuaucccuuuucuuuuuuuuucuuuaacauguuuaucauaguuugaaguccuuaccuagagaugcuauucuuuggauuaccucugggucugcuucuauugaauauuuuaucucuugauuaguggcuacuuuuucuugcuucuuugcauguucaauaauuuuaaaauaugugcugaacauugugguugaaacguuguagaagcugugaauugucuucuuuugaaagaugucacauuuuguucuaagaggcaguuaaauuaucagcucuucaucuuuguucugucaaggccugguauaauguuuucuuagguuaggucuguuugagcuuuguuuauauuucuucagugugguccauuuuucuaagguguggucuuuguggggugucacuugaauguccaugaucuuaccaagauuucucagcuuuggcugggcuccaaugcgaacaacuaacuuuccagcacugacguuugggauuuuaauuuaccaguaucagcuuccuagugggucuccuguguuuuugucuaaucaugugcagcccuggaaaugagcaggaauggaugugaauuucuaagcagacuggugggguucccuuucaguagcuaccacgugucaaagcacucugaccccucaauccuggccaguuuuguucagaacucugaucucuuauuuucucuaacaaguaagaucaauguuuccuguuuagacuucacuuuaguacccauuccuagaaaaugcucccaggguaaaguaagucuugggggaaauguuggacuacuucauguuuucuucuuuuucagggauugcagccuuguguugauuucaguccagugccuacaaagaguuguuuuuuaugcaaguuaggccauucuuacauugcuauaaaguaaacuugaggcuggguaauuuacaaagaaaagagguuuaauuggcucaugguucugcagcuguacaagccaucugcucggcuucuagugaggucuugggcugcuuacagucacaguggaaaacaaaagacgggcagcaugucauguggugagagugggagcaagagagacagagugggaggugccacacccuuuuaaaacagaucucaugagaacucacucacuguuacaaggacagcacuaagggaauggugcuaaaccauucaugagaaauucgcccucaugauccagucaccuuccaccaggucccaccuccaacacugggaaucacauuucagugugagauuugguggagacgacauccagacuauaucaguauauuuuguucggauuuuaaaguuacuuaugguuggagauuaggucucauauaagcuguucucuguggccuaaagcugauuuccuuucauuuuguuuuauugacacauuaacugccuuuuacguuagauuuauugcuuugaguuauacuagaagaaacuuugguuugguugucauuauaguauagguccuguauuucagaaaacaagguuaauugggaaaacagcuuaugucaguuaauuuaugauguaaaauuggaucucuuaauugucuguuguguucuuugugcuucaaggaaucaucugcugcaguuugcuuuagagucaccagccaaaucuccugcuucuuccucuucaaagaaucuugcugucaaaguauauacuccuguagccuccagacagucuuuaaagcaggggagcagguuaauggauaauuucuugaucagagaaaugagugguucuacaucagaguuguugauaaaagaaaauaaaagcaaauucagcccucaaaaagaggcgagcccugcugcaaagaccaaagagacacguucuguagaagagaucgcuccagaucccucagaggcuaagcguccugagccacccucgacauccacuuugaaacaaguuacuaaagguaggaaguuauuuucauauguggaaauauggacaucuuuucauccacaugacauaagaauaaauaggcagcaucuuugagggggaaggaaugguaaaggacaaaccagauuuuaccauaucacaaaccucagacauuguuguagauauguuuguucucuuucucucucagaaacaggaauucaggcugacugcuacaaaaaggaaacaauuuuaauuaguucagccuucaaguauggcaguagcuuucuguuuucagcuuuuaaucuuucuuccccucauucaacauaucaguucccauuuaaucuugaaaagcucuuuuuaucuuauuuuaccaccacuugaaugccuccucacuguucugccugccauauaaagccugugacaauuugaggccuaaccuagucaucccgccuuauugcucaccucucugucucagaaguccugcucuagccuccccacuguuccuccaguacacugaggaauuggcaaacuacaacuggcagaucuaaucuggcuugccaccuguuuuuguaaauaaaaguucacauacccacccuauucucugugacugcuuucauucuacaguggcagaguugcaugguugugacagaggccauaggauccguaaagucuaaauucuaccuggcccuucacuaagaauguuugccggccccuguucuauaccuuuccagacucuauccagauccucacuauucauuuguuauguuagaaaacacugucucacaucacaaaagugcuauagcacuuguuuucuggacuguuuuguaucccauuugcuuaacuguuugaugaauaugucagcuuguuuaacuuuuuguuucuguaucuucuuuccagugaaguuuagagcaccuuuuaggcagaaacucuuagacaucuuugguauacccauaccacacguagugcagagaugugaguguguauuaaacuuagauugaaauuaguuuauuaguacuuaacguguuuacaucuuuuaaagauauauaaauuucacuuauauuuucuacuaugucuauccuuagucuuuuuaccaauugacaguucuuauuguaguauuuuuuagcuugaugguuaacuguuuuuccccuagcggaaccuuuuuucccaaaugaaauuuuacgauaaaccauaacguauaaaauagauaaaacagauuguucuguuccaccugaccuccuucugccuauuauccaugguggucuguaggccccgagauacccccacagaucccugcaacuuuaugaaauaguuugagaaugacuguguuccuuaauuuuaacauuauauauggaaucaucagugagagcuaaauuaacaaauuuguaaccauugacaaaauugaacucaauaaauuauuaaacuaccuuuccuucacucggcccuugggccaggugugucuuacuuaagucguuacuauugcuucugggcuaaacauggauagcuccuaaggguugggaaaauuuaagaugaguucuauaguuuggucauaccuugguagaaaagauguaaccgaaacauuuuuaauaaaugaacuuucaagcuuauuugcagucucuuucucugggaccaggacuucaauuuugugacuucccacaauuuagccauuacccaguaaccagucugucccacuccuguugucccgaugggccauucuuuuucuuuucugcuuuucuaagugcauguuaaguugggauucuuuuuuacuuuacuugcugaaaagaugccaguuuacauacuuuugccccuucuacaauuaauaaagucucucuuuuucuuuuuaaaaaauacaguggauuguccuguuugcgggguuaacauuccagaaagucacauuaauaagcauuuagacagcuguuuaucacgcgaagagaagaaggaaagccucagaagguaaggaaguugagcagaaccauugagcuacuuuagcugggugccucuugugcuuacuugggggaaaauuacaguauuccuuuuauccuggugaccguauuuccugcucuuacuugcuuucuucuuuacuccuguuggccacuucuuccaaucccucuccucuguucuuucuucaacucccacuuugccaaauaugauuagcuauauugaauauuugaacugcuacuaaauuuugacuuaauaagaaauuagugacuucaaauucaauucuuuuuaaacuuguuuuuuucucuuagauuuuaaaaacuaccaaaaagccucuuggccaaagaaagcaagguuagacucugaauauaagauauaaaaaaccuuucucugaucuuuaggaugcucagaaguuuuaaaauuuaaaauugaauuuuucaaaaaauuuugacuaggaaauuauauaaauauauaugauauaaaaagguacaaaaaugcauauaugaaauguaaugucauaccccacaccacccccccauccuccagguauuguagcuaauaaauugucagcucaguauuuacaucuaaacaacugugcuguucuaccucccuuguacaugaaaauaacuguaauuucucaugcuaguccacuauuguuacacauauaaguuguucaggaaugaaauacuagucaaacuuaaauugcaaggcauuacggaaucaguggauaauaagcagaagacacaauuuagaugagucuggugaugaagggagaaagaugagaugguaguuuggagaagcagugaguggcauaaagaucaaggguuguucuuuuuaaaaauaggaguuuaagccuucagucucuuuccuuccacuauuuccagggagagagcagaggauaaauggaagaaagugaggagcacaagagcccaguaaugagguuauccuugacaugcagaaaggacccuucugaaacaggaggcaagggcaagauaauaggugauaauucagagagauuuggaaaagaagaggagggaagcugaagaaauuaaugguaucugagaaguggggaugaaagaaugauuugcuucuauguucagucuguuuugaaggacuuugaagaguauuuuccaaaaaccauguuaauaagacagagccauaguauuauuuuuugugauuaaagaaaauacaucacuuaauuuuuaugaguaaauuuggagugaaugcagauucugagggucagauucauacuguuacaacuuacaaaagcuaacauauaagacacaauggugcuuuauuaagguagacauacuugaguccaaaccuggggcaguuuuacaugcacaguacucccaccuaguggguaaguuuguuaaugagaauaaaauuuagauuuuuagguugcuuaguggugauuuggaguaaaugaauaguccuaaggauuauuucccauaagccacgagaguuugaugaacugcuuuucucuuuagaaaugcaugaguugggaauauagaagcugaguauauucuuuuggaagaguaaggaaucugcacugauuaucuugcauggacuccccuuuuucuagauccauccaucaguucgaauacauuucugauacaucauuucugaugcugucaguuuguuugaagacauacucguccauguguaauuaaguucuaauagugguuuaaauuccugcuucaaagaacacuauaguccugccagugcucuguagugaacuuauaagcacuaccuccuggaucccccucuuaguguguuaaaggcuuugagaaguccuacauuaaggguuacuguuagguuuuguuuaauuuaguaauccuaaauuuauuugaccgccaagccuuucuguucucaucacuuccaucuuacaaaacugguguuuguggagauucugaagacaacacugggccauguucuucuuuaguuguaucuuggccacggagucaggucauagagaaaaggcccugugaguuuuccugucuccuccacaauauucugacaggccaucugcugaaugugaguggcagcccuuaacccuucuauauaaaaccaugucagaacugccucagauucugaggccccuuaaauguauuacucaguuccacuaaaucauggaagaaaaaucaaugucauuuucguguuuggggaaacauuuaucagguuucauguuuuaaaauuccugauagaaauuguugaucucugguggugcuuuuuauuguaaaugccagugaacaguacaguucuucacuggaauuucacagucacaguuuaaucaucuguccuugauaaaacaaauauuuuagauacagacguaaugaaucaucucucccugugugcuucuguaaacacaaaaugauucagcuguugcuaccuacugagauuucauuuugccauaauuuuaucaaccuuguagagucagauggguugucauuguaagaagagcaauuuucagaaaaauauaaucuauugagaguuugcaggucuuuucacaguuaauuaguuauuucuggcuuuuagacuuuguuaauacagcauaaaagacauaauuuauuuggggaauggcucuguugguuaauagagaaauuuuugauuguuuucagucuauaccugacuguaauauuucucuguuugauuauuggaccguuuauaucagauuuacucuggagaaccuuguugaaaauagagauuuuagagcuccacuucagaccugaacccuaauugguggaugguguggagaaggggauggagaaucugcguuuuaaauaaacucuuuaggugcuucuuagguacacuaacguuugggacagccuugugugagcuaguuauaugcaaauccuuuguaaaaacuuguuuuuuggauaaaccuauuauuucaaguuucuguuaauuuucaccugaaucuuugcuauucuuauuuugaaaugauagcaaguguaaugaccuccuugagcacauuuuuguuaagcaucuaauugccauaaagcugagccagguagagaaccugcuauaaucaggugaaaugaauuaaaacucacuaagaaguuccuguuuauggaauugcuuaagucauugguacuuuuauguagcuugaauuuuagcccacuagaauuucuagcaugcuuuaaagagguggaaaauugaauaggucuauguaagugugauucuaagugaaguccucacagcauauuccacaagcguuacauauaugucuucuaagugugccucuuuaggucugaccucuuuuugagacccaagucucucacuucuggugccaccuaggccccugugucugaaugucuuaccagcaccucagauacaucaugucagacacucaacuuuauccacaaacuugauuuuucucuccccuuuuuaaucuaaugguucuacuauuuucccggucacccagguguugaaucagaauuuauuugccauuuuacaugaaaagcauuugauaauucacaauaaucaucagguaucuuccccccuuuucaguucuguucacaaaaggaagccgcugcccaaaacuguauauaauuugcucucugaucgugauuuaaagaaaaagcuaaaagagcauggauuaucuauucaaggaaauaaacaacagcucauuaaaaggcaccaagaauuuguacacauguacaaugcccaaugcgaugcuuugcauccuaaaucagguaaaguaauaaaacagugaguuaugcuuacuuucuggauaaagcaauuuuguguagcucagaaauuauaaaccauagaaaaauauuguaaauaaauacauuuuugauagauaagacgugcaaauguguuccuucaaaagguaccuagaguaugcuaugauaagccagccuuccucucagccugccuuccaauccccagaucccuucucagaggcaccccauugccaguuucucaugugccuaucuagggagaaugugguggggaagaguggaucuggagagccuggguuacagugcccguuuuucagcuuuguggcuuggugacugugggcacguuacuugauaucucuguaccucaguuuucuccuucauaaaauaaggguuauaauaacuacccacuucauaauguugagugaaauaaaugauaaaaggcaugaaaagugccuaacacaguaccuuagcaaguaguuagcuuucaguaaauguugccauuaugauuauuguacacaaacauauauccuuuucauuacuguuuuuacaaaaugauaguauucuguguagugcacuauuuagugguugguucuuuucauuaaaccacacacauacauuggaguucuuucuauuaacauauagaauugccuaauuuuuaaaaacuuggagaauaacaugcaaacauuaaaacacacaaauuauaaguguauuguuuggugaauuaucacaaacuaaauuucauaaagugaaaugucauuguagccaguacugagaucacuaccagcgucccaaaagcccuaucugcccccucccauucacuccuucauucucacauuugaccacugucuugacuucuaaccccauauguucauuuugccuauguuugaucuuuaaauaaagggccaauagcuuauguauucuuuugugccugcccucauuugugcaacauuauaagauucauucauguuuuuuuauauggucauguuuuuuucauuuuuguugcuauaugguauuccauuguauaaacguaucaucuuauccauucaguguuuaauaaacauuucauuuuguucccacuuuuccucuauuaauaaugcugcuacaaauaaucuuuuauauaucuuguggugcacauaggugcauguugcuguuggauauauauauacaggaauggaauugguguuauauauuugcagauauucagcuuucauggauacagccccaaauucaguagucauguacacuuucaucaggagggugugagggugucaguuguucugcacccuugacaacaucaccacuguuaacucuccauuuuagccauucuaguggguccaugguaguaccuuguuauuuuaauuugcauuuccuuaaugacuuauaaauuuuauaugcuuguuggccaucuggauguccucuguagugaaauaccuguuuaaaucuauguccaauucuucuguucugugggccuauuuuuauucuuauuugugggaguaauugaaauuuccuggauaaaaaucuuuugcuggauguauguacauuucuaauuucaccuuuucacucucuuaauggcaucauugaagaguagaaguuccuaaaauaguccaauucauuacauuuuuccuuuugaucagugcuuugccuuagccuacuucaagaucauguggaucuucucuuguuuucuuuuaaaacuuuauuguucuugcuccuaaauuuugauguacgguuuaucuggaauugauuuuagcauauguugugagguagaggacaagauugucuuguuuucuuuccauaugaauaaccaauugaugcagcaccacucauugaaaugccaucccuucucccacugaauugccagaagucuuggcugagaaucagcuaauuguacauguguaggccuggacauuguuuuguuccauugggcuauuauuuaccguugagcaggauaaauaaugugugucuuaaguacuuuaugaguaauuuauaauaggucuugcugucugguaauauaguucuuccaguuuuguuuauugagguugacuuguuuuuucuaggccuuuuguauuuccauauaaguuuuuaaauugggauuacauugaauuuauagaucaauuuugagauaguugauaucuguauaguauuugagucuuccaauucaugaauaugguuuguccccuuuuuugucuuugauuuuugucaguaauguuuugcaauuuucagugugaaggucucacacaucuuuuuaaagaguuauucucugauauuuuugaugcagugguacacgauguuuuauucuaaaaugucaauuuuuauuaguugcuuguacacaaaaauacaacugguuuuucuauaguuuccuuauauccaauggcuugucgcuuuuuguaugugcccuuuuuauugauguauaacuuacucacauguaauacauccuuugaaaguguauaguuagaugaauuuaggcaaauguauauugucauuuagccauugcucuaacugaaauguagaacauuuccuucaucagcaaaaguuccagugccccuuugcuguauauucccucucuuuuacucuaagaccucaggaaacacugaucucuuuuuuugucccuauaauuuuaccuuuucuagacugucacauaaguggaauuacacaaauuguauaguauguagcauuuuacauaugguaucugucacuuagcauaauacuuuugagauuuuuccauguuguugcuuuuaccaguagugcauuuauuuuuuauuuuauuuuauuuauuuauuuauuuuugagacagagucucucucugucggccaggcuggagugcaauggcgcgaucucggcucacuguaaccuccgucucccagguugaagcgauucuccugccucagccucccgaguagcugggacuacaggugccugccagcacgcccggcuaauuuuuguauuuuuaguagagaugggguuucaccauauuggccaggcuagucuugaauuccugaccuugugaucugcccgccucugccucccaaaaugcugggauuacaggcaugagcccccgugcccagccagugcauuuauuuuuuauugccaagcaguguucugcuuuauagccaugccacaauuuguauaucccuucaccuguugauggacaacuggacuguguccaguuuuuuuauuaucaguaaagcuguuaugaacauggguucacaggucuuuauguaaccauauguuuucauuucucuuggguggaguggaauugcuggucauaugguaaauguaacuauaagaaccugccauacaguuuuucaaaugacugaaucauuuugcauugugagagagucccacuuuugccacacccuugcuaacacuugguauuuucauucuucuuaauuuuagccauucuagucaauguguaguagugguaucucaugaugguuuuaauuugcauuuuccugugacuaguggugucugcugucuuuugauaguuuuauuugcuauuuguauauuuucuuugauaaaggcuugguugaaauauucugccccuuaacucuuuuuauugauuuguaaguuauuuauauauucuggauacugaauuuuuaaaauauauguguugugaauauuuuaucuuuguauguggcuuaccuugucauuuucuuaaugaugucuuugaagagcagagaguuuuaauuuugacgaaauuuaauuuacuuuuuuuaugauuuaugcuucuuguguaucauuucaugauuuuuuauguauacaauuguguugcaugucaacaaaauauuugcuuauccuaagaucacaaaaaauuucuccuguguuauuuucuaggaguuuuauaauuuucgcuuuuauauuuaaaucuaugauccauuuucauuuaguuuuucuguaugguggaagguaaaugucaaaugucaaaguuuauuuaaaaaauauguauaucuaguuuuucagcaccauuuguuaaaaagacuauccuuuccccauugaauuacuuugcccucauugucaaauccuaacggccauguauauagcaugugaaucuaucuagaaucuauucuguuccacugaucuauauaucuguccuuucacucaugacacacucuugauuucuguaacuuuauaguaagucuuaaaauuaucagguaguauaaguccuucaacuguguucucaaaauuguucuagguccuuugcaaucccacauaaauguuagacucaguuuuguuguuguuguuccccuaagaaaugucaggcuauuauccauucuuguuguucaguguuuucugaacacugaguguagaaauagccacuuucacuucgccccgauguuacaggcauagcagagcaucugcaucugugcagcuggcagguccaggacagcaucugcagggcagucaguuuauuaguguguaccuuuugggauuuugagugagauuacauagaucagcuuagaaaugauaucuuaacaauauuaagacuuuuaaugcacagucgugguauggcucuuuaggccuccuuuacuuucucucaguagugcugucuacuuuuuuauguguguguguuccauguauuuuguuaaauguauccuuaaauauuucaugucuuuuggugcuauugugaguaguuuuaaaauuuuuauuucucauuguuuauuacuauuuuaaagagucauuuugacauuuauuuuuguauauuuacuuguauacuauuaacuagugaaacucauuucuaauugcuuuuuuauagauuucauaggauuuuuauauacacaaucaaguuacaugccaauaaaaacaguuuuauuuauuuauuuuuuucagucgauaugccuuuuauuuaucuuucuacccuugguuaguugcauugguuagaaccuccagugugauguggaauaaaaguggugugggcaaacauccuuuccuuucuccaaucuuuuuuuuaaaugaauuucuuaagaaaggaucucugacuuucaucugauuuuucaagggucugucuccccagaaggaagaauaauugccuucaaaaaucauuugagugacaguacuauugcaucaauauauguucuuuuaauucuggaauaccccaacuuauagguaaaacauuuagucuuucacuauuaagugugauagguuuucauagaugccuuuuaugagguugaggacauuucuucccuuccuaguuuauuauuaugaaggcguguugaauugucauuuccuuauucuacaucuauugagauuauuauauuuuuauuuauuuugugauaugauuuauaacauugaguauuaaucaguuuauugaaauauaauucauauaauacugagauauaauucauacccaccugaaguguacauacaguucagugguuuucaguauauucacagaguuguacaacuaucauauuaaauuuuagaacauuuuguuacccugaaaagagcccaguauccauuagcaucauuaucuaccaacccuuccagcccuagauagccacuaauuuacuucugucucuauagaguugucuauucuggauauuccauuuaaguggaaccauauagcauguggccuuuuauaaacuaacuucuuucacuuaguauaauguuuucaagguuuaucuguggucaauacucacuuauuuuucauugccaaauaauauuccauuguaugaauaugucacaucuuugugucuguucauuaguucaaaucugacauuuuuccacuuuuuggcuauuauaaauaaugcuguuaugaacauuuauguacaaauuuuuaugucgacauauguuuucauuucuauugugucuuuaccuaagaguagaauugcugaguaguaugguaauucuauuuuaacauuuugaggaauugcuagacuauuguccaaaguggcuacaccauuuuacauccuacuagcaguguauaagaguuccagcugugccgggcgcaguggcucaugccuguaaucccagcacuuuguuugggaggccgaggcagguggaucaccugaggucaggauuuggagaccagccuggccaacagggugaaaccccgucucuacuuaaaauacaaaaaauuagcugggcgugguggcaggcgccuguaaucccagcuacucaggaggcugagacaggagaauugggugaacccaggaggcggagguugcagugagcugagaucgugccauugcacuacagucugggcaacagagugagacuccgucucaaaaaaaaaaaaaaaauuaauuccaguugcuccauguccuugccaacaccuguuagucugucuuuuuccuagugggugugguauugauuuacauuacagugauuaauuuuugaauauuaaacuaaccauucaucuuuagcaaggaauguguucauuucaucuaaguuguugaaucuauagccagaggguucuuuuuguuuuuguuuuuuuaaguaacauuuucuuguuaaccuuuuaauaucuaugggguuuguggugauuuacugucuuucauuuucuauacugaaaaugugucuucuuuuuuccugauuguucuaccuauaaguuauuaauuuuucucguuuuucuaaagaaucauccuucagcuucauuuuucucaaauugcuuuuucucaguuuuugucuguuuuccuauuucauugaauuccagucuuuuaugauuuccuucuuucuacuuacuuuagguuuaauuugcucuucuuuuuuuagcuuauuaugguggaaguuuagauaauuucagauuguucucgauguauuuaaaauacagauuuuugucuaagugcuauuuuaccucuauucacagacauugauagguuguauuuaccuucccauccaguuaaaauauuuucuaauuuuuguuguguauucuucuuugauucauauguuaaauagaaguauuguuuaauuuuuaaagauuuugguuauuucuuagauaccuuuuuauuauucauuucuaauuuaauucaauguuggccaaagaaccuguucuguaucauuucagaccuuucacauuuacugagacaugcuucauaacuuagguguuaggucuuccuggugaauauugcauaaauacuugaaaaguuugcuuuuuugugcagugaucuguaaaugcuauguaaauuuacuugauaguauauucaagucuucagcauccuugcugauauucuguuuacugauucuaucaauuacugagaagcuuuuugaaauauccaacuauauuuauagauuuuucauuuucccugucaauauuuucaguuuuguuauauuuugaaucucuuaguauuauuauguaucuucuugauuaguuagccuguuuauuauuauggcauauaugucuuugucucugguaauauuccuugccucaaaaaucuaucugauaugaguauagcagcuacuuuauuucauuuuucuuuaaaccuauuauaccauuauguuuaagcuguguuuuauuguaagccguauaugguuuggauuuuauuuuauaauuuaauuugacaagcucuaccauuaaauuguaggguuuaaacuauuuuaauuucauuuauucuauuugguuggguuuauaucugccaucuugcuuguuugcuguucuaucauucuuuuguuuuuucuucauuuccugcuuuuuuuuggauuaacugaguauuuuuuaguuuuuuauguuaucuucauuuuacgagcuauacuucuuuuuguuuuuuuguaggggugauuguucuaguuuacuauaugcauuuuuaacuuaucucagucuaccuucaaugaauaguacacuacuucauguauaauggaaggaccuuaagacuuucauucuuuuuuuuuuuuuuuuuuaaguuuuaggguacaugugcacaacgugcagguuuguuacauauguauacaugugccauguuggugugcugcccccacuaacucgucauuuacauuagguauaucuccuaaugcuaucccuccccacuccccccaccccaaaacaggccccagugugugauguuccucuuccuguguccaaguguugucauuguucaguucccaccuaugagugagaacaugcgguguuuggcuuucuguccuugcgacaguuugcugagaaugaugguuuccagcuucauccaugucccuacaaaggacaugaacucaucauuuuuuauggcugcauaguauuccaugguauauacgugccacauuuucuuaacccagucuaucauuguuggacauuuggguugguuccuagucuuugccauugugaauagugccacaauaaacauaugugugcaugugucuuaauagcagcaugguuuauaauccuuuggguauauacccaguaaugggauggcugggucaaaugguauuucuagcuguagaucccugaggaauugccacacugacuucuacaaugguugaacuaguuuacagucccaccaacaguguaaaaguguuccuauuucuccacauccucuccagcaccuguuguuuccugacuuuuuaaugacugccauucuaacuggugugagaugguaucucauugugguuuugauuugcauuucucugauggccagugauggugagcauuuuuucaugugucuuuuggcugcauaaaugucuucuuuugagaagugucuguucguauccuucacccacuuuuugauggguuuguuuguguuuuucuuguaaauuuguuggaguucauuguagauucuggauauuagcccuuugucagaugaguagauugcaaaaauuuucucccauucuguagguugccugcucacucugaugguaguuucuuuugcugugcagaagcucuuuaguuuaauuagaucccauuugucauuuuuggcuuuuguugccauugcuuuugguguuuuagacaugaaguccuugcccaugccuauguccugaaugguauugccuagguuuucuucuaggguuuuuaugguuauaggucuaacauuuaagucuuuaauccaucuugaauuaauuuuuguauaagguauaaggaagggauccaguuucagcuuucuacauauggcuagccaguuuucccagcaccauuuauuaaauagggaauccuuuccccauuucuuguuuuugucagguuugucaaagaucagauagucguagauaugcggcauuauuucugagggcucuguucuguuccauuggucuauaucucuguuuugguaccaguaccaugcuguuuugguuacuguagccuuguaguauaguuugaagucaaguagcaugaugccuccagcuuuguucucuuggcuuaggauugacuuggcaaugcggguuccuuuuugauuccauaugaacuuuaaaguaguuuuuuccaauucugugaagaaagucauugguagcuuaauggggauggcauagaaucuauaaauuaccuugggcaguauggccauuuucaugauauugauucuuccuacccauaagcauggaauguucuuccauuuguuuguauccuguuuuauuucauugagcaaugguuuguaguucuccuugaagagguccuucacauccuuuguaaguuggguuccuagguauuuuauucucuuugaagcaauugugaaugggaguucacucaugauuuggcucucugucuguuauugguguauaagaaugcuugugauuuuugcacauugauuuuguauccugagucuuugcugaaguugcuuaucagcuuaaggagauuuugggcugagacgaugggguuuucuagauauacagucaugucaucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauaaauagcucuucuuauuuugagguacgucccaugaauaccuaauuuauugagaguuuuuagcaugaagggcuguugaauuuugucaaaugccuuuucugcaucuauugagauaaucaugugguuuuugucauugguucuguuuauaugcuggauuacauuuauugauuugcauauguugaaccagccuugcaucccagggaugaagcccacuugaucaugguggauaagcuuuuugaugugcugcuggauucgguuugccaauauuuuauugaggauuuuugcaucgauguucaucagggguauuggucuaaaauucucuuuuuuuguugugucuuugccaggcuuugguaucaggaugaugcuggucucauaaaaugaguuagggaggauucucuuuuuuucuauugauuggaauaguuucagaaggaaugguaccagcuccuccuuguaccucugguggaauucggcugugaaucugucugguccuggacuuuuuuugguugguaggcuauuaauuauugccucaauuucagagccuguuauugguuuauucagagauucaacuucuuccugguuuagucuugggaguguguaugugucgaggaauuuauccauuucuucuagauuuucuaguuuauuuguguagagguguuuauaguauucucugaugguaauuuguauuucugugggaucgguggugauauccccuuuaucauuuuuuauugcgucuauuugauucuucucucuuuucuucuuuauuagucuugcuagcagucuauuaauuuucuugauuuuuucaaaaaaccagcuccuggauucauugauuuuuugaaggguuuuuugugucucuauuuccuucaguucugcucugaucuuaguuauuucuugccuucugcuagcuuuugaauguguuugcucuugcuucucuaguucuuuuaauugugauguuaggaugucaauuuuagaucuuuccugcuuucucuugugggcauuuagugcuauaaauuucccccuacacacugcuuuaaaugugucccagagauucugguauguugugucuuuguucucauugguuucaaagaacaucuuuauuucugccuucauuucguuauguacccaguagucauucaggagcagguuguucaguuuccauguaguugagcgguuuugagugaguuucuuaauccugaguucuaguuugauugcacuguggucugagagauaguuuguuauaauuucuguucuuuuacauuugcugaagagugcuuuacuuccaacuauggucaauuuuggaauaagugugauguggugcugagaagaguguauauucuguugauuugggguggagaguucuguagaugucuauuaggucugcuuggugcagagcugaguucaauuccuggauauccuuguuaacuuucugucucguugaucugucuaauguugacagugggguguuaaagucucccauuauuauugugugggagucuaagucucuuuguaggucucuaaggacuugcuuuaugaaucugggugcuccuguauugggugcauauauauuuaggauaguuagcucuucuuguugaauugaucccuuuaccauuauguaauggccuacuuugucucuuuugaucuuuguggguuuaaagucuguuuuaucagagacuaggauugcaaccccugccuuuuuuuguuuuccauuugcuugguagaucuuccuccaucccuuuauuuugagccuaugugugucucugcaugugagaugaguuuccugaauacagcacacugaugggucuugacucuuuauccaauuugccagucugugucuuuuaauuggagcauuuagcccauuuacauuuaaaguuaauauuaugugugaauuugauucugucauuaugauguuagcugguuauuuugcuuguuaguugaugcaguuucuuccuagccuugauggucuuuacaauuuggcauguuuuugcaguggcugguacugguuguuccuuuccacguuuagugcuuccuucaggagcucuuuuagggcaggccuggugguaacagaaucucccagcauuugcuugucuguaaaguauuuuauuucuccuucacuuacgaagcuuaguuuggcuggauaugaaauucuggguugaaaauucuuuucuuuaagaaugcugaauauuggcccccacuuucuucuggcuuguaaaguuucugccaggagaucagcuguuagucugaugggcuucccuuuguggguaacccgaccuuucucucuggcugcccuuaacguuuuuuccuucauuucaacuuuggugaaucugucaauuaugugucuuggaguugcucuucucgaggaguaucucuguggcguucucuguauuuccugaaugugaauguugggcugccuugcuagacuggggaaguucuccuggauaauauccugcagaguguuuuccaacuugguuccauucuccccgucacuuucagguacaccagugagacguagauuuggucuuuucauauagugccauauuucuuggaggcuuuguucauuucuuuuuauucuuuguucucuaaacuucucuucuugcuucauuucauucauuugaucuuccaucacugauacccuuucuuccaauugaucgaaucggcuacugaggcuugugcauucgucacguaguuuuugugccaugguuuucagcuccaucaggucauuuaaggacuucucugcauugguuauucuaguuagccauucgucuaaucuuuuuucaagguucuuaacuucuuugccauggguuugaacuuccuccuuuagcucggggaaguuugaucaucugaagcguucuucucucaacucgucgaagucauucucuguccagcuguguucuguugcuggugaggagcugcauuccuuuggaggaagagaggcgcucugauuuuuagaauuuucagcuuuucugcuguuuuuuccccaucuuugugguuuuaucuaccuuuugucuuugaugauggugacguacagaugggguuuugguguggaugaccuuucuguuuguuaguuuuccuucuaacagucaggacccucagcugcaggucuguuggaguuugccagagguccacuccagacccuguuugccuggguaucaccagcggaggcugcagaacagcaaauauuggugaacagcaaauguugcugccugauuguuccucuggaaguuuuguuucagagggguaccuggccgugugaggugucagucugccccuacugggaggugccucccaguuaggcuacuugggguucagggacccacuugaagaggcagucuguccauucucagaucuaaagcugcaugcuggaagaaccacugcugucuuccaagcugucagacagggacauuuaagccugcagagguuucugcugccuuuuguuuggcuaugcccugcccccagagguggagucuacagaggcaggcaggccuccuugagcuguggugggcuccacccaguuugagcuucccagccuccagcaauggcaggcaccccucccccagccucacugccaccuugcaguuugaucucagacugcugugcuagcaaugagcgaggcucugugggcguaggacccuccgagccaggcacgggauauaaucuccuggugcgcuguuugcuaagaccguuggagaagugcaguaguagggugggagugacccaauuuuccaggugccaucugucaucccuuuccuuggcuaggaaagggaauucccugaccccuugugcuuccccggugaggcgaugccucgcccugcuucagcucacucccggugcaccgcucccacuguccugcacccacuguccgaaaauccccagugagaugaaccugguaccucaguuggaaaugcagaaaucauccgucuucugcgucgcucaugcugagagcuguagacuggagcuguuccuauucggccaucuuggaacugccccugacuuucauucuuuguacuauuuuugucauagauuuuucuucuauguauuuuaaacacucuauaauaccuuguuacuauuuuugcuuuaaacuaaauaaaaauggaaaagauaaauaaaaaauggaaaagaaggucuguguuuaccuacacauuuaccauuuucagcauucuuuguuucuuuguguagaucuggguguucaucuggugucauuuucuuuugccugaaaaaacuucauuuuuuccuggauuuccacaguguuuggacauuuccugaaaaacuuuauuuguucauucugucuuguuuuuuuuuaaagauagggucuugcucugucacccagguuggagugcaguggcgcaaugauaguucaccgcagccucggacuccaggaauccuccuguuucagccugccagguagcuaggacuacaagcgcaugcccagcuaauuuuuguuuguuuguuuuguagagacagggucucacuguguugcccaggcugauguugaacuccuagccucaagagauuccccugcuuuagccccccaaagugcagggauuacaggcaugaacauugugccuggauuauucaauauuucuuguagugcagaugugcuguugagacagauucucucagcuucuguuugucugaaaaagucuuaauuuugcauucuuuuaaaaaacuuuuuauuuggaaguuuauaggaaaguugaaagacuaucauagugaaugcauagacuguacccuuuguacagauccaccuauuguuagcauuuugccucauuugcuuuaugaauuacucuguuccucuuucucucuuuuucugugaauguguguauguguccauauaauuacacacauauuuucuucuuuaacugccugaaaauaaguuauauaguguuuacccuuuaccccuaaauauguccuuguauuauuucuuaagaaaaaaagauucucuuuuauugccacuguaguuaguacuuguaguagauuuaacuuuguuauaauacuuuuauucaucuauccaguuuuguuaguggacccaauaauaaccuuuguagauuuuuuuuccugcaguacaugauccaguuuuggaucacauauugcauuucgugguaauaucuuuucaaucucuuucaaucuagaauaauuccucagccuuucuuugucuuuuaugacacuggccuuuuaaaagaauacagucuuuguuguguguguguguuuuucaaguaaaaucuucucauucuggcagaaaauucagauuaugccuuccuggccagaauacuauauaagugauguuuugucuucggaauauuacaucuagagccauuugacaucuguguaccccucauuugugauaucaggccugaucaccuggccaguuucucucugguuuauacuuuacauccgcugccuugcuacuaauaagaagucugcagagacacuucaacacuauguagcuauucuauaccucauuaagauuucaccccuauauuuagcauccuuugguaauuuuucucuaaacuauucuuuucugugauaguugcaaaaugaugauuuuucaacuuuagcauugguuucacaguugcuaauugauacuuggcaugauucugaaaacaagagcccuucccucugccuuauuauuauuuucuuuuucuuuuuuuuuuuuuuuuuuuugagacggagucucgcucugucguccaggcuggagugcaguggcacgaucucggcucacugcaagcuccgccucccagguucacgccauucuccugccucagccucccgaguagcugggacuacaggcgcaugccaugccuggcuaauguuuuguauuuuuaguaaagauggcauuucaccguguuagccaggaaggucucaaucuccugaccucgugaucugucugccuuggccucccaaagugcugggauuacaggcgugagccacugcgcccggccugccuuguuauuuucuuauuugucucuuaugaauauggauucacagauuuuuaacucauuacuucucuuaauuauuuucguguuuguauuuuuccacauuuggccagcaggagugucuucauucuaauuccuguccucaugacauacacccccauuauuuucauuaccgucuucuuauuucuaacauaacaagauauugcagacuuuucuugcucuuccaugccccagcccugaaaucagccauuucuuugaggagcgcugguccuuuuuauuggugaaaccaagauauggcuaccagcuaugcucauugcuacuuggugucuuugcuucuaggcuauuugagcagaugaagcugggaaauauaugcauauaugugcauauauauacauacgcacacguggauacauauauacauacacaugcauguaugcauauauauacauguaaauccauguacacuuacauguuucaaggcucucaaaaguauuucauacuguagcaguuuuguuuugucuccagagcauuaauugccuguuggaucauuuuuaugaugguagcuuuaaaauucuugucagauaauuccagcaacuggguugucucagguauuggcaucuugucuuuuuucauucgagucgugauuuuccugguucuuaauaugucaaguuuuuuuuuaaauuguauucugaguauuuuuuauauucuaaugacauucuagguucuauuuaaauauucuaauuuagcaggaagucaucuuguuuaaguuuagcaugcagauccuggccuauuuuuguaggcugugguucuaaugaugauuuaguucccagaucccuugaaauguuauuuuggucuacuuuauuuaauugcuaccuagagacuguugugaauaccugauauuccacacugugguucaguuuucaaaccuuuuggcauauuaauuguaaacaauuucacauguuggucggggaugcccugcacaggcugaaggaauucuuuucuccaguuuccuucucuuugauauucucuucucaguuauuaguugagagggugcaguugucagcugccaucauuggaugggguguagaagucugagcuccucacuaggcuuccacugacauuguugcuaugggaggacauccugcacuaggaccccuuccaccucugguugauggguagaaguccaugcuccccacuugcucucugauaauacugcacagggcagggagcaucagcaguguuuugcuuggguaggucaaguauuaucaagguuucuggguacccucuuuuucaguccuuugcuuauaaagaguagauuuuucuugaggcuuuuuugucuguuucucuugauggcucuggacuucuccagagcauagucuauaagauacagaauacaaagacaccccagggugacacacagugucauuccucacaugcugagaucuuagccaguccaucuuccucuuucuacuuuccagaguucucuuauaguugucuguuauauaucaggguuuuuaguuguacuuagcggagaaaugagucuaauccaucuuguuuggaagaagaaauacuuuuuaauguauuuuaaauuucuguuuuaggggcaaacacauuuaagauuaugucuucuugguaaauugacccuuuuaucacgauauaauuucccuuuuuuuuuuuuuuuuuuuuuugagauggaguuucacucuaguugcccaggcuggagugcaauggcaccaucucagcucacuacaaccuccuccuccuggauucaagcgauucuccugccucagccucccaaguagcugggacuacaggcaugagccaccaugccgugcuaauuuuuguauuuucaguagggacgggauuucaccauguuggucaggcuggucucgaacuccugaccucaggugauccacucgccucggccucccaaagugcugggauuacaggcaugacccacugcgcccggccccuaauuucacucuuuaucccugauaacauucauuguucuggagccuauugcgccucauauuaauaaagcuccuccagguuucuuuucaugacuguuuacaugagacaucucuuuccauacuuuuauuuuuaaccuaucuuuuuauuuaaaauggguuauuuuugauaguauauaguuuggucuugcuuuuuuauccaaucugacauccucugucucuuaauugguguuuuaaaacccuuucuuuaauguaaauacuggugcaguuggcuuugaauuuaauaucuugcuguuuuuuccuuuguuccgucuccuuuuuguuaucuuuuuuugcuguuuuuuggauugagcauuuuuauuauuauauuuuauuucuauuauugucuuauuacuuuaccucuuuuucaaaaaauuuuaguguucucucuaggguuugcaguguacaucuuucauuaguuacagucaaguaauuauacagccucacuuguaagaaacuuuuaacagcauacucccaacuccuaauucuuuguauuguuauugucaugaauuccuuuuacauauacuguuaaaccauuacauugcuauuguuuguccauuaaacaguuaucuuuuagaguaguuaaaaacgagaaaaaaguauauuuuauacuuaucuucauguuuaccauuuucaccaguuuucauuucuucuuagguaaguuucucucugguucuucuaauugaagaacuuguuuuaauacuuuuuguaauggagggcugcuaauaauacuuucucucagcuuaugauuuccucagaaaguuuuuguguuucacuuuugaaagauauuuuuauuagaauucuggauuggcgggcuuuuuucuaaugcuuuaaagaugucacucuauuguuaucuggcuugaauaauuucugaugagaaguguaauguaauucuugauuuuucuuuauauaaugugucuuuuuccucugauggccacaugauuuugucuuugugucuauaugcauguuguugucauuuuggguuuguuuuuauaucuguguugcuugaucuuugaaauucuugcauuugugguuuggugucuuucuuauauuuggcaaauucuagacaguucuucaacgauuucuucuccucccuuuuuucuucuucugugauuucuauuauguguauauuucuugauauugucccauagcucuuagaggcucuguucuguuacaauuuuuuuucuuuuuccuuuuuuucucucucuguguuucagauuggauaauaccaauccaauuuuagguucacugauucuuuccuuagcugagucaaguuaucuguuacuguguugguuuuaugugucuauaucuauauaucuaacauuucuauuuuauucuuucuaaaaaaaaguauuuccauugaaguaauuucuacagaaaugccccaucuguucauguauguuguucaucuuuucuacuagauccuguaucaucuuaaucauaauuugcugcuuuuucauguuuaaguuuugauugaaagccagacaguguagguaagagucugaggugccagacuuuuuuuuaaaauguagcuauauaucacucacaacuuagguuuucccuaugagccugugccucagagagggucucucuccauguucauuucucuccuagaaguagauugcuguuacguaucacuuggaucaugcuagguuuguggcaggcagaaaaggaggguucucuguuacucugauuuagcuucagucuuaggcaggucuuucaauccugcaucucagagcuggggcuuuuucagcgauccugccccucucucacugccaggggcagggguccucuaugggucagggcccagaaugguuuccugauccuccugaaggguagaggggguuuuuuguuuguuuuuguuuacuucccucagcaaccgaugcucuggggauaacauuuuugcugaccuuucgucaguggcuuaaugcuuuuuuucuucagggauaaagaugugauuggggcuucauguccauccugcagugggggugguucucuuuugccaggaauggaucuggaggaagaucuuuucuaauuugcugcccuuccccagugagcuacagagagacugaggacucuugugggugcccacugaggucuguagaaaauagccugcaaggccaggugcgguggcucacgccuguaaucccagcacuuugggaggccgaggcggguggaucacgaggucaggagaucgagaccauccuggcuaacauggugaaacccugucucuacuaaaaauacagaaaauuagcugagcgugguggcaggcaccuguagucccagcuacucgggaggcugaggcaggagaauggcgugaacccggaaggcagagcuugcagugagccgagaucgcgccacugcacuccguccugggugacagagcgagacucagucucaaaaaaaaaaaaaaaaggaaaauagccugcaaauggaugugaugcccgcuguguccaagccacccaaaauuuuuauauuuucaugguagcucacccuuggucuuuugcaguucaucaaaaaguuuagcugagaucuuacccagagauagggugguaccaauuuuucucugguguacuguccuaugucaaccagugcucaugaucccucucucuucuaaggcacucaucuuuguuuagguuucaggcuaguugauugcccucuuacuuuagcucugauggauucaagaaaaauuauaguuuuauaaguuaucccgcuuuuucucgucauuagggugagagugacauuauuuauagcucucuacaaccuaaacagaaucagaaaucucccugaagaagauuuaagccacuaaauucuacccaauccuaauauaguuuucuuuuuuuuuuuuuuuuugagacggagucucgcuuugucgcugggcuggagugcaguggugccaucucaguucacugcaagcuccgccucccggguucacgccauucuccugccucagccucccagguagcugggacuauaggcgccccccaccacacccggcuaauuuuaaaaaauuuuuuuuuauuuuuaguggagacgggguuucaucguguuagccaggauggucucgaucuccugaccucgugauccacccgcuucggccucucaaagugcugggauuagaggcgugagccacugcgccuggccuaguuuucuuaauaucuuacaagaggacaugccagauguucucugucuuuagugauacuuguauuaauggauuggauagaaugcaaauggucccuguguuuuucauguuauuccaugacucauuuuggaaaggagagaaccacuagcuggucaucuucacagagagauuguuuacauuguuucuacugauuuuacaauaucaaggaggcaaaagguaccucucagugcucagaaaacguaaacuuuguauugagacaguugcauucuuaaaugaucgucauaaggucugugguuuaaaaaaaauaaaacuuuaauggggauuauuucaaacauauacagaaauagagaaaagaguuuacugauuuccccauaugccuacuacccagcuuaaacaauuaucacacugucugaauguuguuuuaucuaccauuuacaccccuuuuucuuccauggauuauuuugaagcaaauuccagauauaauuuuuaaguauaaaugaggguuagggauuguagauuuuuauuuccuaccauaugcauuucaguuuuaauguauugacuuuggaugcagaaagauagcauuugcaaauucugugcuguuugcauucaaaggcauuuaauguuugacaggguguauuccagaucucuuuuauguauguaauuggauugguaacauaccuacagacaaagguucuggaggcaaggacauuuuuccugguauuuguagaccuuuuucucuccuugaacaguagccuguuguacugcauuuaguacauuggaauuugagcagacauccccuaauaauugaacucacacuaaaaaauuaauuuucauauuucacugagacuucuguuuagaccuguauauucaaaggagaaagcaaaaugacuugacucuugugguuauacguugaacagcaugugcauguguaagaguucaguguuuuaacuccauguuauuuuuuuaaccuuuuguuuugaaaugguaauugauucacagaaaaauuguaaaaauagaucagggaguucacauauacccaucacccaucuucuucuaauguuaacaacuuaaauaauuauuguacagugauuaaaaaagacaugugauuaaccuagugguuauuuucuuauuuuaacagcugcugaaauaguucgagaaaucgaaaauauagagaagacuaggaugcgucuugaagcuaguaaacucaaugaaaguguauguuaaugggcuauuucaguauauggauagaaaugaagaaaguuuaauacccuacaaaaauuaaagcaagccauuauuaaauuuauucauuuacuaacacauuuccacuuaguguauuaugauuuacuugcaacucauuuuaggacaauauuugauuguacuuagcagucuucuagcacaaaaugcaauccaaaguagaguuuguucaugagcuagaguucuauagaaaaugccugugccugugcaucaggcagcuuugauauugguccuuucucugcugguuguguuugauaagcuaccucuaaggaccucuaagcuacugcuagggaccucuaugaucccuuuuuagcucuggcauucugcaauucuaugauuauacuuauggaaauguuaaguaauuauaagaggauaaauuaaguaauuugaggauggaauauucucuugagcuuuggagggaaucagagaccuaaaauucuucacuguugccuuccacuagcuugaugccccaaacuugaagacaggauaccagugaagaaaauagucauuguguccugugacacuggagaaaguguuuuggucucuuccaaguagacuuuuuuuuuuucuaggccauuuguaguguguuuguaaggagaaagcaaugguuaccuuaagaaaguaaguuuguaaccaaauaaguaggaaaaaaaugggauuuacauugacccuauuauuaccugugugcuaacuguaagaugggaacugcagugaaucauggaagcagauuucugaucuuuuaagucugagguuuaaaaaguggaccuagaggcuuaacuuacuguguuuuguauuauugcauuuucuauacauacugcuuuucuauaaugaccuggagaaguuagauuggaaaggagagaaggcagacaagaagaucagccuuacuaauagucagcuaagugucguuagucuucugguuucaaauauugccuguuguauuaaugaaugugggauauuaaauauugaaaauagaaaauuuauuauuuuguuaauauauaauugaaucauguugcauuuucuacugaugagaaaaaauaaugaguaaaauguauaccauuucugguauuuaagggaaguacauaggaaugauucuuccuaggucuauauaaaacagaugagagaucauuuuccucuauuuuaaacacucacauuugagauuugaagguuuguaauauuucccuuuuugucauuuuggggagauuuuuauuaaggucuuuuuuugauuauuuuagguaaugguuuuuacaaaggaccaaacagaaaaggaaauagaugaaauccacaguaaauaucguaaguugcacgacuuuauuuaauuuguaaagagcuucaguugcuguuuuucaucuuaaguaauuuuucagaauaauguuuuauauuaagguucaauucaaacuuuuguuaacauuacuuaagagauugaauuuuaauuggguguuuacuuagugacuuuuuuuguauuuuauaugccugcuuuuugauuuuuaugacuagcauucuacuuugagcuuaucacuaagcacuuugcaaauauuaauuagcugcucucaaagcauuucugugaaaagaagcugggauuaaaauggaaacauucgggacucuauccuguccucaggccacucaguaacaauacuucuguauaggauuucaaugcuucuauagcuugcaaauuugugccaaaaauaguuuucauuuuauugcuuguuagcaaccucccaacuuuaucacuuccuuuuccuuaaauggucuucguguauaucuuucccagggcuaacacauuacuguuuugucagauagcuguuacucuuuguguggugguuggauuuuaguuuaaauuuaagugccugacgaacaguagauaguuaauagauguucauugaaucaguauucccaggcaugguauguuuuaauugagguaagauaauuuuuuucucucuucauuucuuaaacucugaagggccagguucuguagugauguauugugggagggaggaugaagcacaccugcgcuggauguaggugugauugccugugccuugcuagaguaggaaaaggacccuagaggagucuuggauuauggacugaacaacaaaagucaccauuguucuguugcuggacagauaaguaugaugugaaccucuuugaucaacuuguaggaugucagagugauuuuucuuuagaaaggagaacaaaagagaauaucaaaugaucagugaauuggccuggaaaaauaaggaucacuaaggccugugaaaauaaggaaaccagaaaacuugcauugggagaaaguaauuuaaauaacugaaagggugguaucuaauaauccucccauauuaagaaaaauuuggacuauauucagucaaguaaauauucauugcccaccauuuagauaucuaaaaaguguaacuuuacuaaauaggugguauuaauuuauuuagccuuaaaauaaaccucaaaagucaagugcuucacaaagcuuagaugcuuagccuuuuaguuuauucauacauuuugauuuagugucagguucuaacuauacuauugauauaucuucaucuuuaaacauuuuauuaauguuuuacauguaguuuuuaaaaaaucauuuacuuuuuaugagccuuaucauauaaaagagcagucucuugcauccuccaacaaccugccucuauucccauucccuagagguaacaacuaucaagccauuuggugcuacuuuugguaauuaccuuacaauuuauaaaaaaguauuuuuucugcuacuucuugaaguuuuucaauuucacauuaacuauugaugugcuaauaugaaagauggagauuuagcucauuuauauauccugagcccuaccuuugcuucccuuccauccuuuaaauauuaugucauaaguuuuuguaagcucaguauuuaguuagauacauuguuuauggcucaagccagacaauuugcauaagaugguuauaauuccuuucaucaaaacauucuguuguucuuuuuuuuuuuuuugagauggaggcucgcucuguccaggagugcaguggcgcuaucuuggcucacugcaagcucugccuccuggguucacgccauucuccugccucagccuccugaguagcuggcgccuccugaguacaggcgccugccaccacgccuggcuaguuuuuuguauuuuuaguagagacgggguuucaccguguuagccaggauggucucgaucuccugaccucgugauccgcccgccucagccucccaaagugcugggauuacaggcgugagccacugcaccuggccuuguuuuucuuauaacuaauaauucucuuuuguuuguuuaacuauuuaccuaguacuaauauaucucuaaaccuuccaacagaaguguaaaucacuuuccaauacauuuacacacauugauuauaacucauuauuuucucaagaacgucucuccuagggccaccccuagccucuguuguccuguuccagucuacuaugcuuguccuuuuugccuucuguuaauacauggcugcucuucuggaauuucuugucaccaacuuucugggaauucugcucuccuccuuccuguguugguucacuucuuccaaguuccaagucucccucuucucuugccuuguuuugguagaauacauuugccaggaaacuuccugagaaacgguguaugcaagcuugucuaaacugcggccuaggauggccuuugaaugcagcccaaaacgaauuuguaaacuuuauuaaacauuaugauaauuuuuuuucucucaucagcuauuguuaguguuaguguauuuuauguguggcccaagacaauucuucuuccaguguggcccagggaagccaaaagauuggacaccccugguauagaggaauuucuugagauauauaacauuccauacauaacaggaaauaacccguuuauuauugauugauaauuuggcuguuuguagaacuuuagguuaaaaagauacuuuucuccaaauuuucaaagguauucuuccgcuguuuucuacuuuccaucacuguugcuaauaacuagcuugccauucugauucuuuaucuuucauuuguuacuuuuuuuuuuuaucugcccauguucaguucaccaccaaguucugucagucucuaucuucuaaauaucccccgaguccguacacuucuuauguaucacuuugcucucuagucaucccccaucuacucuugccccuuccuaauacucagaagccaaaacugucuuccaaaacugcugagucuucacaucaugccauuucugccuugcugcccuccugccauuguaaagaacucuucagugggcuuucgauuucucuuaagcuacaguuuguaaagucuguuauuuccuguaucuggaccugccuaccucucuagccuugccucuucuccuccccuuacuccuuguauuccaaucacucugguuaucuuuuaccuacuuuaccaaguccuucacuguuuuagggcauuuguuacccucuucucucuuugucuggaacuaucucuuucucuaauugccucugaccccccuaucuauacuccccacucucaaccagcucaacuguaguuucccugggaaacccauugugaucucuaggacaagguaagauuuucuuucuaugugcacuuacauuaucuuguguuuuuucguaguacuauuccauucauucagccaucacaaguuugucaaguacuuagcacgugccagacacugugcucggagcuggggauauaggaaugaacaagacagacaagaagccuacucuguuggaguuuauaucuuucuaguauuuuaggaagugauaagugaaaaaauaaagcaaggaagaguauaauggucauaaucauuauuuauugugcaauuaauuacuuauuucuaauuaauuucuaauuauguguuuuuauuagugugcuaggguugccaaaacaaaauacugcaugcagaccgcauggcuuaaauaacaaauuuauugucuugugguucuggaagcuagaaguccaagaucaagaugucagcaggguucuggaggcuagaagucuaagaucaaggugucccgagcuucucagggccaugcaggaaggaucuguucuaggucucucuucuuggcuauagauggccaucuucucccuaugucucuugacaucgucuucccucuauguugucucuguguccaaauuucccccuuuuauaaacauaucagucauauuggauuagggcucauccuaaugaccucagggguggcuccucugucauuucccuauuauaagcagaguccugagguaggaaaaaaacucucucacuuagaaaagaaaaaaaaaaaugcuuaaagugaauaguuggggguugggggccugggggaagagccucuugcucucuggaaauggguuccuuuaaucacucuaugucuaccucaauucagaucagcuagaccuccaugaagggaaacagaaccaacauuccuuuaacccaaaggaaagagagagguggcagggucuuggaaaagagacggauccaacaauuccacauuuuaacucacccuuugucauauccuggaugagcccccguauuaugggauaguucccuggaccuugacccccuuugugggugggaacuggaguagauccuuucacucagcgcacugcuggccacuccuugcaagagggaacgaaugcuggaaccagccagaugcuccucucuggugggagcaggcucugugcaggccccguagcaguguccuagccccugcccuuucagcauguggguucuuguccagcgucuuagaaaauugagguugcacaaaccgauaguggguaguguauguggaggauuuuauugggugauggcuggcagcggaugggaguuggaaaggggaugaugcgggaagaaggugaucuuucccugaagcugcaccaucugaaguuagcugcaucugucuguagucucugaugcucagcugcuuguaucccugacgcucagcagcuugcaucccugaccgcuugcaucagccgcuuguguugcucugccagcugaaguguuuuuaugggcaaaggauaggggcauggcagaccaaaaaggcaauauuugggcggugagauggggucagcuguuuucacuuagggccaaggucccagguuaaggguggaguuuagccaggagcccagccauucuguaucucaaggacaccaaagagccuuuguuuaugugggucauaucuguugauauguaucacauuaucaauuaaaacuuagagggugucuguuuccagccauggaauaacuucauuuauucuccuaccuaaaacaagcaaaaugaauguacaaaacauaugaaauagcaauuuucaagauacuggccacaaaggacagggauccuugagagguaagcaaaaaaugcgaugagccuuauaauacaguuuccuggcuguaguaugggcaaguggguauuccaggcaaagccuggagacucuaaguuaaggagaaagagcugagagaucagaggaaccaaaggaguuagaguuugcaggacauaguacuggaaggagaaacccagugaucugcagagaguucaccuugaguauucauuuggcaugcaaaauacguucucugaccacagugaaauuaaauuagaaaucaguaacaaagcccuugggaaagucaccaaauauuuggaaauuaaauaauccauuucgaaauaacccauaggucaaagaagaaauuaaaaccaagaaauuucaaaaauauuaacaauaaacccauuacauguuagcauaaauaacauauuuugauuaaaaaaaaaaaaacuguuucccccucuccaaaaaauagaaauagagauuucuauuagcccagauggaauaacagagacuauauuuacucuccuccaugaaaaaaaaaaaaaucuagaaaacgaggugaauguugaaugguuuuucagauaaugggaaacagguagcacaggacugugaucucugagauagagagaaaacaaaucaugacuuaggccaaacguugcugugaacagacaacauuacauuucacagagauagaagggaacaggaguuucacagcuuggaagcagcaaaccuugacaagaccagccuuauuagagaggucagaaguguuuagaguugauugagaccaaauuggaggugaggaaaugagaccauuaagguagacaacuuuucgggggagguuuuacuguguuaaggagagcaaaaaaauagggucauagcuggagggggguguugggucaagggaggguuuuguuugcuuguuuuuuaaaguuuguuauuuaaauugggagauauuuaacucaguggcuuucugaccuuuuugacuacaacccacagugagagauaaauuuuauauuacuacuaacuguauacauacacaugacugaaacaaaagcuucacaaaaugguauuuaccuuuuccauuuuuaacgcauucugauacuuucuauucucuuuauuauuucauuaagaaaaaaaugcuggucuggauuuacugaguuauuuucauaauucacacucuagguucaaaggcacagucucucuguucacagcuucaugauggaauccugagcauaaguuagagguuagccuuuaauuauagcaaggacaguuguuucaugguaagaacaagggaaauagaucauaagugcacagacaagguauauuggugcuuggaagaugacagaguuucuguuagaaugauucuauauuuuucaaaguagugugaggccaacuaagaggggccacauggggagugucgaauauuugaaugaagagaagaaagugugagauagauauuuuggagaauaguagagcaaacuuuacuagagaaaggugcaagaguuuuauagcaguauugaaugcccauuugagaauuaugaucaugaaauuaaagugucacuagucaguucagggcuagaugaauaagccuguagugaacauuagccauaacuguuaaacucuguucuucauccacauuuagcugguuggcuaucauaggugauaugauggugaaagaaauauaugggauuuuacuuuggaaaacacugacuccaaacucauuucuugauuuaaaguagaagaaguaucucaguggcaucacuguagaagggugugagucuuuucuacucuugagagagccuguuuuuagucuuuuguaccacuggguucuggguucuugggcagacccagagacacucugacuguaagggcuggucuaaagaagaguaguuaaagugaucagggaguaaagggcuugauuucguucuaaaaaagauuacauuuaaacuuagagaggcacaaaggaugguaugauucagguauucaaaaucuggaagaaaaugaguugauugaacguguacuuagucauggacacucccacgacuagcugagccacuuaaaacuuuuaagaggaaaauccaggacacaugcccaccagaacugagauuuuaaacucugcaguauuccuugccaaauggcagaucuucuaaaaugaaguaaagaaguaagugggaacaauguuacuagucuugaucuguugacauuuuucauuuucugaguagggguuauuggaauucucuggcuaaagccagaguaguggcugccauuuacuuuugguuuccagccuagcugugggguaauuagauuuaaaucugggauuuuauuacuucagaagauaauaagucauuaagucuccuuaacuguuaaugugauuacuuuagcaaauuucuugacuaauucuuaaaucuccagucuuuauguguacaguggaauggccuuaguaggaaaauagcuuagaccuggucuaacuaaauuauguagaucccauaguacugugucacccucgccuaauagaaacuacauaaugaugaugguaguguuagcccauugauucuaagcagccagagaaauacaagauaauuauccucaagugcguagagugaaauaggaccucaaagaaaucaccuagcuuguguccuagauaggaucucacuuguuuguaaagaguuaguuuuuuccagugaucuuuacggccagcauauauuucuuuugcugacacuuuaauuggucuuuuauuuaaaauaugccauacauuuuauagcccaacauuaguuucacuagaaguuuucauacauguaccauacacauaaaaauauuguaauuaggagcauucuuuccugaaugucuuugcugugccugucaauauucauguauaggaauccaacuauuuucuuccuugugcgucacaauuuaguguuuucucuuuuugcguuaaaagauaauuuucaaaaacaacuaacaucauucucauauggauguaaaaugaacauguguuuuuauuaaagauuuaaacucauuaguagagagaagacugauauuaugaggugaucaaagaaggagccaaagaaucaucacauuuacagaugaggaacauugaaaugaauguauaaugagcaaaaaacuggcuucuuccacauuggaggaggaaagucaauugaaccuccacccaacaggauuuugcauaucuauagacaagaauuauuuuccauugcucucaguuaucuacaacauacagaguuauaccauagcucaaaggcagugaauggcuggaaucuugggagaguagauuuagacaaugccauaguucaacugaagcacaauuuuuucccuacacccaguaaauucccuaugccuuaguauuaugcuaaggaaaauggaagaaaccaagugauaacaaguacauuguugauuuuuguaugaaaacagugucaaaauuuuguuuuaaccauuuguaguaugguucucccuaaaaauuuuauaggauuuaugacauuacuuuggacuguggccuaaguauuuaacguugcuagauaaguaaacugugaccucagcugcaugguucagaaucacaaauacaugcccuaaaguccauacaguaaugaugacuggcugcucuuuauugaacagauugguacauuaauaaugaugaucuugaggucaggguuaauuauauucaaagguguuaaaaugguaguaaauaaagauuagaguuaguauaguaucguaagauaagguagaauugguugggagagaucuuagaaucuuaaaggggcucuacugggaaaccggccggaaaugugaagaaaaaaaggagagcuggaguagacggacauuccuuuguuaugaugauucaacuuuccuagaagcuucuauuuuagauucagcaaauacucuuaguucucuuguaucuuggaaguuagaaugguaucauuuguauauauuuaagaaagcgggcaucuuucaugcucuuaugauuauguaaaagccuuucuagagaauggaguuugggaagaaaccuagaguagcuaacuaggaauaucauguuuccauauuuguauuugaggaagggagaagauaaaaagaagguuccaugacacuccagcccuuuguauucuuaugcuuggcagcuuuuaaauuuauugcaagugauuccuaaggaugcuguucuugagcaagcuuguacaccucuguuuuuuguuuuuuguuuuuuuuuuuugagacagagucuugcccuguugcccaggcuggagugcaguggugcaaucucgggucacugaaaccucugccucccagguucaagugacucuugugccucagccuccuaaguagcugggauuauaggcacacaauaccacaccuggcuaauuuuuuuguacuuuuaguagagauaggguuucaccauguuggccaggcuggucucgaacuccugacaaaugguccaccuacuucggccucccaaagugcugggauuacaggcaugugauaccacaccuggcuaauuuuuuuuguauuuuuaguagagaugggguuucaccaugcuggccacgcugguuucgaacuccugacaagugauccauucacuucaggcuccugaagugcugggauuacaggcguaagccaccaugcccaucccuuguacaccucuugauauucaguuugucaguuguagaugguuaacuuucauaguccuagcuuuacugagaagaucuuuugaauuucagguaaaaaacauaagagugaauuucagcuucugguggaucaggcuagaaaaggauacaagaaaauugcuggaaugucacaaaaaacaguaacaauaacaaaagaagaugaaucuacagaaaagcuaucuucuguaugcauggguaagagacuauaauuaaaaacagacauaugucgaauuucauuauuuacuuuuaauaugaaaaaauuaaaccaaagaaauuuacuuuggaguucuuaguucuuugaaaugagaaaaaguauuuuuagacaaacuucauguagcaguuuguaaacuagauuuauuacuauggggaaagugguuggaagaauguccugaagaaacaaucucuuuuugucuaucguccuuucaguuaaugauaaaucauaaauuucuuuguuauuuaagcuucaggauguuuucuagauauagaauuuauugguggagauccuguaaagagagugaauuauuuuugugauagaacacugguguuuacuuuggaugaaauguucugccaaacagucuaaaguuaacauaccugguaggcuaauacagagcacguuccuuaacuuugauccauuuuaaaauuugaaauugauauuuuaauucuauugccugggcuuuggaccagugaacaaaaaagaaucauaaugggggaaagugcgcaagaaaauugcuuauuauguuuuucuauauugugguaaaauauacauaacacaauguuuaucuuuuuaacccuucauaaauguacaagucauuggcauuaaguacauucacaauauuguguaacuaucaccacugucuauauccaaaacauuuucaucauucccagcacaaacuuugcacucaugaaauagcaacucuuccguccccucugccucauagcccugguaauaacaauuccacuuucugugucuaugaguuugcccauuccagguaccucauauaaauggaauuguauaauauuugucuuuguguguuggcuucuuucucuaagcauaauguuuucagaguccuucaauguuguagcacauuuuaaaauuuuaaaauauuuuaaaauuuuugauuaaacaguauuccauaguauguauaugucauauuuuguuuauccauuuaucugcuaugguuauuuccaccuuuugguucuuauaaauaaugcugcuaugagcauugguggucagauauuuaaguuucagcuuagagugcgauuucugauucauaugcugguucuauguuuagaaccuuuugaggaaucguuaaacuuuuccauaguggcugcauuaucuuacauucccaccagcgaagcaugaggguuccaauuucuucacauccucaucaaugcuuguuauuuucugauuuuuaaauuuuuuaaaaauuguagaugugaagugguaugucauugugguuuugauuugcauuucccuagugacuaauaaacaauuugugcauaaagugcugccucaguauguaacucauggucauugaacaacucgaacuuguucaugcaguuguuaaaggauauuucuagaaacuaguuuagcacuugagaaaaucugacugaauauuucccauuaagaaaaguuuuuuuaauuaguugaaccucucuugaauaucauugauggcuuguauguauuuaugaacaucaauauuacucuuuccgggguucagaggugauugcugcuuuuagauugcugugcaugaaugagaugucugagaggguaagguaugugagagagaugaagacagacacagacugacugaaaagauggauuuuguauagcaucauacaaccaauauaauuguugcucuuuagaacauugaagugcucauguaagugaacaaguugcauauucucucaagugaaaacuuagccuguuuuuguugugugucucuggggagcucugaugucugagccucacucuucggggcucuauuuuggaguccugcauucugagaucuaagggcaaguaggaaggauaacuuauuuuuuaugcccacagauuauugaaugcuguuuguucccaagagggaauauaucuucuagaaguguauguaagaguggaagaaguaagaaaagaauacagacaaugugcaaaaauaaaagauuguuuuaaguugaauuccuguucccugguuugcuagcuugcuugcaugcaccucacuaguugaguaauauagucccugggugaaccgaguugacugggggauuggcuccucuuaaugugauucugguaucuguuuacaagaggaguuccuagagguucaggauggucauccuggcuaaauucuuuuucccuuuuccagauauacauuagagggugcuguuuuguuuugcuaaugauaguuuauugacagccagaugacauuaggagcauauuuuuaggaauuacacucuugugaaguaugcuguucucucaguguaacaaaaacuuagaacuauuucugaaaaaaauuuaacuguaugaacuuggcaagguuuuuugaagaauuuguuauguucuuuccccauaaauucucucuguauaaucaaaccuugacaauuguauuuuuagugugcuuuguugaagaccacuugccucuacaagugcuugaugagugaugugugaaagcucuguuucucugugaggaaacacaugaaaggagcucuguaguauuauuagcacauguagcuugcaugugagguaccuccucaguuccugaaaguuaaggacagcacagaugaaaaucccagcagcguucaugaugagugggagaauccugggcacuaaagaaucuuucacagauauucuuccacucauauuuguagaaaauuggccauacccauaugccacauuuuuguaaacacugcauccuuccagcuuuuuggggucuuuauuuuuaucugcaauaagagaccuugaaaucugagaauaugacaaagaaugcacggaaaugugauguguauuggaucaaauggaaauauuccuuaugucuguuuaguuguccuuuuccauagagaauaauuagauucuaguuaaccuagaaaaauguuuagaaaaauguccagauagauucacuaucauauaauaguagcaaauauugugguugucuuauuaguugaaucuguagucuuuuuuugguuauacuucuuauguugguuugucaguguucucugaucuaugaaauaugcaagaauuccuuagugauauguuaauagaggccucauuagaauuacaagauucuuccugcuucugguuuuaaaauaaauuuuauuuuuaaacuaauuaaucuuggaaaaacaugggcuggacaguauaauuagauagcaccauuguaguguuaauucuugcucucuggcugucacuagaguucuggaaucuaugugacauauacuucaacuuuacuaagugcacauggcaguauuaaguguugcagaaguaauaggcauacagaaguuguagauuuuaagguacucuuaaauuuauuuuuuccuaggacaggaagauaauaugaccucaguaacaaaccacuuuucucaaucaaagcuggacuccccagaggaauuggaaccugacagagaagaggauucuucuagcuguauugauauucaagaaguucuuucuucaucagaaucagauucaugcaauagguaagaaacaugcaguaguugauuauuuuaaauaucuacuucauaugcacauguagauagauaggcagaaauaauuagaauguagcuuugaggcauggcauggugugucacucuuacauuucaguccccuuuuacugcugggucuucuucacagugauaacaaggcaggauuugggaagguagugcagggaucacagggugaguuuggucucuacucuauagccuuuauguagauacuuuuccuaccguuggaaaagaaagcaugauagacagugaaauuuuugucaagacgaugaguaaaggagauaaaaacaacuauauuggaaaacagaaaugaucagaaagacauggcgcauaggaggguuaagaaaugaaaaauuuaacugaguaaauagaauagauggggaaacuuuaaaaaugagaaguuugguaaugagucauuuugaaaagauauuuuaaaaaauauauaggguuuauuuuacacacacacacacacacacacacacacacacgcaugcacacacacauaccaguuuuuguuccggucuuucacuuaauguuaugucauaaauguuacguuucuauagguuggcacaaaaguaauugaaaccacaguuacuuuugcaccaacauaauagcuuauguuuauaauuguuauuuuuuaaugaguacaguauucuguuaugucucugcgcuauaauuuaccagacccuucaguuucuguuagagcucuacauuuuucccaguguucuacuuauguaccugaugcuaugguaaagcucuuccuuuguuucuauugaauacuuuuuuuuucauuuuuuugagacggagucucacucuguugcccagccuggagugcgguggugcgauuucggcucacugcaaccuccaccucccagguucaagcauuucuccuaccucagcuucccaaguggcugggauuacaggccugugccaccacgccuggcuaauuuuuuuuuuuguacauuuaguagagacaggguuucaccguguuggccaggcuggucucaaacuccugaccucaagugauccacccaccucggccucccaaagugcuggaauuacaggcaugagccaccguaccuggccacuuaucuuuauuauucugauauguaggcauugcccucugaaugaauuguacugauuuaaaaugccuaccuaucagaaucauugcuuauugccaguguuauuuaaugacgcugaaacuuagucaagagagacacccauuugauucugguaacugauaccauagaaaucaggaaaagauucaaacuuagaagggacuaccagucaagaccaaauuccuuuaguagcaucauacuaugugguauuuauuuaucugguccaacugggcguucucagggugggguuaaugaguauauuacauagauuuggccuugcugugcugaagacaugccagucuugucaccagcuucauacucaaccccucagauucuguuaucaaggacgcuuguaaucaaauugaagcuuaagugguagaggaaauuuucauuuuggggauguuccuugucuuucacuucauuuuuccuugugggguucaguguuguaagcgauuucuauuaucccccuacauuuuauuauuugauuuuuauuugugucagucauuuauacugcugacaguugaaagaauaaaaacagaaugaagcauccuuauuuuguuucccugcccauuuaacuucagaguuugguuuagugucuaguuguagcaguggauauuuugcuaauuaaaaaaaagaauuuccuuugcauuagacucucagagaggauaaucuuuuguuucuuaagcuuguaaguuaaauguaagcacaaauguuuaauucuuuuuugaacuugaauuuuuguagacauccaugagaacuccaauauuuggaacuaaccuaauguucuuauuuuuuuuuuccuuaaaaaaauacagcaguuuacuuuuuauaagaauuuaaagugauugacuaaaaggaauguauucuuucucucucuuuuucuucuaucuuuaauacaauguuuccuaacccuuuucuucagcacacauagcaaaugauaguauuucuguggcaugccaggauaaagagaugaugccgccauggguuucagccacccugcgucucacugugggcuagggauuaaugccuaguguacaacuaccccgugggugagggagagaacacaccaaauaggaagcuuagcuuuuauuauaugaauacaccguugaacaguugaauaggugggacauacauggacaaauaggcucauggugcuucugugguagaaaggacagcaagagcauuugaagcgccccuguuuuggggcagguaaggcaaugauugagucagucgaaaaagaaauuaagugacuuaaucucaugauccuaaugaaugguaaagccaguuuucugaauucagauauaaugcuuucuucugcuuuuuuuugcuguucuccaaaucucagaaggcacugaagccagauuaaaaguuaaaugaacaggugacauauuaaaguuacagguuuaugaguuuccccacuccacuguuuucauguagcuccagaaccuuagaggauaauggaagacagauucaguccaaugcuguuuuucagaguagaaucuaucauguuuuuaaaguuaaaaauuaucaguguacauauuaaauacaaguuuuucagauuuagaauuuguucuucugaaaauaagaguccugaaugucuccuggacagaaaacccugguucuggggguuuuaggauccagaagacagcaugcccagaugggcuuggguuaguucacuugauuugcacgugaaagaugugaggguacaggaacuguguggguugggguggucagaaaagagggaacagauauggcuauagcaagagagaauuuuugcagguuguuuuuuaggacuagaucuaaacauuuuaaaaucagcauuucaacuaggauuccuggauaaugggaaaguccaguguucggaacagcauguauagcaugugaccucuuuucuaaaagggggaggaauacuuauauuuguuugguuuugcauaaagaaacacuagaagacuacacaacaaacuaaugaaagugauugcauguuggagaugagaaaacagguuggaugggaacaaaggaggaagugggccaacucaguauacaucuuuuaugucauuugauuuugaaccauguaaauauaucaaucuacuuuaaacaaacaaacaaaaaaaaaagagagcaaguacuguuuaaaccuuacucuuuauaaaguuuuggaaaucaucucaucaguguuaaucgucaucauaaauugguuaauaaaguuuggugguguagacaguaaggaagacaaauauauuaaugaaacuuuguaauuuagaggguauuggaauuauuagaaaaacuacuaaguaaguguuuauguuucuggucaaauugagagaaaaaacaucaaacuaguggaacaauauccuaaguuggaagugaaguaucuuacuguaagucaaugauggcuuuguauuuuuuaaaaucuucauaauugcuguuggaaaguugacauuauauuucauuuuauaacuuaaaugugacauucgaugaauguaauguugccacaaaaucuuuuucuacuaaaccucauuacuguguguauuuuauuauagccuuuuuugugggaauauuuaugaacuuuagaauacccugaaagcuaaaugguucauucuguuucagguggugaguuuuuuuuuuuggaacuuucuagagaaaaugugagaacaugaaacaguucuucaguaucuuuuccauuuuugaaagagcuucggccggacacaguggcucacaccuguaaucccagcacuuugggaggccaaggcagguggaucaccugaagucaggaagaccagccuggccacauggugaaaccuggccuuuacuaaaaauauaaaaauuagccaggcgcaguagcaugugccuguaaucccagcuacucgggaggcugaggcagcagaauugcuugaacgugggaggcggagguugcugugagccgauaucgcgccacugcacuccagccugggugacaaagcgagacuccaucucaaaaaaaaaaaaaaaaaaagcgcuuaaacuggguguggugcaugaggcagaccaucuuuuggaugaauggaacauuuguuuuaggggaauguaucuuuguccaagauacugugacaucaaguccuugaaauguguaugacuccuugagauccauguaccuagcagucagucuuccuuguuucauugugggaggucagcucagccauuggcuuuaugacucuggaaaggugccuggcacauggaauuuuaaauuaaucucccagaguuucaguuuccucauugaaaaaaauggaauaauagcuuuuuuuguuuguuugucccucuaacuucccuggaugagucuacaaagcaaauuagaugaucauauauugugaaugcuuuguaaauagaacguaaacuuauuguugcuugguuucaucucuuguuaaggauuuugcauauauuaguaaguuauuuuuauuauuuucucuuaagcucucuucauuuuaucuuucuuuaguucuaguggagagcagugaaacucuuagccuuguuuuuuccagaacuguguugauguuugugcgacaaaaaccuuauugauaaguaggcaggagagcguauucuuaacucugguaaaaucaauagcauuugauuuuucugcuaccacuauugaagcagcacaauguggcaaaacaagaugaguuuugcauucccauuccuguuuuucuacuuacuuuaauuucucucagccuuugucaaguggggagaaaacuuagggugcuucugugaauuaaagcuaaugugaaggcuggaugugguggcucacaccuguaaucccagcacuuugagaagccaagcaaggcgggaggaucacuugagccugggaguuugaaaccagccugggcaacauagggagaugccaucucuacaaaauauuuaaaaauuagccagacauggugguaugcaccuauaacuacucaggagauguggugggaggauuccuugagcacaggagguugaggcugcaguagcugugauuguaccacugcacuccagccugagugacagagcaacacccugucucaaaaaaaaaaaaaaaaaaaaaauuaaaaaagcuaauguguacaaaguaauuaucacuguggccuguagagguaguugcucagaacaugauaauuuucgucauugucauaauugaaugaguuuuuuggaaccuggaacuuuacuauucuaauacguuagccaacugcuaaaauauuuggcauauaagcuauuguuugucuuacagauuacuaaaaauagggguuugagggaagauucaugguagcugacagaauuuauuuaaguaccauugucugguaggcauguuguccugcauugauccuccagugaucuacccuugaagaguuauuguuuuaaauuggauauacucaaccacguucaaauuagugccacaauuaagggaagaaauaugggcagguaacuacuagaugcuagaaaaauuccacuuguagguaauccuuaauccucaggauuuuuauagcagauguuugcguuuuuuccuaccccgcaguacccuguguaccugccaugcugguucugaugaauuuacacccuggugucauagaaacaguggaaaucaaagauuaaaauagagcacauaguaaucagguuuucucgggcaaauuggagcauggugcugaggcaauuauucagauaauucagacccaaaucuguuuuaugaaaauggaacugacauuuguugaacauuuacugcguaccaagcucuaugcuaaauauuuaauguguuauauugaauaagcuuuuaaaaagcccuaaggaauacauguaucauuauccugauuuuauaugugaggauauugacacagaggaaaguuaaguaacuggcccaaaauuacacaguaaguaacagaaaugggaccucaacuuaacuuugucugacaccgaaaucugaggguuuuuucucuaacuaacauuaccagucauacauuugccguagguauuugacaucuuacuuuucagcuucaguaguaaauucuuuacuaguagaaugaaauaagaugcuacaaaaggaauaugcgaagauaguguuuuacuuugcugaagaagcugugcuacuuuccgucagagaaugacaagagugagauauuacagaaaaaccagcuuggccaaggugugcaugugugugugcaugcacacacacagaauuagcuuacauuucugcaacuuugaccugaaaauaaggcuaaaagcugacuaaaaggugugaaaaauaaauugcagguguucuaaauaagccuauuaauaucuuccuggaccaagguugggaauuccaucgaauucaagauucgauuuugaaucuuugccagugagucuuucucacguguaaucuauauauuaauauccacuguagccuggaccaguagggacaucagagagggccauuugaaugcccuuccauaggggagcuguaacguucauguaccaaaccuuacauucauccagcuucuugaagcguggucuuccagaauguuucaagaccaaauaguagacaagcugaaaaaguuccucguucuagacuuuaaagcugcaguuguguaggcuuguauaugcucugaccccagaaauaucagaaugaguaauuaauuuucuccuuuggaagauuuuuuaaaugucuugaaagaauguuaaaggaauuuuugauccucaaggcauauuaaaaugacuaagacuucaaaaauauuaauugcuuuuauccccagggaagcgaucugagugauaauuuuaguaacacugacugcuauaccuaagugucuuuuuguaaaauccuauuugugaaacuauguuuaauuuuaggaaugugguuuuugagcagauaugguaauaagcacauuacuugaaaaaggaaugagcaguucugucugguauuuuaauuguauuagcaucaacuguguuuuucaguggugacuagaauuggaacagcagauauagcagauaauccugaaacuucauuuuagauaaaauucugaaccucccaaauuuuguaucaguccauuuagugauuugguuaucauucaggugagugccugagguggggcagaaggaaagauaaugggaauugaagacaccagggagcugugcagccuggcugggcagugacauugaagucacagaggaagaggagauugcaggcaacuucugagauguguuuuuuguuaaccaccucuaacaucuguuuucacugagguagcauagcaaaaaccucuuagauuuaugucauuaguguacugcaaauguuuuccuuuaacaaaucagugauuugugcuggugauuugaaagccccuagguaaauugaucacagacucuacuagguuaguugacaggcuuggccauccuccuuucuuagcuagaauaguagagaugcuuuguaaccuuccuguuuaaaaaaaaaauuguguguguuguggagcacagggggguguuggcaagaagcuuacuuuacucuuucuccaacucugugaccccugccaggccccagaacuacgugauccuccgcagcucccauuucccuagcucguggguuuucaguaggagcaguaucacccccaaaggguggaauuuuguuuuucgugggggugggaaguggguaaaaagguuacuguguguaugcauaaaacacagauauauauauauauauauauauuuuauauauauaugcuuuauacaugugcguguauguguaucucaacacaugaacaaacagacaucauauuugugguauuaaaauuucaugggauugggggaaaaguguaaaaaggcugcuuaggaagaugauaguuuuaaaagcuugagaaacaguaccuuaagcacaucagguaaagaagaauggaugacacuggaguagagagaagggaaugaaaagguuggguuaaaacagcuucagcuuuguuuaaauuggaguaguucucuccaagguaaggaguagcaggagcuggggucuugugaauagaaggguuuagaacaacuucuguugaaguagggguggcagggaaucucagccucccuggcuaguggaaaauacuaaagaugguaaaaucugccucaguguuuuucagcgccuuuggccuuugcuccuccucuccuaauggaaacuacauuuggcucucucuuuccuugcccacccccacucucccuccuuccucuuacugguaaccacugguuugcuuucugucacuauagacucauuuguuuuuuucuagaauuuuauauaaaugggacgauacagucuucuuguugucugucaauacugauguacauauccuuuuaguuccaguucagacaucauaagagaucuuuuagaagaagaggaagccugggaagcaucacauaagugaguucucauaaucaugaaauaagcaugcacuuugaccugagaaauuauacuucuaugcagcugauuuucaaacaaaauuauauuuuugcuuucugguuuaaagaaguaguaauccucaugcaagguaaagauuuucaguuuacuacuuguuucuauauauuucugcuaagaaauggaauccuauguaauaacuguaguuauguaucagauguuauuucuguauggauaaauuguucuuaugggcaauuaauacagucaugcaucacuuaacaauggggauacguccugagaaaugugauuucauuguugugggaacaucagaguauacuuaccuagaugguauagcccaccacacagcugggcucuaggguauagcauauugcugcuaggcuacaaaccuguacagcauuuuacaguuaggcauuuguaacacaaugguaccuguuaguguaucuaaaccuggaaaagguacaguaaaaacaugguauuauaaucuuacguaauugccauaaugcagcuagagcgaucuuuucaaaaugcaaaucugaucacuguuacucaucccucugcucuaaaaaucuugaauggcuucuuguuccuuuuagguucaagaagggacucuuuaauaugcguaaaagguccuaaaugauuggaucucuuucuccagacucaucucuuauuauuuacuucauauucucucugcuucaucauauagaugucuuagguccuccugcaugaaaagcucucucccaccacagagccuuugaacuugucccucuacccagaauguucuuuauuuuuucaucuaguuuacaccccuacucagcagcucaaguucuuccuggauccaguccuccuacaguaggcgcuuacagcacuguguccaucucuuuccagcacauuuauaugauuauuuguuuguccaucacucccacuggcuuauaaguuaggcauuuuaaccccacugucaacaugagccuaacucauaguaaauacaugugugaucucauuuaaauauaacauuaugauguucuauuaucccuguuuuacagugaggaaacugaggcucaaagggguaagucuccagcccaaggucauauagcaauaaguaauaagugauggagaugagauucuaaccuaauugucaaaagucagcacccucaaccauuaaacucuacuaucuuuccaaagguggagaggcuugcugugcaguugacauuuuguaguuucauagcugaaucacugggagaguggaaaaguaugguguauccagggcacacaugguuuuauuaugagauauuuggugguucaagcaguagcauuuuauguaaguuugagauuuuggcugcauuacugucucucaccuaagcauuauuuaacuuugaguucuggaagaggaggagacuccuuagcuaacuacuuuccucuuguaccucuucauacugaacuaacccugacaccagugacuaugagcccagaguuccugagcccaagccugcucuugauaaugauaacuucuuaaagugauuacuaccagaaagcacuuagaaaacaaauccuaucauuucaguuuuuaaagcgagaaagauacaagagcucaucuagcccaacccauuuguuuuauagagaaggaagcucggcuccagagagguaaacugacccuuggucaagguccgaggacuaguuagugauaccuccaggaucagaauccaggccuccugauuucagcagaauauagaauaguuuaaacagccgcaguuccuucuaaggaagaacuucugcugugauguaguuuuaaaagcagaaucaggaaaagccuccagagcuuuacuuuucaacaaaauguugcaguucuacaaauacccaucuuaagcuuauaggcauuuuuuuguaguaccacaaguggcauauuugagauguuagucuuagaacauaccauaucaguuccgacacauucucuuaauuccacaaaugauuuagagguuucguuagcaacacauggcuccauauaaagcaggguuuuuguaagcagcaggaaacuuauuuucugcagacuggucuuggggucuucuaucuacauuuuguauucuuuuaugagaugauuagucaguguggccacgagacacaggagaggcucaggaaaacuuguuucauuauacucacagguccuagagacagggcauggcacaccgugcagguccacaagggaaagacgcuagcguggucaggaggcagaagacaggaacaagggaagugcuuuaggcuagaacccugauugggguuuucucaggaaaggcaaggcaggguggggugaacagugcaggacuggcuaguuugaauaauuucaguggcuccaagcuauaggaguggucccuaguuaccuagaaccuggcccuggcaugauuaaggcagagggcuauugccuuuuaggguguuggggccagauagaggaguugugacucuggauugguuaguuugcaugucacaggcauacuccuggcugggcccguugcugucucugagaauugaccagccucuccuuaugccagcaggggcaaucucuccccagcuagaaaggcuauauauuaugaugucaaagcaucauaauauauaggaaacacacccacacaauuuuuacuuagccugucugaugguucccugaagacucuacuugcaagacuuuuacuuuacuugacuuggagcuugcucaauucaaaaagccuuuucucuaaggguguuuguugaaaguaaugagaggcauuugacuagcuuugcagcugucugagguggcggauaacaguuggggcaaaugauacgccaaccaaaaagcaacaacaacaagcuacaagauauauuuacauugaacagaaugaaaauagaaaaugguccugguguuacuucacauuuuggggucucaguuucuuuacacauaaaugugaguaaaauauauaugcuucagugagucuaagcccuuugcuccagaucugcgucuccuccaguguccccucuucucagugaaugguaggaucauaguccuccccacuguucaagccagaaccuagcaauuauuuuaaacuucucacucucccuuaccacucaccugcagucacuugcaaaguccuauaaauaagugguucacagacuuaaaaucaccuggaggacuuguuagacuacagauuagugaacuccaccccuagagauucugauucaguagauuuaggaaggggcuuaaugauuggcauuuuaacaagcuccuagguauagcuggggcagcuucuguacugucucaaucccuuugugccacugcuuacuccugcaggcccuuuacuuuccagcuugcagcaaccacugucuagcugucucucugccuuggucuguuaccaguucauuuugccagugaaacguaacauacagguauuuucccccuuagacuuuaaaguagcucuccaccauccaaggcuuuucguguucuggccccagccuaccuggcuggcucauggaauuuuauucccucacuucccuaccccacaacuguggcuuuggccaagcugccaagcugcaccacucacaguugccucaugaguuacaccgccuugccucuggccuuugcacacgccgcugcuucuguccaaauugcccuuuccccuuuauucaucuagauagcaguugacauuccuuucuucauacucuguucagaagccccugauuuugcuccagcagcacucucacccuuucuagugaguaaguacacuggauuuuaaaucccuagcaccuagcacugugccugggcagcccagcauaggcacucaauaaauaugugaaugaaugaaugugucugucugucagucagucagucaguguuuaugggaucugaguguauucacuaguagauucuauguucuuacuuggcuucaagaaccugugaaugaauaaggaucaccacuguaaacuaaaaacaaaauuuuaagccaucagcugacugaagagacuccccuauuggccaaggggacccauagaaaccuuaaaaacagucccuggccaugacagcacaggaggucagacaugccucauuauaccuccucccuuuugcaguguagacauaacaacuggccaacauuaauguuagaauagagaucauaggacugacagaacagauuuuuuuguggcaauaaaauaccaaauuauagacaagaccuaaggccuugccaggcaaggguuaaguaaaucaccccacacuuaaagaguaauuauguucuaauugccacaagguuuuucuuuuucucuagcagcuaaacaagcacuggccuugagauaaacaauguuaaaacaauuguagcacaucuauacaacugccagaugcugacuaacugacccacccuuuuccacaagcuauaacuacagcauugguuugacaagagacugauuucaauaacuuucuccugauaagagaccacugaccauggacugguucuggcuaguuuuauaguggcugagcaguugggugccuuuauguccuagaaagaccuuuugacauguaaggccuaacuguaauauauuuaaauguuaagucuccaccccagaaugaacauggguugugugaaacaugcaugcaugcauuaggacaugcauuaggaucccccuuuaugaauaaucauagcuccuccuguaaccuguugaauauguauguuugguccacacauucacccuaaaucccuuuucccucuucccucccuuacagugccugucuuuugggcucugccagaguuaacacuucucagccuugucagaguggucaccuuucuggcuguaaucauuuauaagaaauaaaggcuccuuuccaaaguuguaaauuugauuuuuaagcuaacaccacuuaaaaaucuugcuaacucuuugucucuaucucauagugccuuuaaaagaaaauuuuagaaaauaacuuucucuaaucuuauaaaaucggaaaaggaagaaucauuuucucuauuaauagucuacauuucaucuuaaacccauaagaaguuguuugcaugcacuuaugagccugucauguuuguuaaaugauacaauuacuguaauugaaaguacuugcagcaagaaaacagugaaucccaucuuuaaaaaaaugaauaaaaggaaacucaggccuguuuacagugguccuugaucugaccacugucucuuuaaucaacaugaggcaaggagagccacacaccaagagauucuuucuaugggccuaccaagaaggaaaguaggucauccuggaaauaauguguauuggaagcaggcugaugaugaauggccagaucuccuaaggcauguuuuugcauucaguagauucaacacuuuaacaguagauagaugccucacuguggcccuccccaggaauauccucccaucuggcuaacaugcuauugucaaauuuuacuaaaagaaauucauuaguaauaccugcuggagaccaagaauuuaaaaaccugcuguaccugugagaucuuaugaaguguuauuccaguaagucaauguguuacaugcauggaaaaaaaugugggcuggguuauucuauuaggauucuugcaucuuaggggaugagguguuuuagagaauuguucugggagaaccgcugagauccuugccaggaacuccccugcuaaggaaguggaagaaguauagaugacuucuugcacuaccucaauagcugugucuguugccagcuaucauaaaggcaaaucaaagaggggaaacauggaaagaaaaauuacugaaaauuguuaaaggauuauuaaaaacaagguaugagaauagagagugauaaaauagaaguuaaaaguaaggaggaacaucccacuaaaacuuaagccuuaaaaagagucagaagucaaauaaguaaagaugauaaaacauuaagauaaaaaauuugacauggugaaaguugagagauuuuaagaacauaaacuaaaacaugaaaaaaaaguaaaaaugauaagagugauagcaaaaaugguggaaauucucugcuccauaaaagcaauaacaaaacugcaaaaauugucagaaucaacuuuuaggaaaacucugaaaauuaaccaaaagcagcagcaauuuagguaggggucauuuauucaagaaaaaugucugaaucucagugagaacagugagcuuuguggugauucgacuggcuuuguucucauccuucucucuccaguuccucuauggccuugggagccaacagucugcagucauggugaggaccagcaggcugacaguccccagagaaggcagagcgggguuggagccccuuuaaagccacauucccagagaauuuuuacuuagccugucuaaugguucccuggaagacucuacuugcaagacuaucuuuacuuuauuuuuacuuagccugucuaaugguucccuggaagacucuacuugcaagacuaucuuuacuuuaccugacuuggagcuugcugaauucaaaaagccuuuuaucuaaggguguuuguugaaagcaauuagaggcauuugacuagcuuugcagcugucugaggugguagauaacaguugggguaaaugauaugcuaaccaaaaagccuaaugguaaaagcugaagaauaagauuuccauggggguuuugaacagcuauaaaauauuccugggaaucuagagggucacucucauucauagagcuuccgugcaugcuuaggaaagaccuaaggaagcgcuaaacuuucaccucugguuaaccaugaggcugugugcaagcaggaaguaaaggcuaaggcagaguuguccacugaguguugagugaauguugauugcaugccccagcacagacacagaacccaccagcaaagacugguuuugcugaguuucuguaugauauugguuccagaugucuaaggaacuguucaaucauuaguggacuacaaagcuaaucaagcagacacuuuuaguugccauauacaacaaagaauacauauuuauaggauugguuuagaaaagucacuaaacaauaauagcaaacagcaacaacaacaaauccuggagagaucuuguuuguugguuguuuauuuuugguauuucucaugacugggguucuuugaccaacuuugaucuugauuugaaguguuucaacguuuuuagaaaauccacagccauauauauuuacauauuuauuauccauaguucuuucucuccuuucuuccagguauuacaguuauacacauguuaugccauuuuuauugucccacagcucuuggcugcucuauucuaugugcacccccucacauacuccuuuuucucuuuguaucuuaaucugguuuuuauugacauaccuucaaguucacuaagucuuuuuaucaacuuuguguauugcacuuaaagccuauugaaggaauuuccaucucgaaauggguuuuucccuugcuucauuguguaucauacuuuuugaaugcgggccaugcagugaaggaccauagggacugaggucgauaguguuugugccuagaaaugcacauccuucuacugggucauuaguguggggaguugagcuggguaauucagaguugaccuggauuggaguuuccuagugacuaaugugaccuucagugcauccacuucaaguuacucuagcagguggcugcuuugacuucugcuuaguguuggggcuggauugccagaggguuuuucucauugauuuugcucccauuuuccuuucagccaugcuugcuuuccugcaccaaauaggggcauaucuucaccaugucugugucucucccucagccauuuccugcuccugcuuauugcuuguugcuaggcugauggugggaaacagccgggguucacuguuaucucagucuagccugagucuuagguaggcccugugugccugagucucaggggugggccuuucucagcacuuccaccuccucccaugguaucuggcuacuugaccaaaccucugcguggugucaguguaaggucaucagcuggagaugauuuacugccccuccuguaagguagagguuuuaguuucuaccauucccccugcagcagugaaucuuugccugcguuccugcaaaugaggucauaugccuccccuugaggcagacugauuucaccucuguuccuuccccagaggccauaggucuuugcuagagccccagggggaguuuccuguguuucccucagcaacugaaaagcuuaugcuucaugggagagaagcauucaggagagcaggcaggacuugacuucuuccugucccccguagccacugaaguggccccucuccauucaccuguccugcucccagucuuucuugugagcaccugacggaggcucguggaaaagagcuggcaagugugugcagacucuccuugugucaggggccugcaauacuagccuguauuuaagaaauuaggaaaaucuuagcugauucuucuuaccuguuuguauggcagccaccucguucuccaacacucugccaaaagugagagaaguguggcccaucuuuggaggggcauauuuuucuuuggaauuuuacuuucuuaguuccuuuaaaaccucaggucucugaaggaucaaacagaguuaagauuuuguuagacugucuggcuuuuucuuguuaggaugggagcagcuuuuuguuugccguuuuuucccagcccucuacaugcuaaacagaagcauaaaacuccuaaauuuuaauucagaaaaagggguucagagcucauuuacuaucugugaucuuugcuaacucacuaauucauaaaguggaaauacuaauaauaacaauuaugaauucaucaacagaauagaggauuauuucgagguuuuaaugaaauaauaugugugaaaacacuuguaaacuagaaacugcuguacaauaaucauuacuuuccaagaugucauuuccuuuuucugucuucagaaacgaucuucaagacacagaaauaaguccaagacagaaucgccgcacaagagccgcugaaagugcugagauugaaccaagaaacaagcguaauaggaauuaaugugggcuuuugcugacuuuucaaaugcauugauuagaauaccguacuuuugguugccacagauagauuuucuauuuauaaaugcccaaggaaagaugcuaaauucuaaauauuacgguuagcugauauucauucuuuucugcuuuuccagaggggaaaaauguuacaaaauauccuuacuuggucaguugccuccugccucuaaaacaucucucucuaaaaauacugacauuucacacagguaccagcuuugcagaggagguagacucuuuggcacuuuggcacagggauuugguuugguuugguuugguuugauaauuaaauuucagaauguccuuaggccauucuccuucucuuccauggagaauccagccucacaaaaggauucuuucaacuucuuuauugcaagaaacaguugaguuaaauguuuguuuuuggaaaggcgggaugucaguucacauccuugguguguguaaguaccgaugcacgccaccaccaugccuguguuacagcagcuccaugaugguuguugcccgagguuaauguaguuguuuguuagaccugugucuuacacauuucucagaguaggauauuaguauuauaauuuaaagcuacgacagucacaaagucacaauaacuuagaaacauugcgcauauucuucugaaauagcacuuaaaaaugauuagugucaguauuuuuucacuugggucaaucaaaucuguaacacugaauccaagcuauuaaacaaaaaguaugcaaugaaugaauuuuguaaaugaauagagaguaucaguuuacaauaauguucuuaaaacaguauccucuggauaguugaguauggguuagaaaucauugaaauggauuggucagaaauugcuaucuguguaaaaugucuaccaguagccagaugcuuccagaguucuuaaugccucucuggcauuucagagccagcaucccccaacucccaccccucugccaucacccaacccaaacacaucagcuuucaaaugagaugauaguaaaugcggcaauguuaagacaagaaauuuaugauuugccagauucaacauuuaugaccuccccuuccaaagacugucuccguugaccuugucuuuuugguaugccuugggguuucugauaauguguggagucucauuauggcugagaguuuaguguuuucacagugaagugcagacauuugauuucuuuaugaguucccuguguuagaaauggcuauagaaaaauuugucauaauaauuucauuugcaugaaauccugaggggugcauuaaggaaacuaaaagcaccacuuaccaaaucuaucggcagaacugaugugagguaagugagcaugucaaacaaaauaggagcucacauggauauauuuaugucacugaguugucagaaauuaugucaaaaugaaaacuguuuguuucaugacaaauuauauagucuauaaauuaaacuggaaguaauuauuacuuuaauugcagcaaaaggaguuugugagggagcggugagacccaagauugggaaaguaggcacaugaguucauucagcaaauauuugguuaucuaugucugucacugugcugacacugggaauacaaagguggccaaagaucaucuagaacaaugguucccaguggggugggcagaaagauuuugccccccaggagacagcuggcaauguguggagacacuuuuggagguggaggguggugagggguacuaccaguaucaauggguggaggccagggaugaggcuaaacacccaacccucauggauuaguuugccagggcugccgucacaagauacugcagacggggaagcuuacacaacagaaauguguauucucagaauucuggaggcuggaaguccaagaucaguaggguuucuucuucggccucucuccuuggcuuccacucaugguguccuugcauggucuuuucucugugugcacaugacugugcaggacuggugucccgauuucuuguagggacagcagucauuggaucagggcccaugcguauggccucauuuuacuucaguuaccucuuuuuuagauagagggcccuaucucuaaauacugucacauucugagauaccggcaguuaagacuuccaacauauuuagugguagggguuaaggggcacgcuuuagacuacaacacuccacaguaaagaauuauccagucuaacaugucaguugugccaagacugagaaaccuguaauguaaaggaacucccaagucuaccugaaaaguaaggucuaaagagcauuuauugagcacuaucuguuagcacuuagcauauguuuaauauucauacauugaaagaaauguauguucauauccaucugacaaagauuaaggaacuuagaguaaguaauagauccaaaauugaaacugauaaacuucugguucuaaaauucaccuuuuagugaaaauacaguuucucaccaaacuuacaguaauucagaguuauuaacucuuucuaccuccucacuccccucaaaguuauaacaucucccaucaacaucagcucagaauggcagugaugcuuaugguuugugggggugcaggugagcugcuggaugcacuuuagauggccuaguaugccaggccguccuuucauccucuacucucgucuuucuuuuucgaccucauguugaggauuacuggucuaguugaaaaaagaauucauacacauaagaccauguauauaauagagggagguaugccuuuaaaaacaaaauuacaugguaaagacugaugugucaacagggauagacaacauagagaaggcuagaacuguuucuggaaaaaaacccaaaaacaauggauuucaaacuucuuagcauccgauaaaagaaaguagcaauuauucaaaugagaaacacuucugucuguuauguacauauuaugaaaguaugaacauaagagggaaaaccacaaccauuacauuuuuuaccauuucaguaauuuuuuuuugguuuuuagucuguuuuuagacauccuuaagaacaacuaucugaggcuguaaacaaguauuuacauuaacacccaugauacugacuuuauacucccuaccugcauugagaccuuaaagggggcauuucuccauuccuucuguguauuucuggguauccccagguucagauauucagaauacagauacaaguccaugcuugcauauguugcugcuccccccgacagacuucuaccagcaucugcccuccucaccgcugcucugucacgugcacugcggcuggcccugcuggaaaguccuaccuugccuaggacgccauccccgauauagccccaagaugcaaaccugccaagugcuagggcagcccugccuuccuguccauuucagucucuuggccuugcuguguuccaaguggaaaugggagugugcuuuccugguuugcuaguguacuaucacccggaccacagcguccugugcaaaaauuugcuuccucucucuuccccuuucacucuuucucuuuucucuuccccacccccuuuuuuuucucuuuccccuuaccuuucuuuccuuuccacucuuccuguccuuccuuccuucaacuauuaggacuauaugucaaguaaugugcaaaacaaagacaguuccugcccugauggagcuuguagaucagaagggaagaugagcauuaaguaauuauauagauuaauguacaacugugaugagugcaacaaaagagagguucauggcacuaucaaacaugcaauggacggauuuuguuuuugccuauaaacucuugccauagaaagcuugaaaaucaguccagggggacagcauuaaucaccauguucuuuccuuaucccugucuuccccaaaauucauguguugaaacuuaacaagaggugggaacuuuaggaugugauuaagucgugagggcacagcucuuauagauggggucacgguccuucuaaaagggcuugagggagugguuuuguuuccuuccaucccuuccgccacaugaggacacagucuucguucccucuggaggacucagcaacaacacaccaucuuggaagcagagagcaguccucaccagacacggaaucugccagugccuugaucuuggacuuaccagccuccauaccugugagaaauaaauuucuauugucuauaa

SEQ ID NO: 191668 - RNA, 3761 nt, Homo sapiens
cagagacagaggggccggaaguucucuucacggagccgcgcggcugcgggggcgcaaauagggucagugggccgcuuggcggugucguugcgguaccagguccgcgugagggguucggggguucugggcaggcacaauggcgucucgagcaggcccgcgagcggccggcaccgacggcagcgacuuucagcaccgggagcgcgucgccaugcacuaccagaugagguaugaagugaggcgaggagcacggaggcuuucucccccgcuggagccugcggggcuuggggagcgacgccggcccggccucagggucuugcuccccagccagcccccgcucaccugccaaguccccuccucccgugacggcuucgggccugucccccauccuggaaagccccguggcccccgcgagcuccaccccuuguuccgcccggugccuugaggggauccagccccgcgugggcucccgcccugcgugggcucccgagucacgucgaugcuggccccgcuguaucaccuucgaaaccgaauuucuaauuugagccucagcuuccucaucuguagagggagagaauaaucugccuuuuagguuuuggugaaagauuaaucaguaauucguguaaagaaaguagcauaaggccuaccacguaauauaugguagguguuauauuuugggccguuuggggggauauagacaguaaaaggcagccuuuccuaaggacgccuugccuaaaaugaauuuuauaaacacucccacguaagggguauuucuacauucaauuacuaguucgacaaauacugagcuuccaaacaucauacacugcuagacacuagguuauaauagugagcaaaagcagacguggucuuuguauacauguuauaccuucaauaaacaauuuuauuaaagaaaaaaaaaacuguucccugccuucauggagcuugaagucuagagaugacuguuuuuuuuuuccaaccuuuccacauuuucuacaauaaauauuuuuaaauaaaaauuuuaaaauuuuuacuuccuuaaauccauugaucucucccagaauguucuucacaucucucucuccagaguuuuaaagaaugacaagcucuuugaacucucauuuguuucacaucucuaggccccggcugaaagggcccucacaacuuaagcagguguuuucaugccagcccagaguagaaacauugccuuuagggauaugaggaggauacguuugggacgugagagaauuagaagaauaagauaaguauguacuucuuuuggaugaaaaaaucuagcuggagaaguaugggcggccugaguacguuuccucucugccaauaccuucucccgccagacuuuaauccuauggugcagucagcguccucuugcuaaacacagcucugagcuacccuucugccuuuauuauuauuauuaauuuauuuauuuauuuuugagacggagucacggucugucgcccaggcuggagugcaguggcgcgaucucagcucacuuguaagcuccgccucccggguucacgccauucucagccucagccucccgaguagcugggacuacaggcgcccgccaccacgugcugcuaauuuuuuuguauuuuuaguagagacaggguuucaccgugucagccaggauggucucgaucuccugaccucgugaucugcccgccucggccucccaaagugcugggauuacaggcgugagccaccgcgcccagcccugccuuuuuauuaguaguauuguuguuguuuuuuuuuuuuauggagauggggucucauuuuguugccaggcuggucucgaacuccugggcucaagcaguccuccugcuucagccuaccaaagugcuuggauuagaguugugagcccagccucuucuacuuuuaacucucauagucuuugugauucauaucccacuaccccucucccccuaacaauauguuccugccacacauaaccacuugcuuuccuggaacacaaauacuugggccuuuuugucugcaugcuccugcaugggaugcccaucuucacucauuccugagccuaguucagauaucaccugccucuagauagccaucucugacauuccaugccaggcagaguugauuccuccuuccugugaucccauauaucugggaacauauauuuacuagaacuuuuucacuucauuuucuaauuacuuuuuccuccucuguucuuuguguccggcuucuaggcuguuuuauucaaauuuguaucccaguguccaguacaguugucuggcauauaguuggugguaagaaaaauuugaaagauacuucucccucugcucugccccacagugugacucucaaguaugaaaucaagaagcugaucuacguacaucuggucauauggcugcugcugguugcuaagaugagcgugggacaccugaggcucuugucacaugaucagguggccaugcccuaucagugggaauacccguauuugcugagcauuuugcccucucucuugggccuucucuccuuuccccgcaacaacauuagcuaccuggugcucuccaugaucagcaugggacucuuuuccaucgcuccacucauuuauggcagcauggagauguucccugcugcacagcagcucuaccgccauggcaaggccuaccguuuccucuuugguuuuucugccguuuccaucauguaccugguguugguguuggcagugcaagugcaugccuggcaguuguacuacagcaagaagcuccuagacucuugguucaccagcacacaggagaagaagcauaaaugaagccucuuuggggugaagccuggacaucccaucgaaugaaaggacacuaguacagcgguuccaaaaucccuucuggugauuuuagcagcugugauguugguaccuggugcagaccaggccaaaguucuggaaagcuccuuuugccaucugcugagguggcaaaacuauaauuuauuccugguuggcuagaacugggugaccaacagcuaugaaacaaauuucagcuguuugaaguugaacuuugagguuuuucuuuaagaaugagcuucguccuugccucuacucggucauucuccccauuuccauccauuaccccuuagccauugagacuaaaggaaauagggaauaaaucaaauuacuucaucucuaggucacgggucaggaaacauuugggcagcugcucccuuggcaggcuguggucuccucugcaaagcauuuuaauuaaaaaccucaauaaagauggcccugcccacacugugccuuguguuuggggcuugauagagugugaaagguguguugcuugaaagguguggccuuagacacuaggagaugauggguagaagcuccuugagaaaccuagcaguggccauagagaaguagacuggguauggggaaccuaagucauaguuguaaccuacagcugauugguaagaacuaugggccagacauuuaaucucuccaucuaugaaauaguccauucucauuuaucuaccuuagguuaugggcucuucuuuuaguuggauauucacauuuaucuuucaguguuaacuggguaucaguuaugagucuacuacuguauaauggcauccaaaagaauuuuaaaguaccucgguuuauagggauuuacaauucaguagaaacuuguuauucaugugaaacagugaacauaauaucuaaugauguggagcaaguacauuaaaaacaggaaggaagagaucugugauuaaacuaaaggcccuuucacaccuaa

SEQ ID NO: 191669 - RNA, 75502 nt, Homo sapiens
gaacuuagaacagaauuuauuuguaaaauugguacaagccuaaguucuacaauaaaucagaguuucaaaacuagcucccaaaguccagaaucaugacucagagauuuuacucugcaguguagcacagcuggguuuauccaaaccaauaaauaaugcuacauuagaauccugagccagggacugugaugguguuagacaauccaugauguccacaaguuaauaaagaccccacuuuaagaacaaaauauggcugggagcgguggcucaugccuguaaucccagcacuuugggaggcugaggcagguggaucaugaguucaggagauugagaccaucuggccgacaugguaaaaccccguaucuacuaaaaauacaaaaauuagcugggcaugguggcaugugccugucgucccagcuacucaggaggcugaggcaggagaaucgcuugaaccuaggagauggagguugcagugagccaagauugcagcacugcacuccagccugggaaacacagcgaguccccgucuuuaaaaaaaaaaaaaaaaaaaaaaaaagaggaacaaaaaaggauccuaccaguaagaaaggcaaacagcggauuucaaacucuaacacaaaaugaucacaggcuggcagagacacagaagcaggcaacaauuuaucuggggucuaaucagagucaucauaacucucaucacuaucuugcuccuuuucuccagcacuuacuucgucuucuucaccauccuaaggggcaaagaauaaauaaauaagcauuuuagguuacugcucugggugaccucuggaauacagcuccuagaggauacacaacuguacuauuaucacuguuaaaacuuuuuuuuuuuuuuaaaggagucuugcucugucaccaggcuggaaugcaguggcaugaucucagcucacugcaaccucugccucccggguucaagcgauuccccugccucagccucccaaguagcugggauuacaggcaugugccaccacgcccggcuaauuuuuguauuuugguagagacgggguuucuccacauuggcaaggcuggucucaaacuccuggccucaggugaucugccugccucagccucccaaagugcuaggauuacaggcgugagccauugcgcccggcccaauuugcauaauuuuaaauaagcuaugguccuccagcucuacugcauguauaugacauaggaacaaagagggcauucgauauagaaugaaauauuuauuacaaguggugguauggcagugcacgguggcucacgccaaaguaaucccaacacuuuggaaggcugagguggguagaucaucugagguuaggaguucgagaccagcccggccaacauggugaaacccugucucuacuaaauauacaaaaacuagccgggcaugguugcaggcaccuguaauccuagcuacuuggaaggcugaggcaggagaauugcuugaacucgggagacagacugcagugagcugagacugcaccacugcaugcuagccugggcgacagagggagacuccgucucaaaaaaagaagugcugugcugguguaucucaacaggaauccaguacaaaauucuguucugucuggcuuacgauacuaguaugagagaucugcuuaggggaaaguaccaaacuaauaggauauugucugccucaaauucugagaaaaaaguagaagggguauauuauacaaauaaaacuggggaccauguaaauaaaauaacuuuuuuauuuugagacagggucucgcucugucauccaggcuggagugugaugauggcucacugcagccuccaccuccugggcuugagcaacccucccaccucagccuccuguguagcagggaccacaggcaugcgucaccaugccuggcuagcucaaaaaaauuuuuucuguagagauggggucucggguuggucuugaaauucugggcuuaagcgguccucccaccucagccucacaaagugcuacgauuacaggugugagccaccccaucaggccagacuuuucauacuaaaugaucuuucuggaucagacucaaauugcauuacagacagaggccccacagcagggguucuuaaaucugagcuuuuuggugucuauaaccuaccugaauugugacaaaauuuuauaaauguacacuuuuuuguuguuguugagacggagucucacucuguugcccaggcuggagugcaguagcaugaucucggcucaccacaaccuccaccucccagguucaagugauucuccugccucagccucccaaguagcugagauaacaggcacgugccaccacacccagcuaauuuuuguauuuucaguagagaugggguuucacuauguuggccaggcuggucuugaacuccugaccuugugaucugcccacaucggccucccaaagugcugggauuacaggugugagccaccgcacccagguuuauuuuucauuuuuuuuguggagauagggucuuguuauguugugcagcuuugccuugagcucccggacucaagcaauccuccuaccuuggccucaaaaagugcuaggauuacaagcaugagccacugcgccagccaugucuacauuuuuauuuagcuuucuuuaaauugucgaaagcaucuguaccacaaaaaagcguaagaacuucuauuuuuauuucaguucucuaagguggcagcuucugacucugugcuuuggcuuucaccaaaugcuuucacauuucuauuuuuguauguuucaaauguguuuaaaugguuuaacucauucuucucaacacucagaaaauacuucgaugacuucucccuucuaaaaugguuucagauaugaauucauggaaaaugagaggcuauaaugcagaaaauugucaacucuauaacaaaugccacaacucgagauacucaggagugauucuaagauugugucguuguuucuucugggucccaaaaauuauauaagcacagaagcuguuauggagggaauggaaaugggcauagaagcauuugacaauaaacauaaguaggcaaaguucugcuccaccaacuuagaacaauuaacaaaaugcaaccaucagugccagacucugguggguuuuguagagauaccucaguggcuuugcucuuggaggccugggaugacaugucauccucacucucaucugcugugcucuccugggaauuuugggacuuaaucucuucacccuaaaugugaauggaccaagaaaaugguggguuauaaugaucacauuuaggguaauaggggagaagguugaguuuacaggcaauacaaaggaagauauuuuagccauucaaaacacagcaaacauggauaccaacuugugauucagcaucuagaggagggauacucaacuccagguuucugagaugucuguggcccugauacaauaaguaauguaacgaaagguucaucuuaguaugcuaguaucacacuacauuuuaaaaggcuagacuguauuggugacucuaagucgaugcugaacaugguucuaaaauuucccaaauaccuuaagguaucuaagcacuaucacaccaagcacgaauggccaugcggaggcuaaaggacaguauggugaggugguuucagaacaucagcucuggauuugggacuguuuggacucaaacuccggcuccacccacucacuguugaaugacauuagguaaauuacuuaacuucucugagcuucaauuuuuaugcagaaacaauaguaucugccucauaagguugaugugaagaaaggaagcuaauucucuguggugcuguuuuauauauuucauauauaauugacuacaagacucagauauuguaagcaugaaagaaaagggcuuauacuacccuaucugaaaaauguuguaacuccaaaguaguauuauaaacaacacaagauuucagcuaaucagacaacuaaaaaaaaccuuauaaaugcucauuaguuaaaauuagagauuguugcgggaagucagggaccccaaacggagggaccggcugaagccuugacagaagaacguggauugugaagauuuuauggacauuuauuaguuccccaaauuaauacuuuuguaauuucuuaugccugucuuuacuguaaucucuaaacauaaauuguaaagauuucauggacacuuaccacuuccccagucaauacccuugugauuuccuaugccugucuuuacuuuaaugucuuaauccugucagccgagaaggagguauauagucucaggacccuguaauaauugcguuaacuacacaaauuguacagcauguguguuugagcaauaugaaaugugggcacccugaaaaaacaacaggguaacagcaauuguucaggguauaggagagauaaccuuaaacucugaccgccggugagccgggcggaacagaaccauguuucucuuccuucaaaagcaaaugggagaaauaucacugaauucuuuuucucagcauggaacgucccugagaaagagaaugcacaccuagggguaggucucugaacugggcccccccggguguaccugucucuuauggucgagacugcagaggugaaauaaacuccagucuccuauagcgcucccaggcuuauuaggaagaggaaauucccgccuaauaaauuuuggucagaccuguugaucucaaaacccugucuccugauaagauguuaucaaugacaguggugcccaaaacuucauuagcaauuucaauuucgccucgguccugcggucaugugaucucacccugccuccacuugccuugugauauucuauuacccuguuaaguacuugaugucugucacccacaccuauucgcacacucccuccccuuuugaaaaucccuaauaaaaacuugcuguuuuuuguggcuuguggggcaucacggauccuaucaacgugugaugucucccccggacgcccagcuuuaaaauuucucucuuuuguacucugucccuuuauuucucaagccagcugacacuuaggaaaauagaaaagaaccuacgugauuaucggggcaggucccccaauaagagauuaauuuguaauuucuggaauaagacagauuggcuuaggggaaaaaaaauaacaaaagaaauguuugucccuauacaaaaauguuauuaugaaucuacccucaguggggcuuaaaggagcuccucuagcuguggagagagguuuguacuggucugacuccuuuaugucugaggcauuguuuauaucaauggcauguuuuggugccuugcugccuaagaugaggggugcagccugugaccagggcccaugaguaauguaccauaacuuuaagaguuaaacagucacagacuuaagagaaaaguagccuuacugagagacgagggcuuaggugaccuuccuuacaugccaucugaugcugucacaaagaauaagaguaggggauuaucacuagcaggauccaaggcuuaccugcaagucccgguuuuuuagauugcccagccagaaagccucucuacaauuguugagagugagcauagcuuugacucugcaaacuaaaaguuccagggucuuuuugagcagaggcacauguugggugagucucguguccuggugaaucugaauggaaauaaauaacauccaucuuuugugaguuuaucaucaugccuucacauuucuuauagaaaccuuugaauguugaauaagaacacaagcccugccaguaugggccaacgguauguuccaucaaacaggaauaguuuggcagaguaauccaaagagaauggcagcuaaagaauucaaagccuagaagacauaccaccaacaccucuaguuccucuucauaaccucuuacuggccgaucuucaaugaauuuaccuaaaauauucuugaauauauauuuuacugauauuaaacaauagaguagcccuguuuagcuaagagaauuccuuaaacauucacuguccagccgggaggcggaacuugcagugagcagagauugugccacugcacuccggccugggcuacaaagcgagacuccgucucaaaaaaaaaaaaaaaaaaaaaucacuguucaggaccuuauaaauuuagaaccagaggaggaaguaaguaacagaaacuggacucaagaaucauuugguuugccagugacugcagaacucuaggguucuguguucauucagacaaaacgugacaauaccucauuaacuauaagaaggcuucaaguggaaaaauccuuuaaugcuaagauguucucauaagacauagaugaguuccuugaaaguaaguggcacagaugaaagccucuacagauggcugcuuuagagccaccuccugucuccugcaggaucaucacuuacaucacaguccuguuaccuagaggacuuugcagaaguaaacauauaccagcauucuauuucugucacccaagaaguuucuagaggaaaaagagcuuuggaguuugaaucaaauuucagaugcggagauuccccucuagaggacugcccaaucucaaggagcaacuaaggauuugcucugaauaaacugccuuuggacagacacagucccagauauaaaggaagaaggaugguagcccauggaucccccaauagcaacugcagauuaagccaacaggcaggcugcugauagaaccugcuccccuucuuaccuuggaaugcccacacaggugaugaagcagccuuguguccaacuggaagguuuccaguaagcucagaacaucuuccuauaaccaauaaguuuauaaaugcucuaugaaauguccugauuucauuuuagauucaagauacccuugcaaucaaaagcuccaaagaggauaaacucugcaguuuccagccuaugcugauaaucaucuuaauuugccucucaaauaggaggaauagcagcuaccucuuauucucaacucucccauuucugucccuuguaucaaucugagaguuauaagaccugcauuuuaguuuuacauagguuaccaugucucaguuuucccaucugcaacauuaggauaaaauaccaccuucccuuucucuuucagggcugugagggaccaaccaaauauggugaguauuuuguucaacuugcuaaauauguauaggaaauaaugugauucuauccuuaauucaucacucuagcccuggaugccauuggcuaaaaaacugucaagacuguucauuaccacagcaaaggguuuuaugacacaaaugagcuuuuuuuuuuuuaaaaucauuucugagaguauaccuacagaagcauaaaggaauaagcaaaugacacacugauacaugaggaccugagagugcaguagcacaauaaaaucaagcuaaaaggaagaccacugucagaucuggagaagaaauagaaagguggguuugauccagagugggccugaggaguucagccuacuuuggaauauucaguccaauuuggggaucucuggcuacagcugaaguggaccagaggagcccagguagaacacucccagccccacccaggagucaccaaggacauaucuucugagcaacucuucagugcauaucuuuguucucugcucuuagcucuuacccgguguuuucuaaaacugaagucuaggagcggcauacauugcuucagaaaugcuuccacaaagagacgcccauacugaagaagagagacacacuguuaccucuagcugagguaucucacugaaaggccccugaggcagaauagucucauccagcccaaggguuuuauuuucuuauuuauauauauaaaaaacaaauugggaaggguccaaaagguuuauuuggagaauguaacuuaauacaaaaaucaaauaggccuguuaacuaagccccagaauuaggcagacuuaccuaccacagauacagucgauggacagggaacuugcucagcuuaggagugagagcauagaguagaggggagcucuaucugaggauaacuuacucccaagagggaaaaacuggguaaagcugagaaagcauaugaccaauuucuaaauuucccaaucagauaaaugacuccucucuccaacuugcccaucucccacauugcgcaaggguggaguaaaaagggagagugaccaggagaugacaagaauggggcaccauccacuuggaaggaaacuugaggaguggcgaaguagcauucuccccauaacauucugacuggacuucccaucaaaucuagggcuaauacaggcuauucccacaaaagagaaguuuggcaauuaucaggauaucagaucccacauuuguaaggccacccauagacuuuaaagaaaaaucaucuacuccuccuuccucccuuuugccugguaaggaauggcacggaagguaacuacugcuccuaaacucaacugcccugaagccauuccuccuaguacuaagauucuuaccaaaaguuuucaaauucauaggaaaacuggcuucuccaaucauccaacuagggugggaaaaugcauccauugccuucccuaaacuggcauagauucuggaaacucuggcuugugggcaagaaauugagcaauuuaucucagcugagguccucucuagagugauccacaggaagaauaaauaugaaacagggcccaguaaaucucucaccuucaaacauacaugcagaacaggaugacuaucaaauaccuggagaggugaaagacaagaaaccaaggcugagaucugcuccuuugagcacuccagccucuuucccgcugcgcaaagcacagcuuugggugcugcagagaauucuaaaauggaggaaugucaacauuuaaauuaauauuacaaagcagaauaaaguaauuaucacaacugaaguucaagaaaaggaagagacgagcaaagagaaauaaacugauuccaacugggaguguugagaagauggcauuauuagagguccaaaaccuugaucugaagacuuaagaaagacuggaugaggcugggcaugcuggcucaugccugauaucccagcauuuugggaggcugaggcugguggaucacuugagcccaggaguucgaggccagccuggggaacagaaugagacccuguuuccacaaaaaauagaaaaauuagcugggugugguggcauguuccuguagucccagcuacuccagaggcuucagugggaagauucuugagucuaggagguugaggcugcagugagcugugaucacccuacugcauuccagccuggacaacagagugagacccugccucaaaaaaaaaaaaaaaaaaaaaaaaaagacaugaaagagguggagagacaaggacauucuaggcugggggaacaagcugagcaaaaccacgauggagugggugagagcacaguguguuuaaaggagaacgagggcauucaggguuagaagagggaaugugcgcucagaucauagaggauccaaggcaaggugaaaaagugagggaauuacagauggaaggagucauuaaauaguauuguggcauaaguaggaggaaggaaggaaaagacaaaaaaaaaaaugccuagugagaaaagggguuauccaggauggguagggggacaaaggaagaagacgacucagggagagcaggccccaaggaagagugggaagaggagcaaggaaaguccauuuuggaagccaggacacuugguuucugcaguuauuuggugagaugugucaagcagucuccauacucaccuuuaucaaguugaugaggauacugaagucucgaacagccauguuccaguagaggaguuucucuucaugaaucuggggcagccaaauauaugggcaccucugagucacagccaaauacuucccuuacuguauucccacuaagauauaguucuugaauuacauagcuauacagauauuuaagccaauuauccuuagauguagcaaccagugcauccacaagaugguucugaggccugcacauguugugguaacauuagaacaccucauagggacagacuuucuaaaaaguuuccucuucagcaauucccaaguaaguaaaagccuuugcaacauauacugaccauguuggccaggcuagucucgaacuccugacuucaugauccacccaccucggccucccaaagugcugagauuacagacgugcgccacugcacccggugguaguugcugauucuucuaugucuuggguccaaguuuucuccuaagcuguuuuuuguuuuuguuuuguuuugaguuucugagauucaggauuuuuuuucaaagaguuccuaguuuaauuuccuuucccucuaguuagaggugaggaaugggcucucuuuuccuuggcuacugcccaguuugccuccugcuaacuggcaugagguaagccagccuguuugagauacuguggaucuuggcagccugcuaaccagaacggagcuagacaaguaagagaaagggcuagcauagggaagcagagaagcuacagccgguauauguuuuuucuuuuuuuuuucuuuuugagacagggucugagucugacauccagguuggagugcaguggugcaaacuuggcucacugcagccuuugccuucugggcugcacugguuuaugccaggugcagugguuuaugccuauaaucccagcacuuugggaggcugaggcgggaggauugcuugagccuaugaguucaagaccagccugagcaacacgacaaaaccccgccucuacuaaaaauagaaaaauuagccgggcaugguggcgugcaccuguggucccagcuauuugggaggcugacgugggaggaucaucugagcccagaaggcaaaggcugcagugagccaaguuugcaccacuacacuccaaccuggaugucagacucagacccugucucaaaaagaaaaaaaaaagaaaaaacauauacuggcuguagcuucucugcuucccuaugcuagcccuuucucuuacuugucuagcuccguucugguuagcaggcugccaagauccacaguaucucaaacaggcuggcuuaccucaugccaguuagcaggaggcaaacugggcaguagccaaggaaaagagagcccauuccucaccucuaacuagagggaaaggaaauuaaacuaggaacucuuugaaaaaaaauccugaaucucagaaacucaaaacaaaacaaaaacaaaaaacagcuuaggagaaaacuuggacccaagacauagaagaaucagcaacuaccaccgggcgcaguggcgcacgucuguaaucucagcacuuugggaggccgagguggguggaucaugaagucaggaguucgagacuagccuggccaacauggugaaacccugucucuacuaaaaaauauaaaaauuagccgggugugguggcgcaugccuguaaucccagcuauucaggagucugaggcaggagaauugcuugaacccaggaggugagguugcagugagccgagaucaugccacugcacuccagucugggcaacagaacaagcaagacucugucucagaaaaaaaaaaaaaaaaaaaaaaaaaaaaucagcaacuuccaaguaauccaaaguccacuucuugaagugacuauuaucuuacucaccugcugcgagucugcugcugugccaggcucaauuuuuuucaccgucuucucuaguucagccaucaucacacggaagaaaacaacaaaaguaugccuagaagacgggaaaagcaugcgugcccacaccaugaugcacugcuuagaacuaccugggaagaaccaggaaccaaaaguagcuuccuucccuaccucucuaaauguccuuucacuaggguccuuaguaagaggaugggggagcggaaaggacucaguaauaagcccaagaagauugccugucaaacaauggaauuaacuuuaugaaaggagguguuaugguaguauggaaaaagcaaugaaguaacagugagaagaucugaguuugaguccugguucuauguuuauuuuauugcacguguaagcuugagaaguucucuagcucucauuuuccucagcaguaaaauaggggcaaugauaccaaccucacagaauuaucaaaaggaucaaaugagauaaagugaaagugcuuuauaaacugaaaagacuacaaauguuaagauaacuauugauauucugagacacacacccauuaagugagacauacaugugagcacccuguucucaagauggcuaaaauaucucagcugggcacaauggcucaugccuguaaucccagcacuuugagaggccgaggcaggcagaucaccugagguuggguucaagacuagccuggccaacauggugaaacccaaucucuacuaaaaauacaaaaauuagccgggugugguggugggugccuauaaucccaguuacuugaaaggcugggguaggagaaucguuugaacccaggagguggagguugcagugagcugagauuacgccacugcacuccagccugggugacaaguuuucucaaaaacaaaacaaaacaauacaaaacaaaaaccaccaugguccucucaaauauauuagcugagagcccuugaaaggaaugcauaacagacucucuuuauugaaugaaugauuauaucuacugucuguaucagaauuagaugaggaggagcaaggcaguuguguggaagcuauauacguuggacagugugauuaugauucuuuuuuuuuuugagauggaguuucgcucuugcugcccaggcuggagugcaguggcgcgaucccggcucacugcaaccuccgccucccagguucaagcaauucuccuaccucagccuccuaaguagcugggauuacaggcaugugccaccacgcccggcuaauuuuuguauuuuuaguagggacaggguuucacuauguuggccaagugggucucaaaacuccugaccucaaggugauccuccugccucagccucccaaagugcugggauuacaggugugugccaccgugcccagccugaugaugauucuaucuuaagggaaaaacuggaggaaagaacucccuuaccuggucaguguagggaauguggaggaagaugcaucuuuaggagaguugaucaguucugggacaccaacaccagcaaucuccucuauggccuucagaaugcucucugugugcuccagguagauacugcauugagagucaaauauuugacccacuaauuaacaaaguagaauacaacuacagauuccucuaauuccucuaugaucugaauuaacaauaagcaguuagcuaacaguauaaaacagaaccagaggaucuuaagauccacauguuccaaauuguguucauuuuuaaccuacuucauuguuuucaaauucccacuaaaaaggucauuuguccagucucugacaaacaacaguagcaaaauagaaaaaagcuauuuggcucauuggaagaaaccaaacaucucaccagagcagagcauggagcuggucauuagagauguugcucuucucuuuauccccacuuggccacacccgacagaggaauugucuggcaagggaagcuguuagaaaagaagacaaaggaaucuuacauaugggaacuugaccucauucuugcuuuucagguuuuugaggaugauuauugaucaaaaggauuauuaguuuagauuuacuaagacguucccggucuaacaggcaacuuacaaaaagcugucacguuccugauccacuggcccuuuugccagacauaaacucauuugccuaaggcucaacacgucccaccccaaccccaucuugaaacacacaaacaugcaaacaugaacauaaauacagacacacagagaaaaggaaugcugcugggcagugggaaggccaaucuuguuccuccugggcuggccaauagcaguggucaccuccaagauugagaccaaaccuuccccuuuuaaucaauagggauaaauaaagguuuguuuugcauuuuuaucuugcuuucugaugugcugccaacuaggaugagcugcauucuaagagcuacaauaaaagacaguuuaagaaagaggccagggcugggcacaguggcucacgucuguaaucccagcacuuugggaggcugaggcagguggaucacgaggucaggaguucgagaccagccugaccaacauggugaaaccccgucuccacuaaaaauacaaaaauuggcugggcacgguggugcgcaccuguaaucccagcuacuugaaaggcugaggcaggagaaucguuugaaccugggagguagaggauugcagugagccaacaucgcaccacugcacuccagccugggugacagaacgagacucugucucaaaaaaaaagaaaaaggccagggaagaggccaguauuucuuuuauacuugacccugauuucuccuuuauuuccuacuuuauuaaccucaugauuuaugucucguuuugucaaaugucucagauaaauuuuuuuuuuuugaaaaggaagaacaugauuaaacuuaagccaaagagaaaacuaucuacucagcuugucuaaccaaacucagacuaagcaauuuuagcagaaaucagucagguuguucugggaaaaugaccuucuugguauagcaagagggccuauccaagguuauguggggauuuacauguaaaaauguccugggaagcccaaaguuuguaagugugagauauuaguccuauucauuaaaaaaaaaaaaaaaaaaaggaucuaggcccaucaccaauuuuuucuuuguucugagcagaagcuguugauuucuccaaaauaaccaucaaaagucugaugagauaaagagcacacuggaaacugggaaugcuuugauggaaauucugcaaguaauggacgcucuggcuguaaggagacaagaaaaacaaacaaaugcaauaguauccuaugugucacagauauauuuaaauccacaugacgugcccaagucccuuucaguguuugacggccuaaucagaauccuccuuauuuucaggugcuuuaguagcaacccucuucaagcaucuugguagaaaaccauaccuuuguauggaaaaagccagggcagaagacagccccacugauggaauguuggccuugaaggggucauguaugcugagaaacccaagcaccacgcuaauauguacaacccuagauaaauuaucugcucuuuaaagccuuaggcaauacacugaaaauaauuuguaaaaucuggguucacaggccgggcauggugacuuaugccuguaauccuagcacuuugcuaggcugagacaggcagaucaccugagcucaggaauuagagaccagccuggccacaugucgaaaacaucucuacaaaaauauaaaaauuaguagggugugucagcaugcgccuguaaucccagcgucuugggaggcugaggcaguacaaucacuugagcccaggagguggagggugcagugagcugggaucacuccagccugggugacaaagugagacucucucucaaagaaaaaaaaaagaagauauaagguccugaccuauagacagggaugauaagcacugacugcugacccagugauggucuagguuaccaagggaagugagagaaagaccaagucacucugacugaagggggagggggccgaaagccaugccccugagaucaugucaccucccuuguccacugccuaccccucagccacauaaggucuuccuacaagacaaggggaaagaaacaggcuaucagugauaacuagcugcugccuaauuacccaaaucugcugggagacaguaggucccuggauaaucaagaguugauuacagauggucaauguuuucaucauuauuacuugaaaaggcugaguuuaugggcugaugcauucaugaagauuuagcaugauuauucaagguuucuaauacuucaggauuuaucagaauacauagaugagaaagcucauauaugaggagaguagcugaaaauaauuuccuuuacaacuacugaaagacacccagguuauuuuaaagaaaguugccaauccuguuccuaggaguuucuugggacaacaaucuuggcuauguaguuaugacucaccugaguaguuccuccaaaggcuggcuguguucucccuguuucagucggcuacuaaggacauggagggcugaauacaguaaauucugauuuucagguugagaaaauccacuccuaaggaagucaagguaagagggguuagcuuaguuucuggaaaacuacuuggauaguauuuaaggauccuggccuccagucuguaccaucaauaguuuaacgguuugaaaaaagaauugagaggucgggcgugguggcucacaccuguaaucccagcacuucgggaggcugaggcgggcgaauaacgaggucaacacauggagaccaucuuggccaacacggugaaaucccgucucuacuaaaaauacaaaaauuagcugggugugguggcgggcaccuguagucccagcuacuccagaggcugaggcagaagaaucgcuagaacucgggagguggaggcugcagugagccgagauugugccacugcacuccagccuggcgacagagcgagacuccaucucaaaaaaaaaaaaaaaagaaagaaaaaagaaaaaagaauugaaauggaaaguacugaaguaccaaauucaaucacagcucuaaguaucagaguagaaacugaaguacauccaaaguaaucuuuccugaagucuucauagguuucuuuucuucuuuccucuuucuuuucacaggggugagccaccacgccugggccauagguuuacuuugaagggcaaaaagcucuccuucauucccuauauuuuagagauauguagucuucuucaaaaauacaggaauaauuuugucaaacugcuaaaucaauguccagcccauagugguacuuaccccuucuccuacauuaaugagucaagucuugacauuucuaucuuuggauuaccuuucauauugucccuuccuuuccaagccuagaccaucauuuuggccaggccccuaucaauacauguguagaucauagugacaccuuuugaguguucuuuuuugcaucccuuuucaaucuguccugcacucugcugccagaaguguuuucuuaaaccacugcuuucauuguauuauggcugugaucauaaaacuccaaaauggcuucccuggacaacauuuaaauuauucugccugaccuuugaggcccagcacaaucugacguccuagaucuucuccucuagaagcaucuuccugaucaccagugauagucauucuuccuuucaacaaauguauucugagggccuauuaggugucagguuuuuggucuaccauagcuucaaugagauauaguugauguacaauacacuucauguacuuaaaauguugaauuugggccagguaugguggcucacgccucuaaugccagcacuuugggaggcugaggcggguggaucacuugagcccagagguucaagaccagccugggggcaacauggcgaaaccccgucucuaccaaagaaaaaaaaaaggaaaaaucagcugggcauggugguacaugccugcagucccaacugcuugggaggcugaggugggaggauuuauagccugggagucagagguugcagugagcugugauuguguuacuacacuccagccugggcaacagagcaagacccugucucagggaagaaaaaaaaaaaagccagguguaguggcucacaccuguaaucccagcacuuugggaggcugagguggguagaucacggggucaggaguucaagaccagccuggccaagauggugaaaccccgucucuacuaaaaauacaaaaauuagccaggugcaguggcaggcgcauguaaucucagcuauucaggaggcugaggcagaagaaucgcuugaacccgggcagcagagguuauagugagccgagaucgcgccacugcacuccagccugagcgacagagugagacucugucucucacacacacacaaaagcaugggaaacaaguuuagaauauacuauguaaaaccacaggcuaaauugcucaaaauauuccuguaccagacccugguggacauaccuuuuuuuuuuuuuuuuuuuugagacggagucuugcucugucgcccaggcuggagugcaguggugggaucucggcucacugcaagcuccaccucccggguuaaggccauucuccugccucagccucuugaguagcugggacuacaggcgccugcaaccacgcucggcuaauuuuuuguauuuuuaguacagacggaguuucaccguguuagccaggacggucucgaucuccugaccucaugaucugcccgccucggccucccaaagugcugggauuacaggcgugagccacugcgccuggucgguggacguaugcuuucauuucccuugauuaaauaccuaaggauggaauggcugagucacaugguaggugcaugucuagcuuuuuaagaaacuaccaaacuauuucccaauauggauguaccauuguaaagucccccuagaagcaugugagagcuccagcuguuccaccuucucaccaacacuuggcaugcuaagucuuuuugauguagcuaugcuagugaguguguugugcuaucucauugugcuuuuaauuugcauuuccuuaagaaguaauaaacauccuuucauguauuuauuuuaauuguuuuuauaauuuuuagagaugguuuauuuucuguguuaacuucacugggccauggggcccagauuuuuuuuuuuuugagauggggucugguucuguugcccagguuggagugcaguguugcaaucuuggcucacugcaaccucugccucacaggcucaagccauccugucaccucagccuccugaguagcugggacuacagaugcaugccaccaugcccagauaauuuuuguauuuuuuauggagacaggguuuugccaugcuucccaggcuggucucgaacuccugagcucaagugauccacccaccuuggccucccaaaguguugggauuacaggcauaagccacgaugucaggccccuuucacauguuuauuugccaucuauaagucucuuugauaaauuguucaaaguuuuugucaggcacugcuuuuaaguaaugaggauauaaaaaugacagacaucugccuucauggagcucagagucuagcaggaaagacugaugaacaaguaauuauaauaaaaugagauuaaguuuuaucacgaacggauaccagaguguuagaagagaacuggggguuagagaggcaggauggaugcuuaaguucagaucucaagagaugugaugagucagaaaaagcuggggaucaagaagaguggggguccuggcaggagaaugaacaugugcaaagccucccacguaaaagcuauauagggugcucaaauuaauucagugaggcuggaggcagaguauaacauaauaaguggaauagcaggagucagaagaagaccuagaggcuagguaagagaguuuuaacucaagaaaaaucuaagagcaaucagaaaucaaaauugggauaggaucaaacuggguuuauguuaggaagaucacucuuacugccaugugaagaauggacugagagaggccaagugugaaccuagcccaguccagguugagagauaaugggagucuggaagcaguggagaaacagggacagauggcuaucuagauguuauuuauaacagaaaauaaaaucaacaggauuuggcaaucagaugugggaaaaagacgguggagagcagagggagggacaaagaauaacuccugguuucugguucaggcaacuggugguaccauuuacuaagccaggcaaagcugaaggagcaugcuagggaugacauauuccauuuuggauguggagugugaggugucaaugccacaucuaaggagguguugcguaggcaguuggauauaaaugccuauagcucagaaaauaaauuuuggcuaaauuuaagcuuggguaggauugaccagaaaucuuguauaaugagaacagagagcccaacgccugucccugaggaacaaaaguauuuaaggggcacaccucccuuaguucuacuuuuguccauguuguaccuuccacuuccuuccguuaucucucuaaaggccauguacccuucugggguucccuugagucccacuguuuccaugaagguaucauggaauagcccagcucacaguguucagcucaucaccaaacaaucuggaauuaaagcaugcuaaaggaaacuggacuaaggaacagauggccacaucuguuaucagcucaucagcaagucaccuaaucugucaaauggguuaacauaguggcuccaaaggacucagaggguacaagaucaaaugaaauaauacagacaaaaacacucccacaaaauuaaugaaccauauucacauaagauuuuugaaccuuuucuuucuuuucuacauuucagugccuuggugacugucaaauaaaagcaaguauauacucaguucucuccacacuucccacauacuuaccaagcaaaaagcccaugaaaaaucugcagcagccucugauagcaggaagacauuaugugguacuccugaacuuucacuccugguccaucaacuacaccgugauucucagcagcuaaacacuaaaaauaaaaaugauuuuaggacaguugcuucaguaauuguccucauuuuccuuuuucucagccaaaaaugaaaccucauauuugcuuagcagcuucuaagucuaggcuucugaccugaaaauaguugugaauguucuccaggugguuacacauuggggucagcaguugaaaaacacaaugaacaauuucuugggcagaucucuguuggagaugugagaauccaauauuccggcuuccuuuguucuauaauaaaugcagaguuaugagugaagaaacugcuggauagcgucucagaaacuaaggguucgcaauggagucaagucaaaccugugucaccagguaggagcagaugggagaaaugaguuguuaaccuaagacuguauucugacagagggauaaaaaucuugcuccaucuuccaaugacugagagauuggcuuuuguagaguaggaacaguguuugauugagacauauagcccuaucauaacuaaucagauaaaggucacauaaaaguagaaaucauuuagguugacaaauguagggcaauagacuccuucuuauaauuuuuuuuuugaggcaagguucugcucugucacccaggcuggagugcaguggcacgaucacagcucacugcagccuugaauuccugggcucaagugauccucucaccucagccuccugaguaucugagaccacaggcacaugccaacaaacauggcuaguuuuuguauuuuuuauagagaugggguuuaaccacauuaaccaggcuggucucaaacuccugagcucaagcaauccacccaucuuggacucccaaaguguugggguuaaaggcgugagccacugugcccugccucccuauuauaauugaaaaacaaacaaacaaaaaaauguagaagccugggcaacaugcugaaacucuucuuuacaaaaaauacaaaaauuagcugagugcgguggcacaugccugugguccuagcuacucaggaggcugagauaggaggauuacuugaaucccggagguggagguugcagugagccaagauugugccacuacacuccagccugggcaacagagcaaagcccugucucaaaaaguagacccgauagugaauacaaagaagaaugaauugcugggcacuguagcucuugccuguaauccuagcacuuugggaggccaaggcggguggaucaugaggucaagagaucaagacaauccuggccaacauggugaaaccccaucuuuacuaaaaauacaaaaauuagcugggugugguggcgugcaccuguagucccagcuccucgggaggcugaggcaggagaaucgcuugaacccaggaggcggaaguugcagugagccaagaucaagccacugcacuccagccuggcaacaaagcaagacuccgccucaaaaaaaaaaaagaagacgaagaagaaaaaugaaucaagaaaccaagaaacgggauauauuaauguuuaaaugcuuauacccaagacccaagauuuucucauuuuguuauauguaccguccaacugcuuccccggaugcuaggugcacguuuguacacuguauacacaucugaaguucuggacguucuagacagcuuacuacuacacugaggcaugggcccaggcuugguuugggaggcuguugaaaccaaaauucaaguaaagaacaggauucaggaauguucagggcauuuagaaauacauuucguaggcugggcgcagugcucacgccuauaaucccagcacuuugggaggccgaggugggcggauugggaggccgaggugggcggaucaugaggucaggaguucgagaucagccugaugaacauguuaaaaccccaucucuacuaaaaauacaaaaauuagcugggugugguggcgcgcgccuguaguccccagcuacucaggaggcugcagcaggagaaucgcuugaacccaggaggcagaggcugcagugagccgagauugcaccacugcacuccagccugggagacacagcgagacuccgucucaaaaaaagaaauacauuucuuauuccaagugccuuucuauuuucuguuucagacuuccuauuuuuuuuuuuuuauuucugagacagagucuuguucuaaugcccaggcuggagugcaguagcaugaucuugguucacugcagcgucugccuccuggguucaaucaagucuucugccucagccucccaaguaccugggacuacaagcaugcgccaccauaccuggcuaauuuuuuuuguauuuuuaguagagacaggcucuugccacguuggccaggcuggucucaaacuccugaccucaggugauccaccugccucggccuuccaacgugcuggaauuacaggugugaaccacugcacagguagacuuuuuuuuuuguuugagacgaaaucugucacccagacuggagugcacuggugcaaucucagcucacugcaaccuccuccuccccaugccucagccucccaaguagcuggaacuauagcugcaccaccaugcccggcuaguucuuuuuguauuuuuaguagagaugggguuucaccauguuggccaggcuggucuugaacuccugaacucaagugaucugcccuccuuggccucccaaagugcuggcauuacaggcgugagccaccacgcccagccuucagacuuccuauuuaaagcaagaugaggccgggcgcgguggcucaugcccguaaucccagcacuuugggaggccaaggugggcggaucacaaggucaggagauugagaccauccuggcuaacacggugaaaccccgucucuacaaaaaauacaaaaaauuagccaggcgugguggcaggcaccuguagucccagcuacucgggaggcugaggcaggagaaugacaugaacccgggaggcggagcuugcagugagccgagaucacaccacugcacuccagccugggcgacagagcgagacuccaucucuaaauaaauaaauaaauaaauaaagcaagaugaauauugucuggcaauacggcugcacccaugcuacccagugacccaaacacaaugccaaagaaagugacaacuuuuucaucauaauaccuccuuuguucccaaauccacuaugcccaaguccuaugcuucugccuacacuaaccuugagaaaggggacucuccuggcaauaggaggugucagcauacucuccagcuucugggagagaucuuccagcaagaaaagcagcucagggggcccaaguugcacaacuucuguagccugucacauggaggaaaggauuaguuccaggaauguccuagucauuucaugauaauuuuuuuucuuucuuuuuuguuaaaugugcaguggcaagaucauagcuauuccagccuugaacuccugggcccaaguuauccucccaucucagccucccgaguagcggggacuauaggcacacacaaccaugcccagcuacauuuuuuuuuuuaauuaauaagaaaugaggucucacuauauugcccaagcuggucucaaacuccugggcucagaugauccuucugccuuggccucccaauaugccaggauuacagguaugaaccaccacaccugggcccagcgaauuuuuaaauuuuuuuauacagacggggucucacuuuguugcccaggcugguuucaaacuccugggcuugagcaauccuccugccuuggccucccaagguauugggauuauggacaggcaugagccaccacaccuggcuauuucauguuaauacuucccaaugggugaaaaaaaaauuuuuuuuuugagacagagucuuguuccgucacccaggcuggagggcaguggcaugaucuuggcucacuacaaccucugcgucccagguucaagcaauucuccugccucagccucccaaguagcuggcauuacaggugcccaccaccaugccugacuaauuuuuguauuuuuaguagaaauggguuucaucacguuggccaggcuagucucaaacccgaccucaggugauaacgccugucucagccucccaaagugcugugauuagaggcgugagccacugcgcccagcaggguaaauaauuugacuuuuauuuauuuauuuacuuauauuugagacagggucucgcucuguugcucaggcuggagugcaauauuguguucacagcucacugcagccucaaccuccuggacucaagugauggucccaccucagccgcccagguagcugggaucacaggugugcgucaccaugccuggcuacuuuuuuuuuuuaacuuuuuguagagacaggucucacuguguuacccaggcuggucucaaacucccaguacuuugggaggucaaggcaggcagaucauuugaggucaggagucugagaccagccuggccaauguggugaaaucccaucucuacuaaaaauacaaaaauuagcugaugugguggugggcaccuguaaucccagcugcuugggaggcugaggcagaagaaucgcuugagcucaggaggcagaagaaucacuugagcucaggaggcagaggcugcaguaagccaagaucgugccacugcacuccagacugacggacagagcaagacuccgucuccaacaaacaaacaaacaaauaaaaaaacuagccggguguaguggggcaugccaguggcccuagauacuuggaaggcugaggugggaggaucacuugauccuugaacccaggaguucaagguugcagugagcuaugaucuugccacugcacuucagccugggugacagagcaagacucugucucuaaaaagaaaaaagaggcaagggaggaaacugcacccaucucauauaaaggauagcuauuaugcucugucauauaauaaagucaagcauguccaaaauaaauauucagaauaguaaaauaauaauucaagacaggauaguuuagaagacauacuuuuucucuauaaauuccucuguauaccuuucuaguuguggauccaagaugcguuuccuaaauauccugugauuuaaaaaaugacuuugaaugccacacacaggguuugggaaaaaaaaaaaagacuaauucaagggaauuucccuuuugucuguucauuaaauaauccuuucauacuuguuuuccucuaauguuuugcuacuauuaacucugggcaggaccccagagugaucccaguggaauagcuauauuacacugcuagaagcagaaugggugaaauacagucucacugcaaacugcucacucaauacacauuuauguggcaucuccuaagggcaagaugauguagaaagauuaaaaaaaaaaaaaaaagauauggcugggcgcaguggcucacaccuguaaucccaacacuuugggaggccaaggcgggcggaucacgaggucaggagaucgagaccauccuggcuaacaacggugaaaccucgucucuauuaaaaauacaaaaaauuagccaggcaugguggcaggcaccuguagucccagcuacuugggaggcugaggcaggauaauggugugaacccgggaggcggagcuugcagugagccaagaucccaccaccgcacuccagccugugcaacgcagcgagacuccaucucaaaaaaaaaaaaaaaaaaaaggauacuauuucuguucugaagguaccuacauucguguaaauuucaggugaaaauuaaugcuauuucaauuucucuuaaaccuagagaaauucuacucucugaugaaaucccaucucaaaaguuacuuuaucugugaaaauguccucuacucccaacuucuauauaaacaucauucucucacuagaguuucacuaguccuugguucagaccauuaaugccguauuuggcaucaauaaagcuauggggccgggcacgggggcuugcgccuguaaucccagcacuuugggaggccaaggcgggugaucacgaggucaggagaucgagaccauccuggcuaacauggugaaacccugucucuauaaaaaauguacaaaaaauuagccgggugugauggcggaugccuauagccccagcuacucaggaggcugaggcagcagaauggcgugaacccgggaggcagagcuugcagugaguggagauccgcgccacugcacuccagccugggcgacagagagagacuccaucucaaaaaaaaaaaagaaaauaauaauaauaaagcuaccguauugcuagcuauuuccacuucuuugauuagauuagaaguuauuugaaagcaagcaugaugcucuauguacuacugaaaugcaagugcuuugauuaguggcaaacacaaaauaggacucaguaagcaacugucaggugcugaacaaauguugugaaaaagugaaaagggcauugacuucuaagaaccagaagagugcuccucuacaaaaauaaucuagguagcuuauuaguaguaguaguaguaguaaccuaaauguaaggauuacaucauuggcaugauauuuuauaaugucugacacauuauuacaaaccuuaugacuuacaaacaccaguaugaggaugauuauucaucauugcuuucacauauaaaggcuuuaaaagucagucuaacuucucuccucagugucacaguguucuuugugaaauaagaauagaccugaggaacuuucugaaagaagauuaaauucugagauccuagccugucacuuacuucagugugcauuucaguaucuaagaugaacuucgucacaaguccacaauguagaauagagaagaccucaauguccagcucucggaaaaaagcaugggaauuauguaguaacaaugaugucuuuucuuccuucccugugaacuccuauggggaagucacagcaacaaagagaauauauaaaucuucuauauuaaucgaauuuuaauaaaaacuucaaaguacaaauaugcauuuauuuaaugcaaaaaauuacauuuucauuauaauaacaacuuccucuagcccaagucccuaaauauucccaagacagagcaccuaauuuaagauggggauacaagucacacaucaagacccuuaacaggucaucuauuuagggaugaucuauuaggcaaaucaaggcauuuaggucuaguacagaaaacugugagcuggccagguguggugguucaugccuguaaucccaggacuuugggaggcugacguggguggaucacgaggucaggaguuugagaccugccuggccaagauggugaaaccccgucucuacuaaaaauacaaaaauuagcuggcuaugguggugcauaccuguaaucccagcuacuugggaggcugaggcaggagaaucgcuugaacccgggagguggagguugcagugagccaagaucgugccacugcacuccagccugggugacagagugagacuccaucucaaaaacaaaaaacaaaaaacaaaaaacugugagcuuaggggccagaaugaucuggcuucaaaccccagcuccagcauuuauuaacugugugacuuugggcaagucacuugcccucccuggaucuuaguuuccuccuuuauuaaaugugguauuaauaugaaacuugggcucuuacagaaacuauaccuaauaaauauacaauaaaugguggcugaucaacagaaauaauugggauccauguggcccaggcaauuucaaacacaugaaacucauucuacgaacaguacaaauguaaaguaaaagggaacuacugauaaucaaguaccucaagagagaauucaauguacugcugggguacaaaaaagggaguaaaacagucaagaaaauaauuagaaaaaacagucaacaguguguggcaggaauaaggaccugaagucuaaucugaacuuugcuacuaaggagauuacuccaacgccuaagagaguuuuggcucgcuguuuccuaauuuuuuuuucuuuguaaaaugccgagaauaaagcuggguuucuguuaaucucacugggaugucacaaaccuucacggauacccaucauuccaauaccuuguuuagcuggccucuaugagauggcguagggucacauucugaauuuuucucuucugaaagugugucagaggaggaugucuugcugccaucuguuuuuuguuuccuuucuuuuauauuaaaaagagaaaagugacucaaguaauuaauaaucauguuugccaaauaucauugcccucagaaaacaaccuguuggaaacugccuagagguagaagagguaauuuuauaacccuaaauuacaguauauuuauaaaucuaauaaaggaagaguucaguuauacaauuguuccaauuacugaugccaugauacacauaacuuuuagguuaauucaaugaagcuuauuuagagacacaagacaagaggaaaagaacauacuuaccuauuuuuccuuucuuucugauuuuugcugaaauagcaguaacaguaugagguguuauaucuaaaguuuccacaucaaaguuuccaagaggagggacauagucuggggugacugaaacaaacagcaggcugaagcucaauguguaccaauuacacaccaccauuagacuugaaauucagucacuccauuggcuaaaaacuaguuuccaaaauuaccaagcauggcugaaugcuuauaagacauauucaagucaucugacauuguuuuggcauagcaaaauggccagagauaacacagaaauaucauauuaaguaugaucaauuaucauaaaaccacuuuaaauaaugauauauaacuaacaaacagaaaaaaacuaaaacaaacauuuaaaaucuaaaugguggccaggcaggguggcucgcgccuguaaccccaagcacuuugggaggucaaggcgcgcggaucaccugaggucaggaguuugagaccagccuggccaacauggugaaacccuaucucuaccaaaaauacaaaaaugagccaggugugcuggcagacgccuguaaucccagcuacuugggaggcuguggcaggagaauugcuugaacccaggaggcagagguuguaguaagcagagaucgcaccaccacacuccagccugggcgacaaagcaagccucugucucaaaaaaaaaaaaaaaagggaaagguauauauauauuuauggcgcacaugagauauuuugauacagguacacaauguauaauaaucacaugaggguaaaugggguauccaucaccucaagcauuuaucauuucuuuguguuacaaacaauccaauuauacuauuuuaguuauuuuuaaauguacaguaaguuauuguugacuguagucacccuguugugcuaucaaaaacuagaucuuggcugggcucucuggcucaugccuguaaucccagcacuuugggaggccgaggaagguggaucacuugaggucaggaguucgagacaagcccggccaacacggugaaaccccaucugcaccaaaaguacaaaaauuagcugggugugguggugcacacuucuagucccggcuacucaggaggcugaggcaggagaauugcuugaacccaggaggcagaggucgcaguaagccgagacugugccacugcacuccagccugggugacagagcgagacuccaucucaaaaauacaaaaacaacuagaucuuauucauucuaucuaauuauauuuuugaagcuauuaaccacccucauuuuucccagucccccaaccaccauuacccuccccagccucugguaaccauacuucuacucuaucuccaugaguuaaauuauuuuaauuuucagcucccacaaauaugugaaaauauguugugccuggccuauuucacuuaacauaauguccuccaguuccaucuguauuguugcaaacaacaggaucucauuguuuuuuauggcugaauaguacuccauuguguauacggaccacauuuuauccauucacccgcugauggacacuuagguugcuuccaaaucuugacuauugugaauagugcugcaauaaacaugggagugcagauaucuccuugguauacugauuuccuuucuuuuggguauauaccuaccaguggcauuccuggaucauauggugauucuauuuuuaguuuuuugaggaaacuccaaacuguucuccauagugcuuguacuaauugacauucccaccaacaguguacaaagguucucuuuucuccauauucucaccagcaucuguuauugccuguccuuuggauaaaagccaucuuuuuuuuuuuuucuuuuuuucuuuuuuuuuuuuuaucgaucauucuuggguguuucucgcagagggggauuuggcagggucauaggacaauaguggagggaaggucggcagauaaacaagugaacaaaggucucugguuuuccuaggcagaggacccugcggccuuccgcaguguuugugucccuggguacuugagauuagggaguggugaugauucuuaacaagcaugcugccuucaagcaucuguuuaacaaagcacaucuugcaccgcccuuaauccauuuaacccugaguggacacagcacauguuucagagagcacaggguuggggguaaggucaccgaucaacaggaucccaaggcagaagaauuuaucuuaguacagaacaaaaugaaaagucucccaugucuacuucuuucuacacagacacggcaaccauccgauuucucaaucuuuuccccaccuuuccccccuuucuauuccacaaaaccgccauugucaucccggccuguucucaaugagcuguuggguacaccucccagacggggugguggccgggcagaggggcuccucacuucccaguaggggcggccgggcagaggcgccccucaccucccggacggggcggcuggccggacagggggcugaccccccccaccucccucccggaccgggaggcuggcccggcagaggagcuccucacuucccaguaggggcggcugggcagaggcgccccucaccucccggacggggcagcuggccgggcggggggcugacccccugaccucccucccggacggggcggcuggccuggcggggccugacccccaccucccucccggacgggguggcugccgggcggagacgcuccucacuucccagacaggguggcugccgggcggagggacuccucacuucucagauggggcggcugccgggcagaggggcuccucacuucucagacggggcgguugccgggcggagggucuccucacuucucauacggggcagccgggcagagacgcuccucaccucccagacggggucgcggccgggcagaggcgcuccucacaucccagacggggcgguggggcagaggcgcuccccacaucucagacgauggguggccgggcagagacgcuccucacuuccuagaugggauggcggccgggcagagacgcuccucacuuuccagacugggcagccuggcagagaggcuccucacaucccagacgaugggcggccaggcagagacgcuccucacuucccagacgggguggcggccgggcagaggcugcaaucucggcacuuugggaggccaaggcagguggcugggagguggagguuguagcgagccgagaucacgcuacugcacuccagccugggcaccauugagcacugagugaaccagacuccgucugcaaucccggcaccucgggaggcugaggcuagcggaucacucgcgguuaggagcuggagaccggcccggccaacacagcgaaaccccgucuccaccaaaaaaguacgaaaaccagucaggcguggcggcgcgcgccugcaaucgcaggcacucggcaggcugaggcaggagaaucaggcagggagguugcagugagccgagauggcagcaguacaguccagcuuuggcucggcaucagagggagacgggagagggggagggggagggggagggggagaggcaucuuaacuagggugagaugacaucacauggcaguuuugauuugcauuucucugaggcucagugauguugagcaccuuuucacauauccacuauuuguaugucuucuuuugagaaaugucuauucagaccuuuuacccauuuuucaauccgaauaauuuuuuuuccuaucuuuauauauuccaguuauuagucccuugucagauacauaguuugcaaauauuuucucgcauucugugggcugucucuucacuuugguguuuccuuugcuaugcagaggaaaggaacuuaacuuuuuaacuuaaugugaucccauuuguccauuuuugcuuugguugccugugcuuguaggguauuccucaggaaaucuuugcccacucuaauguccugaagaguuuucugaauguuuuuuguuguuguuguuaguaguuucauaauuugaagucuuagauuuaagucuauaauccauuuugauuuuuguauauggcaagagauaggggucuaguuucauucuucugcauauggauauccaguuuucccaacaccauuuauugaagagagugucuuuccccaauguauauucuuggcaccuuugcugagaaugaguucauuguagguguauggacuuauuucugggcucucuucuguuccauugguauaugcaucuguuuuugugccagcaccaugcuguuuugguuacuauagcucuguaguauaauuugaagucagguaaugcgauuccuccaguuucauucauuuuacucaggacagcuuuggcuauucugggucuucggugguucuauauaaauuuuaggcuuuuuuuuuuucuauuucugugaagaaugucauugguauuuuaauagggauugccuugaaucuguagauuguguuggguagcauggaaauuuuaacaauauuaauucuuccgauccaugaacaugaaguaucuuuccuuuuuuuauuugcucuuuaauuucuugcaucaauguuucauaguacucauuauagugcucuuucacuucuuugguuaagcuuauuccuauuuuauuuguaacuuuuguuuauuuuauuuguagcuauuguaaauggauuacuuucuugauuuuuuucagauucuuaguuguuggcauacagaaaugcuacucauuuuuauaugaugauuuuguaucuugcaacuuuacugaauuuaucuaauaguuuuuugguggagucuuuaggcuuuuccaaauauaagaucauaucaucugcaaacaaggauaauuuaacaucuuccuuuccaauuuggaugcccuuucuuucuuucucucucuugucuaauuguucuagcuaggacuuccaauacuguauuuuauaauagugguauuauauaaguggguauccuugucuuguucagaucuuagaggaaaggcuuucaguuuuuuucuguucaguuuaauaguagcuauggaucuauacccaguuuucugaggguuuuuuaugaugaaaggauguugaauuuuauaaaauuuuuuuaagcaucaauuuaaauaucaugugguuuuuguccuucauucuguugauaggagguaucacauugauuuacauauguugaacaauccuugcaucccugggauaaaucaucccauuuggccaugaugaauaaucuuucuuuuguuuguuuuugagaugggagucucgcucugucacccaggcuggagugcaguggcacaaucuuggcucacugcaaccuccgccucccagguucaagcgauucuccugucucagccucccaaguaguugggauuacaggugcccacaaccacgccuggcuaauuuuuguauguuuaguacaaacaggguuucaccauguuggccaggcuggucucgaauuccugaccucaagugauccacccgccuuggcuuccaaaagugcuaggauuacaggcgugagccaccucgugcccagcugauauuuuuaauguguugcugaauuagguuugcuaguauuuuguuaggauuuuuguaucaauguucaucagggauauuggccugagauuucuuuuuuugaugugucuuugucugguuuugguaucagggaaagcuaagugcuuuauugccucacuacuggccuaguaguacuaccaguauaggacacuucucuuaccugccaaguacuuuuccaggauuauuugcaauucuacaaugugcuuuaaccgagugagcaccuuccccuucaucucaggugauguuuccuggcagaaggcauuuacaaucugcaaaguacaaauuacauucucauacuuccaaauguucagauuuuaaccuuguuuauauuauuuauccagagcugagagaugucuaugaaaagcaagaucuuugaguuuagucuguaauagaacuguccucaacaacgugguauacagaaaaaaaaucucuggcccaaaauauaggagauucagccaggcgugguggcucaugucuguaaucccagcacuuugggaggcugaggcaggaggaucacuugaggccaggaguuugagaccagucuggccaacauggugaaagcccaugucuaccaaaaauacaaaaauuagcugggcaugguggcacacaucuguaaucccagcuacuagggaggcugaagaaggagaauugccugaaccugggaggcggagguugcagugagccgagauugagccaccgcacuccagccugggugacagagcaagacucugucucaaaaaaacaaaaaacaaaggagauuaggcuugugacccuaguuuuacuuauuacuaguuauguuacaagguggaauagccagacagcacacaauuuggugaaacaaguucuauacugcuacuuacugugugaccuuggcugagucuuuaaccuuucuaaguauuucuucauaaagaaaugaguccagcacuugguacaguguaaguacuuaaaaauuuuuaaugacuuugaacucccuauugaaauucguauguguaaaaugaggacaauagcuauccugcccguaucauaauagagaugugguaaucaaauaagcucauucaagugcacaaacauuccugaaauaauaucagagaggaagacagugagguagagauauaagauguugccaucauugucauuaucaccaaacacaaauacauucuaaugggagggaaacuaccaccacucacugaaucaaaacaguaggcauaugccugugccaggacgaacaguaguuccacagugaaggugagaaggucauucuagggagaaggcagcuuggagaaaauaaagcaugggcaaugugaagugaauucuaaguauucucauuuggcuaccuaaggagguucauauaacuggggaguggugggacauaacagcuagagaagcacacggggguuagugcuuggugaagacuucuagggagucuugugggaacuaagaaaauaguuuugagaaaaacuaugcacaauaagugaaacauccuauuaacucugcucaccucucggaaccaguugagaguaagaaauaugagagaacacaugaaugaacgcucuuuagcagacauggacuccaacuucucuccaggcuccaggucaguuaggaauauaggacaaucugagagagaacaaacauuuccaacuaccuuuagugcaagccaauaaaaccuggagguugccucuggagcuagcuguccuugcuauuuacuuuccccuuuaacucauauuugaaggccaagaucugauuaaaauauuugcauaucauauagcaaucaacaaauauaacuagaaaguuuuugcaacaauugauuuguuaacauaaugggauucuguauguacuauuuugucuuuggaauuccaaugauaaacuauucugcugaaguuagaaaauuccuccccacauacaccauguauugaucugcccuuucccuaaguuuaccaaaggaagaguauaaagaagaaaggaucugaugacuucaucccauaccuaguagaccaucaaucuccuccaaguuuccguuaugcugucucuccacacaaagucucaguaaccggaaauacggagccaggcacagcggagacaccaaucugagaaggagaaauaaauuucuagaccacacuucauagguguauuacuccacguacauagggagauauuacuccacauacauagggaacacaacuucuuuuuuugagacagagucuugcucugucgcccagucuggagugcaguggcacgaucucagcucacugcaaccucugccucccagguucaagcaauuauccugccucagccuccugaguagcugggauuauaggugcaugccacacugcccggcuaauuuuuguauuuuuaguagagacaguguuucgccacguuggccagaaaguaaucucagaauaucuguuggcucacacaaggcaauauaaaucucaagccaaggauccaagaaaaaacaaggaaucugccccauucucccuaaccucuccaaauaccauuugucucgagagaaacuuuuuugacucaacuuccccaccaagagcuguggaauuccccaugaacauucaaaacacuaacagguuuagaaaagaaaaacuauacugacuuuuggccugauuccugugaggucaccggacccccaucuuuugcaaaguccugagaaaacagcagcggcaggagguuuauggcaaucccauccugagugucguauucuuccaguccguacagugcuuucacaggaaauggaaagucacugcggagaaaaaccagaaucugauguugcagcucaggaauacgcaaggcuacagggaaaaccacuagagcaaaccaauuucaaacacaacaucauggggagaaauuagaagaacaaacagugaaccuuuuaggaauuuuggagcuaagggugcaggggugcugggguugggaggaaagaagcugugggacugggcagcuguggcugaggugaaggguauucugaaguuuguaucagcuacugacagaauugauguaacuucaccagugcaaccaagccagcagguaaacaauaccuacccuuccggaacaacacaggaguccacuacgaaggcauccuggaaaucauuacagaugguaugcccaacccauuccuucaggaagcaaacaaacaaaaagggcagugcagaguguacuugcuguacagcccuagauaaauuacucuuaaccuuucuaagucucaguucccucauuucuaaaaagaaaguaauaauaaauaucucacuauugugaaguagaaaagagagagugcauaaaaagcacuuagcacaaggcccagcacagaauagggcucucagacagauaauagccaucaucauuaacaaagucaaucucuucuuuacuaucgugauuguuauuaagugaaggagcccucagagaagagccgugagacaggguagggcagaaaagccuuucccaguuagaauuuaggagaggucacaggaugaucuauuuucacacugcaacagaaagacuugaagaguguaguaaagcagcucucaugcuuuauugcuuuaagaaaagacaauuggcuuuaccagggcuuuuggauccagcuuuucauguuggaucagguuggcaaauucaucauaguaaagugcagaggccugaggagacugcucacugcaggaaugaaccaacugcaacaaggaggucaccuggagcaaagaggaagaaugguuuaaaccuugggcugccaaucuuucccaaacuccacucgccccuuucaagacuguuuuuucacuuucugauuuuacuggcaaagcucuaugucucacuugaaguuuuccugaauguucugacccgucugucuccuucugauaucaucccuuuuccaaucugccagacacugcagccagauuaauuuuucuaaaguaaaccuuugauuuugccauuuccaugcuaagaaacccuuaaggaauaccucugccuaaagaaugaaauaaaaauguauugcuuuacaugcaaggcucucuguuuucucucucaaauagcuuuuucuuuuuuucuuuugagauggagccuugcucugucguccaggcuggaguauaguagugugaucucggcucacugcaaccuccacuucccggauucaagcaauucucuugccccagccuccugaguagcugggacuacaggcgccugccaccauguccagcuaauuuuuuuguacuuuuauuagagaugggauuucaccauguuggccaggcuggucucaaacuccugaccucaagugauccuccugccuuggucucccaaagugcuaggauuacaaucgcaaaccaccgugcccugccugaacuagcuuuaugucccacuuuccaauuauguacuuauuuguccccaugcuucaaccaaaguguuauuccauaaacauggcauaucuuucuugcuaagacuuuauaauuuaauuagagagauuaaauggauauagaaauaaaugcaacuggccugggagugguggcucacaucuguaaucccagugcuuugggaggcugaugggggcagaucaccugagaucaggaguuugagaccagccuggucaacauagcgaaaccccaacauggugaaaccccgucucuacuaaaaauacaaauuuaacugggcaugguggugcaugccugugaucccagcuacuugggaggcugaggcaggagaauugcuugaacccgggaagcaccaccgcacuccagccuuggcgacagaguugagacuccaucuaaaaauaaauaaauaaacauaaaaauaaaugcuacccaagccaguaguuuccaagugucagaaaaccacagaaguaggaguucaggaaaacuucuuuuacaaaagaagcacuuucuggugaacugacagugacuagaagcaauucuucaguuacucauaaacauauccaaucacauuauaagaacucggccgggcgagguggcucacgccuguacucccagcacuuugggaggccgaggcagguggaucacuugaguucaggaguucaggaccagcggggccaacauggugaaaccucgucucuaccaaaaacauaaaaaauuagccgggugugguggugcgugccuguaaucccagcuacucuggaggcugaggcaggagaaucacuugaaccugagagguggagguugcagugagccgagaucuugccacugcacugcagguugggugacagagcgagacucucuaaaaaaaaaaaaaagacaggaaaaagaaagaaaggaaaaaaagaacucaccugugugcacugcucaucgcucagguuggcucucucuugggucaaacuaggugauucacuucuaaaaacaaagaauuuuuuuuuaaauuauuauuauacuuuaaguuuuaggguacaugugcacaacgugcagguuuguuacauauguauacaugugccauguuggugugcugcacccauuaacucgucauuuagcauuaaguauaucuccuaaugcuaucccuccccccucccccaccccacaacauuccccggugugugauguucccuuuccuguguccauguguucucauuguucaauuaccaccuaugagugagaacaugcgguguuugguaaaaacacagaauuuuaauuucacuuuuguaauauuuuguaacaacugccaauaaguuuaagaauucugacuucccuaggguaggguaaagauaaaagugcaugaaggcagcgaagaguauuuauuuuguccauacaaaauacagauuagagcaaaggaugguuauccuauauauuuuuuucuuuuuucuuuuucguacauauuuuuuaagggcaaauuagcaauaauuagaggaagcacuuaauuagugcauauuauguacuaaacauuguucuaacccuuuaauguucucaaugacucuaugagguaaauccuauuauuauccuuauugcugaugugagucuacaaaggcagagagauaaaguaacuuacccaagguaauucagcuaauaaacaauggagccagaaucugacccugggcaaccaguauggcuucacugacugaacucuuaacuagaguugcacacucugcaaccucuucccauuauuaaugugugucacaggggagugaugacuaucugagccgguggcgguuggggugggguuagagggagaauuuacuaagacaguuguagguaaagaaaggcagauuucuuagagaaaguauaaaaguacguugcaagaaagcacugggcagccagcaauagaggagcugacugcaaggaaacaacggcuugcuggggauuucuagaguaguauuuaugauguaugcuguaugccgaagagggcuuugugcaguacugauaaugccaaaguugcagugagcuaacuugcaggugucuggugauuaaguugggcgcaggagggcugcauguccugcaccaugaaaaaaggcagacuuacauacuuugucuuugcuuucuuugcucccaccauugugacuccuuuucccuaauuaggauuccacaauguggauucuaaagaugucuccugaugucucagaaaauaaauuccaaggagcaugaacugaaauccaaugucgguuuguaauggcaacaucuuaucaagcccccaaaccgauauuucuuuagauucuacaaauggggccucaaggaacaaggugaggggaaauacacaagaucuuauuuguaucaaauguauaaaguucccgacaggaaugacacagcaauguagacaccugcauugucuagugccuauaucaggagcagauaaagaaaaaugcauucuaaaagaaucaggguucccauuuugugcaaagauuucuagaauuuuaccucuagccaauccuuaauuuuuaaccacagacuguaauggcuaggaucacauuccagcaaaacauauacaugguaauauauacagucacgauuagaagggaacauggaaaaguagcaaaacacauuugcucauuuauaguuguaacuucuacugcuaaaaugaugucuaugagauguaacacuuaguuagcaagauuaacugaucuuaaaccacagaagucagaaucuccacguguaccugucugccgccaugaugccagccauggucacagcaccaauaaucccaaugagcuuguacuugaauacggugcuagagagcugcuuucuuaucaccaagugcaugucauccugcaaugagaugaugaagaaagaugaaaaugcuggaauggcacagcaaaagaagguauggauaucgagccauauagcuagacuauaaaggcguuuaccguuuacuaacuguuuuuuuuuuuuuuugagacggacuuucguucuuguugccuaggcuagagugcaaaggggcaaucucggcucacugcaaccucugccucccagguucaaacgauucuccugccucagccuccuggguaacugggauuacaggcacccgccaccaugcccggcuuauuuuguauuuuuaguagagaugggguuucaccauguuggcuaggcuggugaacuccugaccucaggugauccaccagccuuggccuuccaaaaugcugggauuacaggugugaaccaccauacccagcccugugugucuuuagcaagucaauucaucucuccaaguuuuaauuuuuacaucugugaaauggggacuuuuuuuuuuuuucuuugagaaggagucucgcucugucacccaggcuagagugcaguggcgccaucuuggcucacugcuagcuccaccucccggcuucaugccauucuccugccucagccucccaaguagcugggacuacaggugcccgccaccaaccacgcccggauaauuuuuuguauuuuuaguagagacgggguuucaccauguuagccaggauggucucgaucuccugaccucgugauccgccugucuuggccucccaaagugcugggauuacaggggugauuacgugccuggcccgaaauggagaagguuguuuuaaggauuagcgauacauuauaaaaaacuucuagaacagugccuagcacaugauagacauucaauaauaauaucuuuuauuguuauuauuucuauaaggauaugaaaauuaucauaauguugaucacugcucagccaaaauaaugaacuagaauaaaauacucagguaaagauuuaaacauggaggcaaggcugggcgaaguagcucauaccugucauccuaacacuuugggaggcugaggcugcuggacugcuugaacccaggaguucaagaccagccuggguaacauggcaaaaccucaucucuauagaaaauacaaaaauuagccagcugugguggugcaugccugugguccuggcuacucggaaggcuggggugggaggaucaccugagccugggaagucaagaacacagugagccaggaucacaucacuguacucuagccugggugacagagccagacauugucucaaaauaaaauaaaauaauaaaauaaacauugcugaaaaacauuaaagacauaaggaaauggaaagagcuacugucuucauggauuggaagacacuuaauauugcuaauaccauucaaagugauucagugcaauccuuaucaaagucccacaacauguuuugcagaaacagaaagauccauaccaaaauucacauggaauuucaagggaccccaaacugccaaaaccuugaaaaagaacaaaguuggagggcccacacuuccugauuucaauauuaauacaaagcuacagcagucaaaacaguguggugauggcagaaggacagacguauagaccaaugaaauagaauacagaguucaaagauaagccuucauauaugugacaaauugauuuuugacaagggugccaaaguaauuucaauggugaaaggaccaucuucucaacaaauuggcacuggaaaaacuggauauccaugugcaaaagaaugacguuaaauccuuaaaauauuaaaauaagcuauauacaaaaauuaacacaaaguggaucaaagaccuaaauuuaagagcuaaaaccuucucuuagaagaaaauaaaagaaaacuuucaugaccuuggauucggcaaugguaucuuaagcaugacaaccaaaaggacaagaaacacaagaaaaaaaauugauagagagugggucguacagcuuuggaguggcaaccuucguggugccagcgaugaaaaacagaauuauauaugggugaugcugagaaagguaagaagauuuuuguucagaagugugcccagugccacacgguggaaaagggagacaagcacaagagugggccuaaucuccacggucucuucgugcggaagacaggucaggccacuggauucucuuacacagacaccaauaagaacaaaggcaucaccuggggagaggauacacugauggaguauuuggagaaucccaagaaguacaucccuggaagaaaaaugaucuuugccggaauuaagaaggcagaaagggcaaacuugauagcuuaacucaaaaaagcuacuaaugaguaauaauuggucacugccuuauuuauuacaaaacaaauaucucaugacuuuuuuauguguaccauacuuuaauagaucucauacaccagaauucagaucaugaaugacugacagaauaucuuguugggugguccucauuuaaaacuaagacugguuugugguuaaaugaauaugcuguuuuuuuuaauuuuaauaguaauuccaauucaguaaaugguaucacuguuuaccccuucuaaagauaugauuagacuuuguuaguaauguucaacuuuucacaaagauggugagugccaucuuaaaacuuaauggaggccgggagcaguagcucaugccuguaaucacagcacuuugaggggcugagacaggcagaucaugagguuaagagauugagaucauccuggccaacauggugaaaccccgucucuacuaaaaauacaaaaauuaacugggcguuguggugcaugccccuagucccagcuacacgggaggcugaggcaggagaaucacuugaaccugggaggcggagguuggagugagcugagauugugccacugcacuccagccuagugacagagugagacuccaucucaaaaaaaaaaaagaaagaaagaaagaaaaagaaaaagaaauagauaaauuugacuuuauugaaacuaaauacuuuagugcaucaaaggacacuaucaagggagugaaaacccauagaaugggagaaaauauuugcaaaucauauaucugauaagggaucaauauccagaauauauaaauaacucccauaccucaaaacgacaaaaaccuaauuuaaaaaugggcaaagggcugagcacgguggcucaugccuguaaugccagcacuuugggaggcagagguggguggaucuccugagcucaagcguuccaaaccagucuggguaacaugacaaaacauaaugucuaccaaaauuauaaaaaauuagcugggcaugguggugcacaccuauggucccagcuacucaggaggcugacaugggaggaucgcuugagccugggagguggagguugcaguaagccaagauaacaccacuguacuccaaugugugugacagagugagaccccaucucaaaaacaaaacaaacaaaaauggguaaaggacuugaauagacauuucuacaaaaauauagaaauggccaagaaguacaugaaaagaugcuuaacaucauuagucauuagaaaaugcaaaucaaaccacaaugagauaccacucgcacucaucagaaugauuauaguuaaaaaauagggccuggggagguggcagguaccuguagucccagguacucaggaggcugaggugggaagacugcuuaagcacaggauuuccaggcugcagugaaguaugaucacgccacugcacugcagcuuggguaacagaauaagacccuaucuaaaaauaauaauaauuuuuaaauuaauuaauuaauaaaaaucaaaagaaauuuuuaagaaaggaaaauacauguuggcaaggauauggagaaauuggaaccuacauacauuguuggugggaauguaaaauuaugcagcugcuauggaaagcaguuuggugguuccucaaaaugguaaacauauggucaucauaugauccagcaauuccacucuuagauauacacccuaaaaaacugaaaacagggacucaaacaaauauuuguaaaccaauggucacagcaacauuauucaaauggccaaaagguggaaacaacccaaguguccaucaauggaugaauggauaaacaaaaugugguauaaacaaagaaugggggccgggcgcaguggcucacgccuguaguccuagcacuuugggaggccgaggcaggcggaucaccugaggugaggaguucaagaccagccuggccaacauggcaaaaucccaucucuacuaaaaauacaaaaaucagccgggagugguggugcgugccuauaaucccagcuacucaggaggcugaggcaagagaacugcuugaacccaggaggcagagguugcgguaagccaagauugugccauugcacucaagccugggcgacagagugagacuccaucucaacaaaacaaaauaaaacacaacaacaacaaaaacaaagaauggaauuauuuauuuauuuauuuauuuauuauuauuuuuuuuuugagacagagucucgcucugucucccaggcuggagugcagugaugcgaucucggcucacugcaagcuccguaucccggguucacgccauuccccugcuucagcuucccaaguagcugggacuauaggcgccugccaccacguccagcuaauuuuuuguauuuuuaguaaagacgggguuucaccguguuagccaggauggucucgaucuccugaccucaugaucugcccgccucagccucccaaagugcugggauuacaggcgugagucaccgugcccggccaagaauggaauuauuauagcuguaaugggaauaaaguucugaugcaugcuacaaccuacaugaaccuugaaaauauuaugcuaagugaaauaagcgagacgcaaaaggauacauaucguaugauuccauuuauaugaggcaucuagaaugaacaaauccauagacagaaugugauuagugauuauuaggggguggggagaggaagauggcaaauuauugccuaauggguacaaaguuuguuugggaugaucaggaaguucuagaaauggauaguggcaaugguuguauaacauugugaauauacuuaaugcuacuaaauuguacccuuaaaaacagcuuaaacggucuauuuuauauuauguauauuuuaucaaaauucaaaaauaaaauaaaauagugaaguaguuuuauauugcugauuugaagcaaucuccaaaauaaacugcuaaaugcaaaagcuaagauguagaacaagaagggaaaggaaacuacagguaaacacaaauuuguaaauucucagaacaucucagaagcuuauaaagugauugccccugugggagacaaaccaggugccuacagaacugagaagugagaguuauuuuucacugaauacucuucuauauguuuugaauuuuguaugacacauguauauuaccuaguccaaaaguuuuuuuuuuaauuaaaaaaaaugugcugacuggggauccaagaaagggggggaaaaaaagauaaaaaauaugaugguuguggccgggugcgguggcucaggccuguaaucccagcacuuugggaggccgaggcuggcggaucaugaggucaggagaucaagaccauccuggcuaacacggugaaaccccaacucuacuaaaaauacaaaaaauuagccgggcgugguggcgggcgccuguagucccagcuacuugggaggcugaagcaggagaauggcgggaaccugggaggcggaguuugcagggagccgagauugcgccacugcacuccagccugggugacagugcgagacuccaucucaaaaaaaaaaaaaaaaaaaaaaaaaaaauauauauauauauauauauauauauauguauauacauguauauacauguauauauguauauacguauauacauauacguauauacauauauauauguauauacacguauauauauauauacguauauauauauauaugcugguuguucaaagucacaguccaguaugaauuacugccauaagguagcacuaaagcuacaaacgaguuacaaguuaugauuccaaucuaaucucuucguuuuauuuauuuauuuauuuauuuugagauagagucucacucuguugcccuggcuggagugcaguggcacaaacauggcuuacuguagccucaacuuccugggcucaauggauccucccaccuccgccuccugaguagcuaggauuacaggugugugccaccacaccuggcuaauuuuucuauguuuuuguagagaugggguuucaccauggugcccaggcuggucucaaacuccagggcacaugugauucgccugccuuggccucccaaagugcugggauuacagccuggcuuuuucagugaauggcgcccacaaacaaaagcaagcccacgugaaguucacauuagauggagauguuucuuagaaaacaaggcaauucuguguccccacugcacucagaaacugaacaguuucaugguuagcugaucacagacccaucucuacccuaacagacaaagcuuuuugagggcagaggaucuaauauaucagugccuggcacagaauaggcacuuaauguuugugguaagaaaaaaaaaugcuaguacuauggcuauguacuccauuuccacuacuacacacuaggaaaucuaucauuugcuuguuuuuuuuuuucuagcaaauuucaagagguuuaaaauuaauacaaaauacugagaauacaaaaaaauuuuuuuuaauuuuauucuauuuuauuuuauuuuuauuauuauuauacuguaaguuuuaggguacaugugcacaaugugcagguuaguuacauauguauacaugugccaugcuggugugcugcacccacuaacucgucaucuagcauuagguguaucucccaaugcuaucccucccgccuccccccaccccacaaaguccccagagugugauguuccccuuccugugcccauguguucucacuguucaauucccaccuaugacugagaauaugcggugugcgguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacaucuggguugguuccaagucuuugcuauugugaauagugccgcaauaaacauaugugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcacuuuuucauguguuuuuuggcugcauaaaugucuucuuuugagaagugucuguucauguccuucgcccacuuuuugauggagaauacaaaaauuagcuggguaugguggcacgugccuguagucccagccacuugggaggcugaggcaggagaaucgcuugaacccaggaggcagagguugcaaugagcugagaucgugccaacugcacuccagucuaggagacagagcuagacucugucucaaaaaaaaaaaaaucuuucccaacauauugccucuuaccuggauguggcugcuggcuucauucuguuugcuaaaugccagugugcugagaacauagaagaguuuucguauuugcugaggggauauguuauccagauaaucuaaaaugcccuguggaaaaaaugaugccaacaaugaggcuagcagcuaacauuuuucccuuaaaauucaaaaaauuaaaaucccuguaaaagagacacacauagauagccagguaucuaaaacuuuuuagcucccuuaaaagcucaaagcucaaguucuaaaagcuaugcucagagcccaaagguuugauagacuggauauaaacugggaaaauucuuacaacuuucuaaaucucuuauuaucagagacuaggaacuaacuaucaggaaacauaaaguuuucuuuauccucuucacucugaaccacaauccugggcuuuaaucaucuacugcuuagucauucuaaugcaccucccaguucucgguauucuuuaccuccaccuuucccuuuuuuuucagugaaaacaauauucuaccaaaaguuaugucuuuacccuauuccuugccauaucaucccuucccagcuucuacucaaugaauuauuucuccuuucucuacagaucuggaaggagucacaaggaaacuauuuacuuugugaccuugggaaaugccucagcuuuucucaucuauaacauggugauaauaauagcuauacuaccuuucaugguuugucugaggaaaaaguaauaaaacagcuuuguaaacuuuuaauuaauuuuuaaaaaucuccauuucuuccucucuauugaauccuuucucucagccuacaagcaaucucaaaccuccucaucuaaaaaauaucucccucacaaccagcuucuuucucaagcuacuuuuuuuauucucuccuccuugaugcuucucgacauugacucuauuccccaagucuucaaguuacugcucucuggcuuccacccuuauaauucaauuaacacuguucucucagagguuaccagagguauccuaauugccaaagccaauagccucugccuccaucuucaacuuuuucaguguccaacacugggagauaaaucccucacuccuuuuuguuuuuuuuuuuuuuuuuuuuuuuuuuugagacggagucucgcucugucgcccaggcuggagugcaguggcgggaucucggcucacugcaagcuccgccuccuggguucacgccauucuccugccucagccucccaaguagcugggacuacaggcgcccaccacuacgcccggcuaauuuuuuuguauuuuuaguagagacgggguuucaccguuuuagccgggauggucucgaucuccugaccucgugauccgcccaccucggccucccaaagugcugggauuacaggcgugagccaccgcgcccggccucacucuuuuuuuuuugacaguuucgcucuucucgccuaggcuggagugugauggcaugaucucagcucacugcaaccuccaccuccuggguucaagugauucuccugccucagccucccgaguagcugggauuacaggcaugcaccacaaugcccagguaauuuuuguauuuuuaguagaggagggcuuucuccauguuggucaggcugauucgaacucccaaccucaggugauccguccgccucggccucccaaagugcugguauuacaagcaugagucacugugcccggccaaucccucacucuugaaacucauuccugggcuuuugcuaccugacauccuuuaagcucacauuauuaaucuuccagguuucucauuuuccuucuauggacauuugcuuucaucugccacuuaaacuuuaaccuucucaaaaugucugugcucuucuaagccuuuuuuuuuuuuuuuuuuuuugagacagagucuugcucugucgcccagacuggagugcagugguguuaucuuggcucacugcaagcuccgccuccuggguucacgccauucuccugccucagccucuugaguagcugggacuacaggcgaccgccacgaugcccggcuaauuuuuguauuuuuaguagagacgggguuucaccguguuaggcaggauggucuugaucuccugaccucgugauuugcccgccuuggccucccaaagugcugggauuacaagcaugagccaccgcacccggaccgccacauauucuuaacagucaccaagucauguuaauucuaacaccaaauugucucuuaagccauaauuucuucuacauucccgugaccaaaaucuggcccuuacucucacucccuuagaccauuucagcagucuccaauccacccaucauauagccuacugaguuaucucucaaugcugaguagauuaggucaacuguauguaaaaacuaguaauagcuccuuauugucuaaaaaauaaaguugaaacucuuuagcauguuauuugagacucuuugcaacaugggccuguccuaugucuuaccagccuugccuccaaucauuccucuccauauauauccuauucuccagucaugcuuguuugcuucucauuccucagucacaccauugacuugggcaccaguuugcuucugcucaaacucuucucugccuagaacgcacuucccauacuuucucuugucagucauucccauccuucagcaaucacucacauugccucuuugaagaauucuccagcuucccaggcuaaauuuaauuauucuuacucuguuauaucuauaguacuuuaccagagaauucaccauguuguauuuauagugacuugcuuaugugucuuagucuuuaacaugaaagguaagggccuacuuuacauucacagcacccagaauagagauuagccuguagguuagguauaaagaaguguuugcugaaugaauuaacacauagauagaauagucacuuuuuauuuauauuacuugcccaucaucucaccuccuucccaccaccucccaccaauuauaguauucaauaucuaaaguacaagaagccaauaagauaccuuuacaaagacagcauucaucaucauagcagauggguuuaacacuaccaacucuagaaggacaucuaaggcaguaucaacuucagcuucauucccacugcagauaugggucacuaaggcaccaaccacuuccuauacaggggagagucaacagaacaguguaaaacaaaauauggauggccauucuaaagggauucacccccaaggccucuccaaucucuacuuuguuaaaaucacaaucaacccaaacccaucaccuauuaucuaguuuucauuaauguuggcuucaggagauuuaggaauaugccaguguaacuugaccaucccaucuugaccuauuucccauauuuuaucagugagcucuaccuaagcccuccugauuuugcuccuuggcguaguuuuccucuuucuuuuucccauauggguuaaauuuuacccuuuagguugagguuguacaagaucaguugaaauuccucaaaaagauggcacucaaggagcuaaaagcuuuaaagguuuucuccauauaguacaggcuagacuugcauguuuccaagcaaacauggauuaugacagugucucuaagacauuaagaggguccagaaaugucuuagaugccauucucccuuuauacugucacuccauaauagucauaacagaauuacauuuucaacugcaacagcuaccucaugucagcugcaacuauugcucuacuuuaaauguuuaaaauuuuuuuacaaaucuucauuuuaaaaguuccauucaaaugcguuuuaacauuguuaaugacaggaagaauauauguaaaaauacaaaauaagacacuguucuuuacuugcuuucauaaacauuuuccacaaauacaguccucccucucuggauauaugcuauuaaaaugugucucggccaggcccaauggcucacgccuauaaucccagcacuuugagaggcugaggcaggcgguucaccugaggucaggaguucgagaccagccuggccaacauggugaaacgcugugucuacuaaaaauacaaaaaauuaaccgggcgugguggugugugccuguaaucacagcuacuuaggaagcugagacaggagaaucgcuugaacccaggaggugaagguugcagugagcugagauagcaccacugcacuccagccugggcaugaagagcaaaaccacgucucaaaacaaaacaaaaaaaagugucucauguuuugaaauggacuagaucuggaucuuaauuucagacagagaauuuuagagcucagaacacagaguuagagccaccagucaagucucuuccuuucaucaaggcugggacuagaauugagcuuucuugagacccaggucagaguuccuuccccuucagugaguuccaaccaacaagaaauaaacaucagauuauuuucccuuucuguguucccuccuugccaaaauaaauguuucaacauaccugcuggcaguacgugucaaaaaacuuaaaugcauauuuguauaggagacugccaaaugaaauuauacucuggucuagagagugaagcaaacucugagccagcgacagaauggaugaacacauauccuuaagaaccuugaguggggaagaguagagagagaaaagaagcuguaggaaacaguuaguacacaaccuaagaguugcuuauccuuuuggaaugucagacuucuccucccuagcucucauuuuaacuuaggaaaucuuaaucuuuguuuuacacaaaaauaauccuucaucauucugagauuacucucagcaucaaugggauuccacguuuggauaauaauugacuuuuaagcucaaagaaguuaaauuacaagccuaauagaacauuccuaucugcucaauuugggauuggaggccagauguucuaaaucccaguuuccccaugcaaucauacuacccccagggauguuccaccuugguuauaauuugaaguaggucuauaagguucaaugcuaacuaagcugauuuuuuuaaaagaagaucaagaagagaagugaucauaaccuaccaauaauucaauguacauagacauuaauggacccagacuaaauaaccaguuaauaaacauagcuuccuuauugauaccauaauuuuuaaaaaucuuauauuuaguacuaagcuggguauaaugcuuuauuggggaaaaugcaaugaaaaauuacaugugguuucugcaucuagaaaauuacagcccaaaacauguauaauuggcagaaauaaacacagaaagaacugcaagauaaaauaauacaaccguuaaaucuauuccuaaauauaaaauuuaagacccagcgagguauucucauuagcuccuaacccaaaccccaaaccacuggcccauccaguuuucuaaguucuauacugcuaauauccugaacguucagcuggcaaaacacuauuccuagcuuauaaaauuccacuuugaauaauuuacauuucuagaggaauuaucaccuaaaguccacaguuuugaauggcuaaagagugauaguucaaauagguacauauuuacauuucuacuaguuucuacaggcugguccuauuccccucaagguuuuuauaagcuacuuaaauaggauacggaaggccaguuugucaaaguugcaaacugcauugagauagacaauuaaaaugauuaaugcaaaaacaaaauucaaaaaucucaauggguuugaacaauggacugaaauaagaugaaauuuuacaugagagcuguaaagcuuucuguuuuagauuaaaaaucaauagucucugacacuuacuaaguaaugaacagagaauguacucuggagcagcuguucuugaaugcagccugaucgaaucuuauuucuuagcacccugucaauguacuucuuugucugaguauuggugcuauagaugaugaaaagcaucaccaggucaaacaccuauugucaauaaauaugcaacaacagaaaaacaguuaacaaaucaguacauuugcuacaaugaaacagcagcuuuuccucuaauuaaaacacagaauggauaaugcucauuuguuccacacacuccccugggaguaucuacacuuuucacaaaacucagaaauauuuuucagauaaauaaagugccacaacuguuaaccauugauaccccuuaagaauacagagcaggccaggcacaguggcucacaucuguaaucccagcacuuugggaggccaaggcgggcagaucacaaggucaggagaucgagaccauccugacuaacacggugaaaccccgucucuacuaaaaauacaaaaaauuagccggguguggcagcaugcaccuauagucccagcugcuggggaggcugaggcaggagaauggcgugaacccgggaggcagagcuuacagugagccgagaucgcgccacugcacuccagccugggugagagagcgagauuccauucucaaaaaaaaaaaaaaagaauacagagcaauaugcaugaaagugauauuacuacagaaguaacucugaacaucuugacauuuauuaaaagaaagauucaaucacuugccaacuccagcguguauuuguugccaacuacaguauguauuuucaguauuacuaggaaaauuacuaggccaggcacgguggcucacgccuguaaucccagcacuuugggaggccgagauggguggauuacgacgucaggaguucaagaccagccuggccaagaugcugaaacccugucucuacuaaaaauacacaaauuagccgggcaaaguagcacacaccuguaaucccaccuacuugggaagcugagacaggagaaucgcuugaacccgggugacagagguugcagugagccgagaucgagccacugcacucgagccuaggugacagagcaagacuuugucucaaaaaaaaaaaaaaaaaaggaaaauuacuuugugaaaaguuggaaagacuauaaaugcccaucaauacaucaauacaggaaagguucaauaaauuaugauggaguaauuuuaauuuuuggaauauuacacagucaucaggaagaauaagccaugcuaggcaugguggcucacgccuauaaucccagcacuuugggaggccgaggcgggcagaucaugaggucaggagauugagaccauccuggcuaacaugaugaagccccauuuccacuaaaaauacaaaaaauuagccgggcgugguggcaggugccuguagucccagcuacuugggaggcugaagcgggagaauggcgugaacccaggaggcggagcuugcagugagccgagaucacgccagugcaguccagccuaggugacagagugagaacccgucucaaaaacaaaaacaaaaacaaaacaaaacaaaaaaagagaaaacauugggcguguauucagggcaaccugagucuaugcuuccaggaaaaaaaaaaaaacaguuaaaaaggcaagcaggacaaacaagaaaaaacaaaaaaaauuuuacuacuuaucuuaacugaaugcuccacuucuuaggacaccaaaacugaguuauuagaccagaauacagucauuaaagauaacaaugaagacaaugcagaccuugaaauauuuaugacaggagaaaaaauguuaagaaaaaaaaguaagaauacaaauuauauuuauacaaugauuacaaauauguaaaaauagguaugcaggcagccaaggugguaaauuuauguuuauccaaaaccaaaaacaguguguuggaguacuuugauauuuuucaccagaaaaaauucugaauuuucauugcuuuauucagcaucaugaaagcuuuuaagauaaucaucccaaaauuggauaacaaaacuaacaaaaaucccacaaaacagauuccaaccaaagaaaaaucuuuaaaggcaaccaaucagcaccuaaggaacucaaucauccggcuuuuuaucuuuugagauggagucuugcacugucgcccaggcuggagugcaguggcgugugccaccaggccaggcuaauuuuuuuuguauuuuuaguagagacgggguuucgcuacauuggccaggcuggucucaaacuccugaccucagaugauccgccugccucagccucccaaagugcugggauuauaggcgugagcuaccgcgcccggccaaucaucuggcuuuuugauggaagguauuucuagaauuaauagagacauaagauccaguaccacugccuugacaguggacagauugauuuacucuagucaggucuacaugagcaaaguaaaguaaaacauggaaugccauuaucuugacaguggugcugaguggaaggaagggcaauuaggcagauacagggaccugagacuuaggugguuauuuucuucaucucaucaguggggaccuggcuucuuugacugcaccuugaugugcuuguuuacacuguuaguauuuccccuuguggauacuguaggcuuauuuuauagccagagugaguaggggcaggcuaucuggccagucgccaccucagauuaucuuccccagacagcuaauguuuauuagagcaacuagggaagagagagaagagugacuggaggggggagaaagaaagacagugggaaggcaagcuagccaaugucauuacuuuuaagucugcaauacugaaaaugcauaguacaugaacauuaccuuguguucagauacugaggcaguguuuucaauugccugaaaaaacaggagagagucacaaaaauauuaugacacaucagcgaaacacguuacaccuuauucagcaugcccuguuaucucaucuaagagccaauguguccaucuggcaaccaucagcuaucauuuccacuugaaugaguuuugagauuuuuauuucagucuaccucaguuauacaucugucacuaauugccacucauuuccuccuugauaaucaaaguuccaaagaucucaccuuaauccaggcuucugaaaugguuuucucauaucuaauagcugacuuuauuacaucaaagaggagaauaauacagcucugaccgcugcuuucuugauuuccugaggaacuacaaguagcagagaggaaaaaaauuacucuucuacguaccagaaaagaacuuacaagaucggaguuccugccauguacccuggagcaaaugacaaccucauguauaagauggcuaauaaacuugcacugucgucugucugggauugaucugaauggcuaagaaaauauauaaacacauacauacucacauacauauauguaauuugaaaaacaauauaauacuagauguaaaugucauaauaguaucauuauuuguaguaguauuaagcucuaacucugacagugggaugucagaaaauugugacauccugugugaggaugagcucuuuaccuugcucguccuuuacuuuucaacuuuacuugggaagccuguaaccgugauggcaaaacacaaugcugcagauccaacuucucccgaagcucagaaauuaccugcagaaaguaaauauuagcuaugguuuucugcucauucauaguggguaggcacaguccagucucucuaccaugacaaucuccugaaagacugaggaagaaaaaaauuuaaauguuggacauuuugaaaaauagaguuaugagaauagccaaugcaaugucauagaacaucauacccaaaauuucagaauucugugagguacuacacaggaagaguaaauguaacuuauagcagcuuauauagaucaaugaaucuguugaauagcuccauucucuccucugaaugcuauccggauuagucaguauucucaguuagucuggggacagagaagagcaauuggcacuuaaguugcuuuaucuaggugugaugggauauaagagcauaccucaaguguauccauggcuguuacggaaugaagaaugaacuuuauuaucacagguaaauccuccaaucuaauagacgacaacuuauccaucaccaacuggcgaaccuaaaaauuaaaagcacagaaacuuaauagguuuucaugucacuaccucaacuuuguacugaacuguuagauaaaauuagaaaaaaaucacuucucuuacuccaucuucccacuuauaauuuagggaaaaacaaaauuuuagauuuuuccccaaauuagaaucuuuuaguuguuaauaccacagcuucaucaaaaauagacgggcaauaaaugugaaacagagcuauuaucuuacauuuagagccuaaauucucaacuggcuacaguaaggcauaaaaaguauuauuccuaugggaagcagguaugacucagacaacauggaagauuuccacucaaaacuuacugcuuaaaaacagaccugugggccaggcacgguggcucaagccuguaaucccagcacuuugggaggccgagggggguggaaaacaagguccggaguucaagaccagccuggacaauauggugaaaccccgucucuacuaaaaauacaaaaauuagccgggagugguggcaggugccuguaaccccagcuacuugggaggcugagucagggaacugcuugaacuugguagguagagguugcaguuagcggagauugcaccacugcacuccagccugggugacagagugauacuccgucucaaaaaaaaaaacagaccugugacucuaccauagaauagcaucugaaacucauugaggggaaaaaaaaaaaaaaagagagauaucaaaugugauucacuaugguuucaaaaugaaauauucauuacucccaaggcaaugacugacugacacuuguucugggagguuggaaagcuggcucuguuucuggaaagcugagucuuuucuaccuucaauaggaaguuugggucaagucggaggcuugaaaggacauccaggauugggacagugagugaaguauucucuaucaguaggucacugugaaugguagaaaaagaaaaaaguuguauaaugguuugaacagagcugggcagacaaugacuugagaaaaucauuuauuagaguaugaaaauaaaggacauacuuaguugccauuaaguuaccguuuauaguauguuucuuuaaaaauuguuuugacugcaaaaaauaauacaugcucauuauaaaaauucaaauaauaaaaguagaaacaagaagccuuccaucacaauccccacuacccagagaacaccacuauuuaguuugguauguauccuuccccgcaaaaaggaaaaagaaaacccaaaacauuuacaaugaaaucugauaaguaugagagacacauguagguggugcuacaggagcacaacauagugagaaggacagugauagauugcuuuuuuuuuuguuuguuuguuuuuugagacagggucuuacucugaugcccaggcuugaguacaguuacaguggugucaucacagcucacuguagcuucgaccuuccacgcucaauugauccucccaucucagccuccugaguagcuagaauuauaagugcguaccaccacgcccaccuaauuuuuguauguuuuugaaagacggcuuuucaccauguuguccaggcuggucucaaacuccugggcucaagugacccacccacuucagccgcccaacaugcugggauuaaaggcaugagccacugcgcccaacagacggugacagaugcuaaaaaaaaaaaaagacuauacaaaaggagaugagcuggcaucaggcagguaaaguggauggcguaguacuuugcccagaaggagcauccugcccaaaaggaugagggcaagaaaucacuggauguuuuggagguagcuuugcagacaacuauacaaaaggaaguauuacaaacugaauuuaaaaaaaauacuucuaguacaauaaaaaguugcauuaagauggaaacuuuauuaccuagggauauuguucuccccuucuucaauacuucccuaccaauuacuauuuuucaaaugaaugacaguaagcaaugggucuccgcaagcggucugaugcaggacugugcauuagaaugaaucaccuaggaacccaaagaagguagauguuuaauaggcuccacaaaugauuuuaaugugcagccaggguuaaggacccccugaagaacaaguuaaugaaacuuaagggaucauggucaacuucuccacuggccaaauuuagauaucuaauccuaagccagacuucacgcucauaacagguauaccauuuaaaagaaaguacauggggccaggcacgguggcucaugccuguaaucccagcacucugggaggccgaggagggcggaucacaaggucaggagaucgagaccauccuggcuaacauggugaaaccccgucucuacuaaaaauaccaaaaaaauuagucgggcaugguagcaggugccucuagucccagcuacuugggaggcugaggcaggagaauggggugaacccaggaggcggagguugcagugagcugagaucgcaccacugcacuccagccugggcgacagagcaagacugucucagaaaaaaaaaaaaaaaaaaagaaaguauguggaucuauucaaauauauaccuuuuuuuuuuaagucaaaucccauacccuacucaugaagggggguaucauccucuuuuuagauagaagagaccauauuacuacugcucuuugcauacugcagugauagaacccccauagcugagccucacuuagaugaugacagaggguuuauccaccugaguucuuuccccacaucagcgugcugggaauccccuaggaucucagguaggcuggugaugaugucaugcugcagguucucuggagcaauacugaucagcugcaugaucuugguggugagguccugcaguagaagacacuauuagaacugcagcacauuacccagaauaaagaaagacuaccuacgugugaaaugcagagcugaaauuauuugagaaauaaacacagucauuuaucucuguacuuugaaaaagaaucuucccaaauauuuaauuuauuuaauaaaugauaucuacucuucguauuuaaacuuuucugaaauuuaaagggugaaguaucuaugauucucaaauuaugaaaauuggaaaaagcuaauggauggauggaaaaguaugaauuuucuguuuagaaagaaaaaaaaauacaaccuccaaaagauaugagaaacauacucuuuaaauucaagagauaaaguccauaagccuaccuugccauccacaacucugucaagccauuuuaguugacugacaaugagucgagguauguugauuucaucacuguucuugcuaaaauguuaggaagagaaaacagggaacugagccuuucuggucaaaauaacagcaagcauuaauacugcacaaaauauuuuagccauuccauuaacauuuaccgaacaccuacuaugcauucggcacugcacuagacacacaagugauacccaagaugcaggagauacaugcuuacguauguuaagaaaaaugucuagaagacaugcuaaauaugaacagugacuacauccagggaggauuuagagagaagggaugacagggcuagacagcaucucuuaauaauaauuuuuaaaaagacaauguuaauaaaucuuaaaaacugaauaugacaaguauuuuuaaaagguaagacacuaauaacaucaacgcaguaagugcuuaaaaaggcaagcauaagucagaugcaguggcucaugccuguaaucccagcacuuugggaggccaaggugggcagaucacaugaggccaggaguucaagaccagccuggccaacacggugaaaccccaucucuacuaaaaauacaaaaauuagcugggcacgaugguggguaccuguaaucccagcuacuugggaggcugaggcaggagaaucgcuugaacccagaaggcggagguugcagugaguugagaucgugccacugcacuccagccugggugacagagccaagacucugucucaaaaaaaaaaaaaaaaaagcaagcauauauugcuaagggaacauagaaagucaaauuagauuauauuuauaaaaguacuaaaaaucauuuauaaauaaagaaauguuggcucaauuaucauuuuuccaaauaugauaguuuccaccuuccuucgagccuccuauaucuaaaguuuuggaccacuuccaucuccuugacagcaugguccuuguuauugcagccaaucuuaacugaaaaagacuagccaggauguaaagcauccagcaugagacauuuagcuaaaacaaauuugaaaaaauaaaccuucagugggugcaguggcucacuccugcaaucccagcacuuuguggggcugaggcaagcagaucacuugaggucaggaguucgaggccagccuggccaacauggcgaaaccucauaucuacuaaaaauaccaaaaauuagcugggugugguggcgcacaccuguaaucccagcuacucggggggcugaggcaggagaaucacuugaacccaggaggcagagguugcagugagccaagaucgcaccacuguacucuagccugggcaacagagugagauuccgucucaaaauaaguaaaccuuuaaacuuacuauuacuguaucaggacucugaaaaaauuaaaaaggagaacauaaaaaugacuauaauccugucauuccagaaagguacacuauuaauauacauauguguauguguguaucuucuuuuuuaaacaaaauacugaacuacuuauugcaaaaacugcaauuacuuuugcaccaaccuaauauaagugcuauguguaaccuggguuuguuuuuuucaauuaauguaugauauuaacuaauucuuuuuacaauuauuaaugugcacauaauauuucuauuuuuugaacaucucaauuauuuacauuucuuuauuuuaaagaguaaucuuuuucaauauacggaacacuucacaaauuuggguaucacccuugcaaaagggccaugcuaaucucuguauuguuccaauuuuaguauacgugcugccaaagcaagcacuaaacuaauauuauuucauuuucauucacaguuauuaucuuaggauaaaugaggagacaugacauuaggauuaaaggguaugcaaaaucuaagguuuuugacacauacaaucuauugcucuuccgaaucgaugccugaacuaauuuauaugcucacuagcaacguacaagcaugccuauucacuacacucaacaaggagacccuuugagaguaggaaaaaaugcauuuauuuuacuguguaauaguuauuauuuacuauuuugauacaguguuuuaaauuugugccuuugauugcuaacaaaauugaacuuuuuaaauauuugauguucuuguauuucuucuuuguaaacugucuguucaugaccuuugucuacuuuucuauuaggcuguucauuucuuaacauaguaauuaaaaaaaaacagguagggccacaucccaguaguuugagaggcuaaggcagguggaccacuugagccuggaaguuuugagacuagccugggcaacauggcgaaaccccaccucuaccaaaaaaaaaaaaaccacgaaaauuagcuggaccggguggcgcacaccuguagucccaggcacucaugaugcugaggugugaggaucacuuaagccugggagguggaggccucagugagccaugaucguacuacggcacuccagccugggcaacagagugagacccugucugaacauacacuacaaaauuuaaaagguaaagaaaaguauucagaaaauaccugauuccaaccaacuggcuacccucuuuggagacaacuaccauuaccaguauauuguguauccuucuacuagggauuaucccugagcauaagcaacagauacuuaaaaaaaaaaaaaaaauucuguuuugaaauacagacaaggucucacuacauugcccaggcuggucuugaauuccugaacucaagcaauccuccucccucagcuucccaaacuguugggauuacaggugugagccacugcaccaggccaauaguuacuuuuaacaguaauccuaucuauuuuuacaaagucauauuaauagaugaaacuucaaagacacuccaguaaaauuuuaguagucacuuaagaaauauaaugauaaauaugacuuucagagaaaccaauaguuuucagaguaaccuuuucagagagaacuuaaguacaucaggguacuuugaacauuccauaauaacgccacuuacuuuucaaaaaaauauucuggcaacuucucaaauaagguuuugauaauggcaggcuaaaaaagaagacauagggaguuaggagaugaucucaaaauacacaauagaaauguauaaucccagcuacuugggaggcugaggcacgagaaccucuuggaccuggggaaggcagagauugcagugagccgagauugcaccacuccacuccagccugggugacaaaggagacucugacucaaaaaaaaaaaaaaaaaaagaaauguauaauucucuuuccaacuagagcuccuggaauaaacacuuugcuaaaguugauaucuuauuacaaggauauccacacgaauaugucuucauuuuuagaauaugcuauuggaauacaaagacuuaauuugucuucugaaaaacugaaaaugauuaucaaggcaacguuaaaauaaucagauaauuaaaauauuauuaaauacaauaacuguuaauccacaaaaugcaaacuuuaaaagauuaucaaauaacuugcaaggggagcucucaggaggaacaagggagcucuuagacuuaaaauaacuaaauuaucuucaagauuuccagugaaaaggaagaguuuaagagugugaaaagauuaacaguaggggagaagaggaaaaauggagaaugggguggagggaaguuuucugcucuauauacauuuguauaacuugagauauuuaaaucauaucaauguauugucuacuuaauaaaagagacgaggaggaggaaaaggacaaaauuaaguuacauaagcaucuaaaaagcuaaaugggagauaauguagauaugaauaugauaaagauuaccagauacucagagauacacaggaugcagcuuuaagaacaggaaucagaugcagagagaauaaauggggccgccagauguauuaggcuaauaagcacaguuuuaaaacacagacauuacccuaccaaacccaucacagcaacagggcugugcuaaagcugcuacaaacccaaauucuccaauuaacccuacucuauccuguguucccgcuauuuagacuugagcauacaccacaaaccucuuccaucaaauguucacagaaaaagugacagucuuaccugcaguaugucaauccccagaagcaguuugaugagacucuuagaauaagaugcacccauacuguaaaaaaaaaagaaaucuguuuuccacuuugcuuuccuuguuuuaaugcuuuuaucaucuuuucucaauaaaauugguuaaauacauaauauuuaaagaggaacuacccuguuagacaagaaauacagaaaugagcagauggcucuuugcaagggagagguagagauuugaaauucugucagcauagguaaaacacugauuguuaggcucauaaccacaagcuuaggaauuuuaaacuuaguuuaaacucugaggaaaacagagcuuacaccaaaaaugaaauuugaaacaacugugcucucccuccccagccccaugaaguuggcaaaacagacugaauuucagcaagauuccaugccuccucuccacaccuggcuuccucauccugcagacgcucacaagacaaaaggcaguuccugaaacugucuucauccucaauguaagacuccaggccacuaacaaauucuucuauuaucuuaaggagauuuaaaaaauaaaaaagaauaaaauuuuuaguuuaauauuugcuguuaaaaaucauucuagcccacucaacuuuauaccaguguccuuaaauuccaaauucuagaguuaugcuggcacaagcaaaaauaccaggggaaaaauacauacuuugggauaggaagggugucuccucagggucugaaagagcuucuuuuggaaagcuauuugauccacagcuaugcagaaaaaagaagagcuggucaccaguuuccuaccauaguuuuccuucucuaaaaacccaaguuucuugccugaugaaaccaauaaaaauauuuucaaccuaauuucagagacaaaucuuuuuuuuuuuuuuuuuuuuugagauggaguuuuguucuguugccuaggcuggagugcaguggcgugaucucagcucacaggaacuuccgccuccuggguucaaaugauucuccugccucagcccccccaaguagcugggacuacagacacguuuuuuuuuguuuuguuucguuuuuuguauuuuuaguagagacaggguuucacuguguuagccaggauggucucgauuuccugaccucgugauccacccuccucagccucccaagugcugggauuacaggcauaagccacugugcccagcccagagucaugggguugugucuaaacccacauaaaagacuuagcuuuggcugggcgcgguggcucaugccuguaaucccagcacuuugggaggccgaggcagguggaucacaaggucaggagaucaagaccauccuggcuaacacggugaaacuccgucucuacuaaaaauacaaaaaauuagucaggcaugguggcgggcgccuguagucccagcuacuugggaagcugaggcagaauggugugaaccugggagguggagcuugcagugagcagagaucgcgccacugcacuccagccugggcgacagagcaagacuccgucucaaaaaaaaaaaaaaaaaaaagacuuagcuuugauagcagauagccacuaaguguucuaaaaaagaccugccauaaccuuagcaagauagaauaaucugcucccccaaaacagaaucuuauauggcuuuauaaauuuucuucugaaauuauucugacacugauacagcugcuuucuggauauuuauuuuuucauaagaaaacacaaaauaaauaauauauaauauuuuuucuaauaaaaggaugagaaaugcuuuacuuaagacauaguaaugaggaccaaagacuguaccauuuucuuuuuccauuuuuguuuuuuggaaauggagucucacucuugucgcccaggcuggagugcaguggugcgaucuugacucacugcaacuuucaccucccggguucaagcaauucuccugacucaggcgcccaagcagcugggacuacaggcacaugccaccaugcccggcuaauuuuuuauauuuuaguagagacguguugcccaggccggucgcaaauuccugagcucaggcaauccgccugccucgagccucccaaagugcugggaugauaaacgugagccaccgcgcccggccugacuguaccauuuucuaaaaagcaauuucaacuuugucucaagauggauggcccucugauuucuaaucuucauugccucucuauuuagaaaacccaugauucaguccugaacuauuucauuaaacccagagaauaaaauuagauuaaaauauuaccuaguugauucugacucucucccguuuuaagaauaauuccugauaucuuaagaagcuuuacaaagaugcugucauuuucuucaacuucauuagcaauaugagauuucuuugucuuuuuggaaagugguugcuuccugguuucugaaaauagaaaaauuuucaagaauauggcaaauaguaaaggaaaaauuaaaacuuaaacccaggaauaauaaucaugagaggaaaacugauguguccuuaaaaauuauacuaggauugaugcuguagugaaauaaacugucuucagcaauaguggcuuccaaaacaaacaaauagaauuauuuucaccuauuuucauuugaagaauucaaaaugugccauuucuggccaggcaagguggcucaugugguaaucccagcaaauuaggaggccaaggcaggaggaucacuugaagccaggaguucaagaccagccugggcaacaaagugagaccacccccccaucucccccccuucacccccauucccccccuccacacacaaacuaguuaggugaggagacgcacaccuguagucccagcuacuucggaggcuaaggcggaagaauaacuugagcccaggagguugaggcuauagugagcuaugauauuaccacugcacuccagccugggugacagagugaaauccccaucucuaaaaaaauaaauucaaacaaauaagugccuaacaagaauaacccacagaaauguuuuccacccaaauacuaaacuagccagugucucucaagcuguugccugcaaaccacuguacuggaaucccugggaagcuuauuaaaaugcauauuuccgacccagcacaguggcucacgccuguaaucccagcacuuugggaggccgaggcaggcugauuaccugaggucaggaguucaagaccagccuggcuaacguggugaaaccccaucucuacuaaaaauacaaaauuaacugggugugguggcgugcgccuguaauaccaacuacucgggaggcugaggaggagaaucacuugaacccgggaggcagagguugcagugagcccagaucgcgccacuucacuccugccugagcaacagagugacacucugucucaaaggaaaaaaaaggcauauuccaugccauauaccagaguuacugagucaaaaucuugggaaugggaccuaggaauccgaauuuuuuauguucuucagauaauaauccugauacacaccaaauuugagacucaaugaucugaauaaaggguagacagaauggggaagguucuuuguaucauaucuuugacuacaaugcucagauagguuuaaucccaagacuuucaacccauaaaaagaaauaagaaacaagaaacaaacagguacuugaagccaaguuuaaaauuuacucuucucccuuaaugaugccauuuuguuuuuuccuucuucaauuccucucccucuuucuuuuuuuuuuuuuuuugaaauggagucuugcucugucgcccaggcuggagugcaguggcgcgaucuuggcucacugcaagcuccgccucccggguucaugccauucuccugccucagccucccaguagcugggacuacaggugcacaccaccacgcccggcuaauuuuuuguauuuuuaguagagacgggguuucaccauguuagccaagauggucucaaucuccugaccucgugaucugcccgccuuggccacccaaagugcugggauuacaggcgugagccaccgugccuggccuccuuucccucuuucuaauaaagccuuaaucagaaugagacaaagaccacuaccuuccugaaugaaauguaaaacacaaccagaaugaaaguuucaguuuguucauuacugaccaagagaacccaaaucccuucuaauaaacuuaauucagaagucucuucucuuuuggagaacaguauuuccaaaguauaacauuuacuuucaguaauuuccuauauuauuccucuucaguuucaaauuuucuaccaauuucucuauauucuaauucuagaaccccauuacuaaucaaccauuggagcuucacaacuuccuuuuuuuuuugagauaagagucuugcucuguugccccggcugaagggcaguggcgugaucucagcucacugcaaccuccaccuccgggguucaagcaauuccccugccucagccucccgaguagcugagauuacagacacgugacaccacgcccagcuaauuuuuguauuuuuaguagagaugggguuucacuauguuggccaggcugaucuugaacuccugaccucaggugaucugcccgccuuggccucccaaagugcugggauuacaggugugagccacugugcccggcccacaguuuccguuucuaaaucaagccuauuccuuacaugguuuuggacucacaauuuuuaucauuauaaucacuguucagcaagcauuuucaucuauuucgguugaauugaccaagaaucagacuuaacuuccaauaaccuaguaagaaauaacucuucaauccacaagucaguagaagcuaagcuaugagaaugcaaaggcauuaagaaugacauaaugaggccaggcaugguggcucacguccgauaucccagcacuuugggaggcugagguggguggauuaccggaggucaggaguuugagaccagccugacuaacacggugaaaccccuucucuacuaaaaauacaaaaauuagccaggcaugauggcauguacauguaaucccagcuacuugggcggcugagccaggagaaucgcuugaacccgggaggcggagguugcagugagccaagauugugccacugcacuccagacugggcaacaagagccaaacuccaucucaaaaaaaaaaaaaaaaaugauauaaugggccaggcgugguggcucaagccuguaauccuugcacuuugggaggccgagauggauggaucacuugaggucaggaguuccagacagccccuggccagcauggugaaaccccgucucuacuaaagauacaaaaaaaucagccgggcaugguggcuggcgccuguaaucccagcuacucgggagacugaggcuggaaaaucgcuugaaccugggagguggagguugcagugagccgagauugugccacugcacuccagccugggugacagagugagacuccgucucaaacaacaacaacaacaacaacaagaaugauauaauggacuuuggauacucaagagaaaggguggaagggggguuagggauugaaaaaauacacauuggguacaccauacacuuuucgggugacaggugcaccaaaauuucagaaaucaccacuagagaacuuauuuauguaaccgaacaccaccuguucccaaaaaaccuaguaaaauaaaaacaaaccaacacaaaucaagauuaauagaguagauaagagcaauaaaugaacuaucaaccuccccgccccccacucccuuuuugagacauggucucucuugcucugucgccuaggcuggagugcaguggugcuguuauugacucauugcacccucgaccuccugagcucaagugauccuuccacuucagccuccucaguagcugggaccacaggcacaaaccaccaugcccagcuaauuaaaaaaauuuuuuguagagauggagucucgcuauguuacccaggcuggucuugaacuccuagcuuuaggugacccucucaccuuagccccucaaagugcuuggauuacaggugugagcgauagcacccagccaucaacuccuuauaucuggaacucuugggaucuuugucaacuauuucucauaugggcagagucugcacuguuucuuugccucugguuugcuugcuuugauguauuuuuccuuucacaucacuaacauagcaugugucuagaucauaauauuuuuuuuccaagagaggaagaaagaccauaaaguuuuuuaaggguacagacuauguuaugucuuugugucucaacaccuaaaugauguauagcagaaaaagucuguaacacuaauuccucuuauggauguggagacugagguccagaggcuguggucauacucaaaguuauacgcagaauucgaggcaaaaacucagucccaaaucugauauuucucccuuaauucugugcacuccauucauuacacuuugaagauucucagcacuugaaaagcaggaacuuuauaucucucacaugccucacacauugcuacaggaaauaaagcaacaaaugacuagauacuuacuggaggcaucuucugucaggcucucuuuauccucagauuuugacagucuucuuuuggaaaccauuuugaccaaugucuugugcacuuaaauuacuuccuagagcaaaaucgggaaacagaaguuacccucuagaagauaaauucugagaaguuaaagcuauuguucaaagaaaacugcucuauccaaaaucagaggggcucacaucuccauauuaaugcuaccuaaaccuaggugcuaagcaaauuucaacucuuacaucuagccaauacuaccuuccuuucaagucuuaguuaccucuuuaggcagacuacuucgcuguugcugaaggauaaaacccaucacucuccaucugagauucaagacccuccauuaucuauccccaacguaccuguccuuuaauucaugauuucaauacuauauguuagggacugugcuaggugcugggguuacaacugugaacuagacagacaugaucccuguccucagggaauuuacaguaugguaacaaauagccuuaauguacugaacuacaguuauguaagugcuauaaaaguacagguucuaugagggcuuacuaggaaauuuagucuaguugcuaguaagggugguaaagagaagcaaggaccauuucuuagggacaaucuccuugaauuuuuuuuuuuuuuuuuuuaguagagacaggguuucaccaugucggcuaggcuggucucaaacuccugaccucaagugauccacccaccucggccucccaaagugcugggauuacaggugugagccgcccggccuaaagaagugauuuuuuuuuuuuuuuuuuuugagacggagucucacucugucacccaggcuggagugcaguggugcagccucggcucacugcaagcuccaccucccggguucacaccauucuccugccucagcuucccaaguagcugggacuacaggcgcccgccaccacgcccggcuaauuuuuuguauuuuuaguagagacgggguuucaccguguuacccaggauagucuugaucucauaaccucauaauccgcccgccucggacucccaaagugcugggauuacaggcgugagccaaccgcgcccggccugaagaagugauuuuuaggcagggacuugagggcugaaacagcaguuagccaguagaagggguaggagaagaggaguccaggcaaauagauacucauacugaaacaaggagauguggaguuagaaaucagacagcagaggugggggaagugccugaaucacaugaccuuuuaaucuuguaaaucagaaccuucguggucucagugccuuugcacaaagguguucuuuucaucugaagugcucuuauuugccuggaaauuccuacucagaucuaaacauucaaucgaaugucaucuuccuugaaaaguguuccuccuaucccuaagggaguuugcuacugcagcuucccugcuccacaggguauaccuaggggcccuuaccucacacuagacuggggcucuuugagagcaggaacccagucucacuuacucaaugucccuaaugcccagcauaguuaccggcauaaggaaaauuucugagaauauucagagugaaaaaagcucgcagugcaggggaaaugcuaaaagcuaacaagaacuguuucaagugcuuuauauuuaauaauucauuuauuucccacaaaacuuuuugagguggguaccauuauucucaucaucacgggcagaacugggauucuaacucggagucuggcuucagcaccugcgcucuucaccaccuauacuuacucuugaugauuauaaugacuucuaauaaugguuaacauuuacgagguaccgggcccugugcuaaacuuuuuauuuaucgccgcuucgguuaauacggauaaccauuaucagccaucuugcagauggaaaaacuaagucuugucagcacguccggcuuccaggcacccgccuuuaacacgugcgauaccaucuggcuuccagaaaagcccaacagaagugagaugaggccgacugccuggauuaguucaucgggaagcgggugaggguaaaagccuuucucguuuccgcauuuuaaugacgcagaaagguaccuguggggauuaucccaucucagggcagaugaggaagccaagguucggggcgcggagccccagaggagaacgccgaccgcggcccggacuuagagauuaggccgcaggggagcggggccucgagagacuacgaccauugcuccacuuacucaccgagaagccgucgccgcccguaguuuucgacuuucccgccaggcc

SEQ ID NO: 191670 - RNA, 11542 nt, Homo sapiens
gaggccuguagggucggggcgccugcgcagucgcucuuccucaggcggcggccauggcgggacaggaggauccggugcagcgggagauucaccaggacugggcuaaccgggaguacauugagauaaucaccagcagcaucaagaaaaucgcagacuuucucaacucguucggucagcgggccagcaaggggaggcggggaggagggaggccgcugaggugguugggcuggggcgccggggagaugcuuugagaggacucccgcagccuucggcuguugcggguuuucacuuccuccuucaggucccaccuucucccucccgcccugacccucaggcucccguagacagucucuguaggguuauccugcccuacgcugagcucauggcuuccugccaucccucuggauccauucuacaaguccuucuccuagacgcgucaggcagccccauccucgcuccgugguucuucuccuaaguggucucccugccuccuuuguacucugcauccauuccgguccccacuuugcacucaaagugagcauccgggaccgugucacuccucuguuucaagacuguugaccguuccccaucuucaggaucuggucgauacccucuagcgucgugccuuuuaguuggacccguugucaaccacucccgucuuguccauuccuuccuguuuccugugucugcugcggugagaguggugggagaugaggucagagggaugccaggaucuuguaggaccuuggaaguccucucuguauugcuaguauauauagcuuaugguagguguucugucugcuucuagcccauuccucagagcuaacacaggucgggugccuucagcagaaagauaucuuuaccagaaucuuuccuaggcauggccugcuugugacagccuuaaauucuuccuuaugaacagcaagcaaagcaaucgagauuccuaccccuucuucuccaaguguuuaacagaacuuggcacugguuagacuuucuuguguaauuacaggauauagggacuaguguacuuuggaaagauuuuuaaaugaaugauucucuaacuaaaggacugauggccuuaggaguacaaaggugacagagcaagagauugucagaaagcaucagcgagagaugcuagagcuccauaugaggcccucucuuaaggcauagugggagacacagaauaagaaccacuuccuacauucaaagaaguucuaaucuugaagaugaaauaaugacaacuucaggacaaagaagagcaucauuuuuguauuaaaguauuuucauacaggguguuuaggacuauaaucguggcugaguucaauggcuuaugucuguaaucccagcacuuugggaggccaaggugggaggauugcuugagcccaggaguucaagaccagccugagcaacaugaccagauccuaucucuacaaaacaacgacaacaaaaaaauuaguugggcauggucaugcacaccuguugucccagcuacucgggaggcugagacaggaggaucacuugagcccugaaggcagugagccauguucaugccacugcacuccagccuaggcgacugacugaaaauugaaaagccuaagcuuaggauuugcaaaggagaaaugucccuuuucuugcuuuauaggcaaggagauaucagcuuggauauuuuuaugucuaauuuguaagagucacauuuuaugaucagauagagaguaaagacuuuauuugggcuuuucaacaaauucuuuuuuuuuuuuuuuuuuuugagacagggucucacucuagcccaggcuggagugcaguggcgugaucucagcucacugcaaccucuuccuccuggauucaaaugauucucaugcccccgccuccugaguagcuaggauuacaggugugcaccaccacaccuggcugauuuuugugcuuuuaaaaauagaggcagguuuuggccaucuugcccaggcuggucucaaacuccugagcucaagugauccacccgcuucggccucccaaagugcugggauuacaggccugagccacugugcccugcccccaaaaauucuaaacuaaggaauuagacauacagaaguccagucuuuuggagccaaaagaaaugacuucccuuagcuuagaucauuauccucccuuaaagugaugauaauggccaaauguuuggaguaauuacuaggugguuuuuaaagauuuuagaaagugaauuuagagaaaauaacaauuaaauacaacuaaguaagaagagaauuauaaugcaggauuaacagucaaaggaauuugacuuagcaguuagguguaccugaggcaaguucuuaaagauuggcaugguggcucaugccuguaaucccagcacuuggggaggcugaggcgagcagaucaccugaggucgaguuugagaucagccuggcuaacauggugaaacccugucucuacuaaaaauacaaaauuagcugggcaugguguugcacaccuguaaucccagcuacucaggaggcugaggcaggagaauugcuugaaccggggaggcagagguugcagugagcagggaucgugccacugcacugcagcuugggcaaaagacgagacucugucuccaaaaaaaaaaaaaaaaaagauugacacuaucacaaugcaagaguuuagaaaaagaccccaccggcugcgaaacuggauaaauuaaauuauaaggauagacuugaguauguugucuugguauugaaugagucaggaugacuauguaugggauguuuuuuucccauccuaagccauuaguaggcuuguacaauugucccuugaacaauacauguuugaagugcauggauccauuuacagguagauuuuuuuuuuugagacagauuuucauucugucaccuaggcugaagugcaguggcaugaucucggcucacugcaaccuccaucucccagguucaagugauuuucuuggcuuagcuuccugaguagcugggacuacaggugugugccaccaugcccggcuaauauuuguauuuuuaguagagacaggauucgccauguuggccaugcugcucuugaacuccuggccucaagugauccaccucuguucaaccucccaaagugcugggauuacaggcaugagccacugugccuggccauaaguggauuuauugcgauaaaaguuauacaguaugccuaccucuccugccuccccuuccaccucugccacccaugagguagcaaaaccaaccucucuucuuccccuucuuccucagccuacucagcaggaagacaaugaggaugaagaccuuuaugaugauccacugccauuuaaugaauaguaaauauauuuccuuuuccuaaugguuuuuuuuguuuguuuguuuuguuuguuuuuuugagacggagucuuguucuguugccuggagugcaguggugcgaucucggcucacugcaagcucugcacucgcgccacugcacuccugccugggcgaaagagcaagacuccaucucaaaaaaaaaaaaaaaaaagaauuuacuuugaggccaggcacaguggcucaugccuauaaucccagcacuuugggaggccgaggcaggugaaucacuugagcucaggaguuugagaccagccuggccaauauggcgaaaccccaucucuauaaaaaauacaaaaauuagccaggcauggugucucaugccuguaauuccaagcuaccugggaggcugaggcaugagaaucacuugaacccuggaggcaaagguugcagugagccaagaucgugccacuguacuccagccugggugacagagugagacucucucucaaagaaaaagaauuuacuuugagggagcaucugaaguucuucaaauauguuagcaauucuguaguccuuacccugaccacagagaaucugcaugggccauguauuuuggagagagaacuguuguucuaagauagugaaugacuuucugaaaagcauuuaccuugugauuccugcuggugagaguagagucacagucucccacgugaacuugaggacauacaaaucguaauguagcaaaaauaucauaacacuaggccuauuuugcacuuuggaauuggugaaguuucuaaaaauagaugguuagagauuaucgcuuuuuauucuuaugcuauuuuuuucugguucuaaagguaauauaugcagagaaguauaaagacaaaauagagaauguggcuguuuuuuuaaaaucuugguuuuuguacugagccaacaaauguagcaugccuggugugugucagaugcugugagaaaggaauaaauaugaauaaauggguaugauacccacuccuaagacauucagaauuuugcuggaaaaguaagacuuaacuacaaaaacauuccaaaagaaagacaguuuuuguuuuuuuuuugagacagagucucauucugucgcccaggcuggagugcaguggugcaaucucggcucacugcaaccuccgccucccggguucaagcgauucuucugccucagccuccugaguagcugggacuacaggcaugcgccaccacgccuggcuaauucuuuuuuuuuuuuuaagauggagucuugcuguguugcccaggcuugaguacaguggugcaaucuugacucacugcaaccucugccucuuggguucaacugauucuccugccucagccucccaaauagcugggauuacaggcacacacaaccaugcccagcuacuuuuuguauuaguaguagagaugggguuuugccauguuagccaggcuggucucaaacuccugaccucaagugaucugcccaccucagccucccaaagugcugggauuacaggugugaaccaccgugcccggccugacaguauugauuuuuguaaugcugaaguuauaugcauuaaguucagagaaggagcugucugauaacagcauuuguuuccuaacgagaacugguauuuucaguuaaaggcuggugauaauguacacauacuugugcucugguuucagauuuauccagcugcugaaugcuuucucaguguuuuuuauuugaaccagcguauacuuauuaggauuugaaauaugaccaagguuucugcaguugaacauuuucuauuucucaacaguguuuauccauguaggccaggagcauaguauuguucuugaauucuaauucauuaccagauugacagcuagaacagaauagccacccaggaaggaaacuucccucucuccuaccucccccaauaauuuucguaugucuucaugggaaauggcagguugucagagauaauauucaugcucuuacucaguagcauacauaacgugcuuucagacuuccaaaaaccagacugaaaagaggcuugguccuguugggcaguuccgacagaaaguggcaguacauccaggaaaagggggaugcugaagugaucauacuuaagcuagaccugggaauucaagcagcacaagcguaaaaagaaugaagaauguccagaaauggcaaauccauagagacaaagauuagugguucccagggacugaggggugacagaauggggagugacaggacuaagagguauaagguaucuuuuggggaugaugaaaauauucuaaaaguagauuauaauuauugcacaacucuguaaguauacuaaaaaccacugaauuguauacuuuaagcaggugaaagaauggaaaguggcagaguugggcuggagaccugggguauaaauuauagccccggaggcacagaaagaugauaguagugugcauugggaugcacacaguaugggaaagaauaccagugacccaacaugggcccucagcuuaccuagaccucaguuuucccacuuguaaggugaauagaguuacacuagagucaaucuuuuguuccacuaauauaccagaauccaucuuuuuuuuuucagucaacaucuauguaccaggcaagaugcuaagguuacaagaggcaauauguacuucuuuugauuaacuuguucuaacggugaaacagacauguaaauaaauuguaaauuacaaguacauaaauaucauuugguuucguaacaugaauauuuuccuauuucauuaaauauuccucaaacuuuuuuuuuuuuuaagacagaguuucacucuuguuguccaggcuggagugcaauggugcaaucucggcucacugccucaggugauccacccaccucggcuucccaaagugcugggauuacaggcgugagccucugcacccggccacuuuuuuuuuuuuuuuuuuuuuuuuugagauggagucucgcucuguugcccaggcuggagugcaguggugcagucuugacucucugcaaccuccgccuccuggguuuaaaccauucuccugccucagccuccagaguagcugggauuacaggugugcgccaccaugcuuagcuaauuuuguauuuuuaguagagacaggauuucuuuuuuuuuuguauuuuuaguagguaugggguuucuccauguuggucagguuugucuugaacuccgaccucaggugauccgcccgccucggccucccaaagugcuggaauuacaggcaugagccaccgcgccuggccacuuguaacuuucaauggcuauuuuaauagucucauuaauacgcuauaucaaaccauuccaaucaugggcauuugguuuuguugcuuuuucaccaucuuaaauaguagugaugcacauucuuauuuguaaaaucuuuauccaaagagggaagucauaaccaaagaccaaguacaugaauaacuuacaaauuagaaauucagaggcuggcacggugccucacgccuguaauccuaggacuuugagaggccaaggcagguggauugcuugaguucaggaguuugagaucagccugggcaacaaagugagacccccauaucuaccaaaacaaaaaacaaaaaaauuagccaggcacaguggcauccaccuacugaguaguaauugcagcuacucgggaggcugagguggaaggaucacuugaaccuaggaguuggagggugcaguaagcuaugauugcaacacugaacucuagccugggugacagagcaagaccaugucucuuuuaaaaaaaaaaauucauccguaaauguuuagauaaauacagaagaggaagaauuauuauguccaucuggcaagaccucucagagauagaauuugaacuuagccuugaaggagauaggcaggcaagaugaguaagauuuggacauaauaagaugaaaguugaggcaagaucaggguguaggaagauuugucaaaauggaugcugaagcgcuuuugcaaaacagccagggaauagaugaaaaggaaacuuguuagcuaaguguuaaaucauugcgugggagagucucagcgaauauuucagacuugaaaacugaaguuuauugagagaugacugaacaacaauguuggaggagagaguagaagauaaugaccaugcuaagauaccuuuucucucauauguugagaauaguuggaaaaagaauaguuccuguuacagaaguuugcagagaaaaaguuguuuuaaauuaaaucugguuucauuuugaaugagaugguaaaagaagauuggaaaagcuagaggaagaagaauaauuuuggcuguuuucacagauggaaugugggcuuuaucggguauuugaugcucuccaacuuuucucuaguucugaaaggccuuugccucuaggagcaacaguagugacauggcuuuaaugagcucagaacucucacaccuucccuccccauaauuucugcugcuuucuuggccucuacuuucuuuccuuuuuuuuuuuuuuugagacggagucucacucuguuucccaggcuggagugcaguggugcaaucucggcucacugcuaccuccaucucccggguucaagcaguucucugccucagccucccgaauagcuggaauuacaggcgcccgccaccacacccggcuaauuuuuuguauuuuuaauagagacgggguuucauuguguuagccaggauggucuccaucuccugaccucgugauccacugccuuggccucacaaagugcugggauuacaggccugagccaccgugccuggccuuuuuuuuuuuuuuuuuuuuugagauggagucucacucugucacccaggcugcagugcaguggugcaaucccagcucacugcaaccuccgccucccagguucaagugauucuccugccucagccucccgaguagcugggacuagaggcacccgccaccacacccagcuaauuuuguauuuuuaguagagaugggguuucaccauguuagccaggcuggucucaaacuucugaccucaguugaucugcccaccuuggcuucccaaagugcugggauuacaggcgugagccaucacgcccagccucguuucuuuccuguugagauuauuuucuuauucuugccauguccccucucuugaaagucuuaguuaggccauuaguaaauggcuguacagccuugguguauucauuugcuauuccuggcauaacauauuaccacacaggcugggcacaguggcucacacuuguaaucucagcacuuugggaggccaaggcgggcggaucacgaggacaagagauugagacaauccuggccaacauggugaaaccccgucucuacuaaaaauacaaaaaaaaaaaauuagcugggcaugguggcgcacaccuguagucccagcuaccuaggaggcugaggcaggagaaucgcuugaacccgggaggcagagguggcagugagccaagauugcgucacugcacuccagccuggaaacagagugagacuccaucucaaaaaaaaaaaccaaaaaaacaaauuaccacacauuuuguggcuuaaaccacauacauuuauuauuuaccauguguaggucauaaaucaaacacuggucacugggcuagcaaucuucacaccuuggccagcagucuucacaccuuggccuucugaaguauuaggauuacaggcaugagucacugcuccuggccugggcuccaaucaggguuucagcaggacugccuuccuuucuggaggcucuaggagagggucuaguuccucgaauauuggguuguuggcagaauucaguuucucgugguuguaggacugagaucucuguuuuguugcuggcugugagcugagaguuguucccagcuucuaaaggucacuuacaucccuugguucauggcucccuucuuccacuuucaaagccaacaauggcagauugcauccccuucacacuuggaaucucuuuuucuucuuccauuucaucucugacccccuuccuaugccuuucucaccuacauuuguggacuaugauuagauugggcccaaauggacaauccaagacaaacucuaggaucucaagguucuuaaccuuaaucauaccugcaaagcccuguuuccucauguauaauccauauucacaggauccagggauuagagaaaggacuuuuuuuugagacagaguuuugcuguuugacccaggcuggagugaaguggcgagaucuuggcucacugcaaccuuugccccccccgguucaagugauuuuccugccucagccucuuaaguagcugggauuacaggcaugugccaucaugccuggcuaauuuuuguauuuuuaguaagagacaggguuucaugauguuggccaggcuggucccgaacucuugaccucaggugauccacccgccuaguccucccaaagugcuaggauuacaggcaugagccaccgugcccugcaggaaaggacguuuuuguggggccguuauucucuacuugcaacacuugauaggaaguucagcagauccacucuaagcaacugugcuaugaguggaucuuagcacuguauccauuuccauuuguauucuguguauuauuccucuuuuucauuguagguguugugugugucugugucuguguuuggagugacauuaauccugaacaccagucucuuuuucucagauaugucuugucguucaagacuugcaacacuaaacgagaaauugacagcccuugaacggagaauagaguacauugaagcucgggugaguuugaugggcaagggcauuccagagagaaugcacauuuccacuuauugcugaaaaaaaccugaaagcagaaacagucuuaggaaacuuaagcacuggccggacaugguggcucacgccuguaaucccagcacuuugggaggccaagacagguggaucacuugaggucaggaguucgaguccagccuggccaacauggugaaaccccaucucuacuaaaaauacaaaaauuagccaggcaugguggcucacaccuguugucccagcuacucgggaggcugaggcaggagaauuacuugaaccugggagguggagguugcagugagccgagaucacaccacugcacuccagccuggguggcagagugagacuccaucucaaaaaaacaaaagaagagaaaaguuaagcauguugccuggauuugaaccauguuucugugacuucacagcuaucuucuuuucugcuauuucucacugccuaggaucuaaagauuuuuuuuuagaccccucuaaucuuuuuuaauuuaucuaaaugucaguuuuccuuuccuuucacaggugacaaaaggugagacacucaccuagaacagugccgugcugcugcugggaaguugcuuuacacaacacaggccacaugggaaaggccccagcagccuucagcuccuuccuuucuccuuaaagagcaacagggcuuauucuuguuuuucuuuuuucaaaaguguggccuuugggcucugccaucugggguguggugugguaugugggaagaaguucagaggaaccguuggaaacgacguuaggcauuuuaccuuuucaguaacauuuuauacaucuacuugucaauguauuugagacauucacagccaaaagccugggacucuuugugaagguccuccucaccucuaucuuucuuucucucucucucaaacuuuccuuaaaguucucauugccuuugcacugcuucugugaacagucuuugucuccuccccaccuuuggugggaagugcggggcaguccuggucaagacacucaugcccuggcaauguggcugccagagaauguuguugcuaacccaccaguuucuuguugauuuggagaggucaaggccaggcccccacuuggcuugaagggacauuuucagacuuuucuuucugucacuuggagugucuaugccucucauauuucccuaauaaacuccucaacuuuuuaucugacugcugugauuaugguggggagaggagcuagagauggguucacuuauugcacagaaauguaauacauggcguuauuauucuaacauaaaacuuucagauguagcuguuugauucaaagccuagguggcuuaccagcccaaguccccauguuuggacuuucagcugacuagcucaucuugggaaucauuuggucauucagcacauuuaccaaguauuuacuauguaggcauguuaaacuccaauaaaacauacagcauugaaucaga

SEQ ID NO: 191671 - RNA, 11542 nt, Homo sapiens
ucugauucaaugcuguauguuuuauuggaguuuaacaugccuacauaguaaauacuugguaaaugugcugaaugaccaaaugauucccaagaugagcuagucagcugaaaguccaaacauggggacuugggcugguaagccaccuaggcuuugaaucaaacagcuacaucugaaaguuuuauguuagaauaauaacgccauguauuacauuucugugcaauaagugaacccaucucuagcuccucuccccaccauaaucacagcagucagauaaaaaguugaggaguuuauuagggaaauaugagaggcauagacacuccaagugacagaaagaaaagucugaaaaugucccuucaagccaagugggggccuggccuugaccucuccaaaucaacaagaaacugguggguuagcaacaacauucucuggcagccacauugccagggcaugagugucuugaccaggacugccccgcacuucccaccaaagguggggaggagacaaagacuguucacagaagcagugcaaaggcaaugagaacuuuaaggaaaguuugagagagagagaaagaaagauagaggugaggaggaccuucacaaagagucccaggcuuuuggcugugaaugucucaaauacauugacaaguagauguauaaaauguuacugaaaagguaaaaugccuaacgucguuuccaacgguuccucugaacuucuucccacauaccacaccacaccccagauggcagagcccaaaggccacacuuuugaaaaaagaaaaacaagaauaagcccuguugcucuuuaaggagaaaggaaggagcugaaggcugcuggggccuuucccauguggccuguguuguguaaagcaacuucccagcagcagcacggcacuguucuaggugagugucucaccuuuugucaccugugaaaggaaaggaaaacugacauuuagauaaauuaaaaaagauuagaggggucuaaaaaaaaaucuuuagauccuaggcagugagaaauagcagaaaagaagauagcugugaagucacagaaacaugguucaaauccaggcaacaugcuuaacuuuucucuucuuuuguuuuuuugagauggagucucacucugccacccaggcuggagugcaguggugugaucucggcucacugcaaccuccaccucccagguucaaguaauucuccugccucagccucccgaguagcugggacaacaggugugagccaccaugccuggcuaauuuuuguauuuuuaguagagaugggguuucaccauguuggccaggcuggacucgaacuccugaccucaagugauccaccugucuuggccucccaaagugcugggauuacaggcgugagccaccauguccggccagugcuuaaguuuccuaagacuguuucugcuuucagguuuuuuucagcaauaaguggaaaugugcauucucucuggaaugcccuugcccaucaaacucacccgagcuucaauguacucuauucuccguucaagggcugucaauuucucguuuaguguugcaagucuugaacgacaagacauaucugagaaaaagagacugguguucaggauuaaugucacuccaaacacagacacagacacacacaacaccuacaaugaaaaagaggaauaauacacagaauacaaauggaaauggauacagugcuaagauccacucauagcacaguugcuuagaguggaucugcugaacuuccuaucaaguguugcaaguagagaauaacggccccacaaaaacguccuuuccugcagggcacgguggcucaugccuguaauccuagcacuuugggaggacuaggcggguggaucaccugaggucaagaguucgggaccagccuggccaacaucaugaaacccugucucuuacuaaaaauacaaaaauuagccaggcaugauggcacaugccuguaaucccagcuacuuaagaggcugaggcaggaaaaucacuugaaccggggggggcaaagguugcagugagccaagaucucgccacuucacuccagccugggucaaacagcaaaacucugucucaaaaaaaaguccuuucucuaaucccuggauccugugaauauggauuauacaugaggaaacagggcuuugcagguaugauuaagguuaagaaccuugagauccuagaguuugucuuggauuguccauuugggcccaaucuaaucauaguccacaaauguaggugagaaaggcauaggaagggggucagagaugaaauggaagaagaaaaagagauuccaagugugaaggggaugcaaucugccauuguuggcuuugaaaguggaagaagggagccaugaaccaagggauguaagugaccuuuagaagcugggaacaacucucagcucacagccagcaacaaaacagagaucucaguccuacaaccacgagaaacugaauucugccaacaacccaauauucgaggaacuagacccucuccuagagccuccagaaaggaaggcaguccugcugaaacccugauuggagcccaggccaggagcagugacucaugccuguaauccuaauacuucagaaggccaaggugugaagacugcuggccaaggugugaagauugcuagcccagugaccaguguuugauuuaugaccuacacaugguaaauaauaaauguaugugguuuaagccacaaaaugugugguaauuuguuuuuuugguuuuuuuuuuugagauggagucucacucuguuuccaggcuggagugcagugacgcaaucuuggcucacugccaccucugccucccggguucaagcgauucuccugccucagccuccuagguagcugggacuacaggugugcgccaccaugcccagcuaauuuuuuuuuuuuguauuuuuaguagagacgggguuucaccauguuggccaggauugucucaaucucuuguccucgugauccgcccgccuuggccucccaaagugcugagauuacaagugugagccacugugcccagccugugugguaauauguuaugccaggaauagcaaaugaauacaccaaggcuguacagccauuuacuaauggccuaacuaagacuuucaagagaggggacauggcaagaauaagaaaauaaucucaacaggaaagaaacgaggcugggcgugauggcucacgccuguaaucccagcacuuugggaagccaaggugggcagaucaacugaggucagaaguuugagaccagccuggcuaacauggugaaaccccaucucuacuaaaaauacaaaauuagcugggugugguggcgggugccucuagucccagcuacucgggaggcugaggcaggagaaucacuugaaccugggaggcggagguugcagugagcugggauugcaccacugcacugcagccugggugacagagugagacuccaucucaaaaaaaaaaaaaaaaaaaaaggccaggcacgguggcucaggccuguaaucccagcacuuugugaggccaaggcaguggaucacgaggucaggagauggagaccauccuggcuaacacaaugaaaccccgucucuauuaaaaauacaaaaaauuagccgggugugguggcgggcgccuguaauuccagcuauucgggaggcugaggcagagaacugcuugaacccgggagauggagguagcagugagccgagauugcaccacugcacuccagccugggaaacagagugagacuccgucucaaaaaaaaaaaaaaaggaaagaaaguagaggccaagaaagcagcagaaauuauggggagggaaggugugagaguucugagcucauuaaagccaugucacuacuguugcuccuagaggcaaaggccuuucagaacuagagaaaaguuggagagcaucaaauacccgauaaagcccacauuccaucugugaaaacagccaaaauuauucuucuuccucuagcuuuuccaaucuucuuuuaccaucucauucaaaaugaaaccagauuuaauuuaaaacaacuuuuucucugcaaacuucuguaacaggaacuauucuuuuuccaacuauucucaacauaugagagaaaagguaucuuagcauggucauuaucuucuacucucuccuccaacauuguuguucagucaucucucaauaaacuucaguuuucaagucugaaauauucgcugagacucucccacgcaaugauuuaacacuuagcuaacaaguuuccuuuucaucuauucccuggcuguuuugcaaaagcgcuucagcauccauuuugacaaaucuuccuacacccugaucuugccucaacuuucaucuuauuauguccaaaucuuacucaucuugccugccuaucuccuucaaggcuaaguucaaauucuaucucugagaggucuugccagauggacauaauaauucuuccucuucuguauuuaucuaaacauuuacggaugaauuuuuuuuuuuaaaagagacauggucuugcucugucacccaggcuagaguucaguguugcaaucauagcuuacugcacccuccaacuccuagguucaagugauccuuccaccucagccucccgaguagcugcaauuacuacucaguagguggaugccacugugccuggcuaauuuuuuuguuuuuuguuuugguagauaugggggucucacuuuguugcccaggcugaucucaaacuccugaacucaagcaauccaccugccuuggccucucaaaguccuaggauuacaggcgugaggcaccgugccagccucugaauuucuaauuuguaaguuauucauguacuuggucuuugguuaugacuucccucuuuggauaaagauuuuacaaauaagaaugugcaucacuacuauuuaagauggugaaaaagcaacaaaaccaaaugcccaugauuggaaugguuugauauagcguauuaaugagacuauuaaaauagccauugaaaguuacaaguggccaggcgcgguggcucaugccuguaauuccagcacuuugggaggccgaggcgggcggaucaccugaggucggaguucaagacaaaccugaccaacauggagaaaccccauaccuacuaaaaauacaaaaaaaaaagaaauccugucucuacuaaaaauacaaaauuagcuaagcaugguggcgcacaccuguaaucccagcuacucuggaggcugaggcaggagaaugguuuaaacccaggaggcggagguugcagagagucaagacugcaccacugcacuccagccugggcaacagagcgagacuccaucucaaaaaaaaaaaaaaaaaaaaaaaaaguggccgggugcagaggcucacgccuguaaucccagcacuuugggaagccgagguggguggaucaccugaggcagugagccgagauugcaccauugcacuccagccuggacaacaagagugaaacucugucuuaaaaaaaaaaaaaguuugaggaauauuuaaugaaauaggaaaauauucauguuacgaaaccaaaugauauuuauguacuuguaauuuacaauuuauuuacaugucuguuucaccguuagaacaaguuaaucaaaagaaguacauauugccucuuguaaccuuagcaucuugccugguacauagauguugacugaaaaaaaaaagauggauucugguauauuaguggaacaaaagauugacucuaguguaacucuauucaccuuacaagugggaaaacugaggucuagguaagcugagggcccauguugggucacugguauucuuucccauacugugugcaucccaaugcacacuacuaucaucuuucugugccuccggggcuauaauuuauaccccaggucuccagcccaacucugccacuuuccauucuuucaccugcuuaaaguauacaauucagugguuuuuaguauacuuacagaguugugcaauaauuauaaucuacuuuuagaauauuuucaucauccccaaaagauaccuuauaccucuuaguccugucacuccccauucugucaccccucagucccugggaaccacuaaucuuugucucuauggauuugccauuucuggacauucuucauucuuuuuacgcuugugcugcuugaauucccaggucuagcuuaaguaugaucacuucagcaucccccuuuuccuggauguacugccacuuucugucggaacugcccaacaggaccaagccucuuuucagucugguuuuuggaagucugaaagcacguuauguaugcuacugaguaagagcaugaauauuaucucugacaaccugccauuucccaugaagacauacgaaaauuauugggggagguaggagagagggaaguuuccuuccuggguggcuauucuguucuagcugucaaucugguaaugaauuagaauucaagaacaauacuaugcuccuggccuacauggauaaacacuguugagaaauagaaaauguucaacugcagaaaccuuggucauauuucaaauccuaauaaguauacgcugguucaaauaaaaaacacugagaaagcauucagcagcuggauaaaucugaaaccagagcacaaguauguguacauuaucaccagccuuuaacugaaaauaccaguucucguuaggaaacaaaugcuguuaucagacagcuccuucucugaacuuaaugcauauaacuucagcauuacaaaaaucaauacugucaggccgggcacggugguucacaccuguaaucccagcacuuugggaggcugaggugggcagaucacuugaggucaggaguuugagaccagccuggcuaacauggcaaaaccccaucucuacuacuaauacaaaaaguagcugggcaugguugugugugccuguaaucccagcuauuugggaggcugaggcaggagaaucaguugaacccaagaggcagagguugcagugagucaagauugcaccacuguacucaagccugggcaacacagcaagacuccaucuuaaaaaaaaaaaaagaauuagccaggcgugguggcgcaugccuguagucccagcuacucaggaggcugaggcagaagaaucgcuugaacccgggaggcggagguugcagugagccgagauugcaccacugcacuccagccugggcgacagaaugagacucugucucaaaaaaaaaacaaaaacugucuuucuuuuggaauguuuuuguaguuaagucuuacuuuuccagcaaaauucugaaugucuuaggaguggguaucauacccauuuauucauauuuauuccuuucucacagcaucugacacacaccaggcaugcuacauuuguuggcucaguacaaaaaccaagauuuuaaaaaaacagccacauucucuauuuugucuuuauacuucucugcauauauuaccuuuagaaccagaaaaaaauagcauaagaauaaaaagcgauaaucucuaaccaucuauuuuuagaaacuucaccaauuccaaagugcaaaauaggccuaguguuaugauauuuuugcuacauuacgauuuguauguccucaaguucacgugggagacugugacucuacucucaccagcaggaaucacaagguaaaugcuuuucagaaagucauucacuaucuuagaacaacaguucucucuccaaaauacauggcccaugcagauucucuguggucaggguaaggacuacagaauugcuaacauauuugaagaacuucagaugcucccucaaaguaaauucuuuuucuuugagagagagucucacucugucacccaggcuggaguacaguggcacgaucuuggcucacugcaaccuuugccuccaggguucaagugauucucaugccucagccucccagguagcuuggaauuacaggcaugagacaccaugccuggcuaauuuuuguauuuuuuauagagaugggguuucgccauauuggccaggcuggucucaaacuccugagcucaagugauucaccugccucggccucccaaagugcugggauuauaggcaugagccacugugccuggccucaaaguaaauucuuuuuuuuuuuuuuuuuugagauggagucuugcucuuucgcccaggcaggagugcaguggcgcgagugcagagcuugcagugagccgagaucgcaccacugcacuccaggcaacagaacaagacuccgucucaaaaaaacaaacaaaacaaacaaacaaaaaaaaccauuaggaaaaggaaauauauuuacuauucauuaaauggcaguggaucaucauaaaggucuucauccucauugucuuccugcugaguaggcugaggaagaaggggaagaagagagguugguuuugcuaccucauggguggcagagguggaaggggaggcaggagagguaggcauacuguauaacuuuuaucgcaauaaauccacuuauggccaggcacaguggcucaugccuguaaucccagcacuuugggagguugaacagagguggaucacuugaggccaggaguucaagagcagcauggccaacauggcgaauccugucucuacuaaaaauacaaauauuagccgggcaugguggcacacaccuguagucccagcuacucaggaagcuaagccaagaaaaucacuugaaccugggagauggagguugcagugagccgagaucaugccacugcacuucagccuaggugacagaaugaaaaucugucucaaaaaaaaaaaucuaccuguaaauggauccaugcacuucaaacauguauuguucaagggacaauuguacaagccuacuaauggcuuaggaugggaaaaaaacaucccauacauagucauccugacucauucaauaccaagacaacauacucaagucuauccuuauaauuuaauuuauccaguuucgcagccgguggggucuuuuucuaaacucuugcauugugauagugucaaucuuuuuuuuuuuuuuuuuuggagacagagucucgucuuuugcccaagcugcagugcaguggcacgaucccugcucacugcaaccucugccuccccgguucaagcaauucuccugccucagccuccugaguagcugggauuacaggugugcaacaccaugcccagcuaauuuuguauuuuuaguagagacaggguuucaccauguuagccaggcugaucucaaacucgaccucaggugaucugcucgccucagccuccccaagugcugggauuacaggcaugagccaccaugccaaucuuuaagaacuugccucagguacaccuaacugcuaagucaaauuccuuugacuguuaauccugcauuauaauucucuucuuacuuaguuguauuuaauuguuauuuucucuaaauucacuuucuaaaaucuuuaaaaaccaccuaguaauuacuccaaacauuuggccauuaucaucacuuuaagggaggauaaugaucuaagcuaagggaagucauuucuuuuggcuccaaaagacuggacuucuguaugucuaauuccuuaguuuagaauuuuugggggcagggcacaguggcucaggccuguaaucccagcacuuugggaggccgaagcggguggaucacuugagcucaggaguuugagaccagccugggcaagauggccaaaaccugccucuauuuuuaaaagcacaaaaaucagccaggugugguggugcacaccuguaauccuagcuacucaggaggcgggggcaugagaaucauuugaauccaggaggaagagguugcagugagcugagaucacgccacugcacuccagccugggcuagagugagacccugucucaaaaaaaaaaaaaaaaaaaagaauuuguugaaaagcccaaauaaagucuuuacucucuaucugaucauaaaaugugacucuuacaaauuagacauaaaaauauccaagcugauaucuccuugccuauaaagcaagaaaagggacauuucuccuuugcaaauccuaagcuuaggcuuuucaauuuucagucagucgccuaggcuggagugcaguggcaugaacauggcucacugccuucagggcucaagugauccuccugucucagccucccgaguagcugggacaacaggugugcaugaccaugcccaacuaauuuuuuuguugucguuguuuuguagagauaggaucuggucauguugcucaggcuggucuugaacuccugggcucaagcaauccucccaccuuggccucccaaagugcugggauuacagacauaagccauugaacucagccacgauuauaguccuaaacacccuguaugaaaauacuuuaauacaaaaaugaugcucuucuuuguccugaaguugucauuauuucaucuucaagauuagaacuucuuugaauguaggaagugguucuuauucugugucucccacuaugccuuaagagagggccucauauggagcucuagcaucucucgcugaugcuuucugacaaucucuugcucugucaccuuuguacuccuaaggccaucaguccuuuaguuagagaaucauucauuuaaaaaucuuuccaaaguacacuagucccuauauccuguaauuacacaagaaagucuaaccagugccaaguucuguuaaacacuuggagaagaagggguaggaaucucgauugcuuugcuugcuguucauaaggaagaauuuaaggcugucacaagcaggccaugccuaggaaagauucugguaaagauaucuuucugcugaaggcacccgaccuguguuagcucugaggaaugggcuagaagcagacagaacaccuaccauaagcuauauauacuagcaauacagagaggacuuccaagguccuacaagauccuggcaucccucugaccucaucucccaccacucucaccgcagcagacacaggaaacaggaaggaauggacaagacgggagugguugacaacggguccaacuaaaaggcacgacgcuagaggguaucgaccagauccugaagauggggaacggucaacagucuugaaacagaggagugacacggucccggaugcucacuuugagugcaaaguggggaccggaauggaugcagaguacaaaggaggcagggagaccacuuaggagaagaaccacggagcgaggauggggcugccugacgcgucuaggagaaggacuuguagaauggauccagagggauggcaggaagccaugagcucagcguagggcaggauaacccuacagagacugucuacgggagccugagggucagggcgggagggagaaggugggaccugaaggaggaagugaaaacccgcaacagccgaaggcugcgggaguccucucaaagcaucuccccggcgccccagcccaaccaccucagcggccucccuccuccccgccuccccuugcuggcccgcugaccgaacgaguugagaaagucugcgauuuucuugaugcugcuggugauuaucucaauguacucccgguuagcccaguccuggugaaucucccgcugcaccggauccuccugucccgccauggccgccgccugaggaagagcgacugcgcaggcgccccgacccuacaggccuc

SEQ ID NO: 191672 - RNA, 12036 nt, Homo sapiens
ccucgccuccguuacaacggccuacggugcuggaggauccuucugcgcacgcgcacagccuccggccggcuauuuccgcgagcgcguuccauccucuaccgagcgcgcgcgaagacuacggaggucgacucgggagcgcgcacgcagcuccgccccgcguccgacccgcggaucccgcggcguccggcccggguggucuggaucgcggagggaaugccccggagggcggagaacugggacgaggccgagguaggcgcggaggaggcaggcgucgaagaguacggcccugaagaagacggcggggaggagucgggcgccgaggaguccggcccggaagaguccggcccggaggaacugggcgccgaggaggagauggaggccgggcggccgcggcccgugcugcgcucggugaacucgcgcgagcccucccaggucaucuucugcaaucgcaguccgcgcgucgugcugcccguauggcucaacuucgacggcgagccgcagcccuacccaacgcugccgccuggcacgggccgccgcauccacagcuaccgagguacgggcccggcgcuuaggcccgacccagcagggacgauagcacggucugaagccccucuaccgccccgggguccauuuugcagacggggaacugaggccccuugaggcaggacacauccagggugacgcugcucguaagcgucagagcauucuuuuuuuuuuuuuuuuuuuucugagacggagucucgcucugucgcccaggcuggagugcaguggcgcgaucucgacucacugcagccuccgccucccggguucaagcgauucuccugccucagccuccugaguagcugggauuacaggcgugcgccaccgcgcccggcugauuuuuauauuuuuaguagagacgggguuucaccauguuggucaggcuggucucgaacugcugaccucgugauccgcccgccucggccucccaaagugcugggcuuaugggcaugagccuccgcgcccggcccagagcauucuuuauaaggccgaauaguuugcauuugaagguggcuccccccagucccccaccccacguguauuuuccccucaaagaaaagcugcauccuuaacaccccaucuguucaguccucaugacuccagugggccaguucugcguagucccugcccucguggagaacacauuccuccuggggagacugacagaugcaaagacaggaacaagccagggucauguuggcgccggaagagccgaccguguguggcgugggaaauugacuuaccugccugcugggagauggagggguugcgguugugugguuucaguuaaggagcacuucccggagaaggaagagagcaggauggaguaggaacuagccaacccuagguaagagguucuagacaugcgugcguugagaccuggagucuugggagaggaugcuuaaaaggugauuuuaccccuaggaauaugggggcacugaaauuuuuuuuuuuuuuugagacgggagucuugcucugcaagcuggagugcaguggcccacgcuagaaugcaguggcgcgauugcggcucauugcaacaucugccaccuggggucaagugguucucuugccucagccucccgaggagcggggauuacaggcgugcgccaccacuccuggcuaauuuuuuuuuuaguagagacggggguuucgucauuuuggccaggcuggucucgaacuccugaccucagaugauccacccgccuuggccucccaaagugcugagauuacagguguaagccacugcgcccagcccuuugaaaguuuuucaguauuuauguauauauauuuuugaguuggagucuggaucugucgccagacuggagugcuguugcacaaucuuggcucacugcaaucuccgacucccugguucaagcgauucuccugccucagccucccaaguaacugggauuacaggcacgcacuaccauucccagcuaauuuuuuguauucuuaguagagacaggguuucaccauguuggccaggauggucuccaucuccugcgcucgugaucugccugcuucggccucccaaagugcugggauuacaggcgugcugggauuucggccacaacguccgaccgaaaguuuuuaagcagggacaugacauugucagauuuauauacugaaaagcucacccagguugccaagugguuuggaggggaaagacugcugucgaggaagcaguuagguaguugugaaaacccaggugaggaauaacuaggccuuaccuaaggugcaggcaguaaucuugccauggccuuuaagcagagaaguaguccuagugucacuuaaucuuuacaaaggauuuuugcaaggaucccgaucuuucuuccuugagggugguguacuuaauacacuuuuacaccagacuucuaauguuagaugaagaacacaguauuuccagggaucaacauuucuguaggcuccuauuuuauauaggaaauuguaugaauuuuguauuuuacuccaaaauuuuucugugcccgauuuaauauaaaaauuuacugagccugggugcaguggcucaugccugugaucucagcacuuugggaggcugaggcaggaggauuucuugagcccaggagcuggagaccagccugugcaacauagugagacccugucuguauuuaaaaaaaaaaaaaauucuugaaaaauuagcagggcacauuccugccuuuagucccagcuacuugggaagcugaggcaggaagaucacccgaacccaggaguuggaggcuacagugaacuaugauggugccucugaauaguugcuguacucuagucugguaacacagcaagacccugucucucuaucuugucuuuuuuuuuuuuuuuuuugagacaggauguccugcuguugccugggcuggaguguggaggcuggaguuugguggcaugaucacggcucauugcacccuuaaccugggcucaagcaguccucccagagcuucagcuucccaaaguagcugggacuauaggcaugcuccacuaugucuggcuaauuucuuuuuuuauuuuuauuuuuaguagagaugaggucuugcuauguugcccaggcugagaccucaucucuuuuuuauuuuuuuaaaauuuuuuauuauacuuuaaguucuaggguacaugugcacaacgugcagguuuguuacauauguauacaugugccauguuggugugcugcacccauagagaccucgucuuaaaaaaagaaaauaacauuacuuuugaagguacuuaaugcacugaauuguacauuuaaaaaugguuaaaaugguaaauguuugaggcagguagauccaccugaggucaggaguucaagaccagccugaccaauaugguggaacccugucucugcuaaaaauacaaaaguuagcugcaugugguggcaugcgccuguuuagucccagcuacucgggaggcugaggcaggagaauugcuugaaccugggaggcggagguggcagugagccaagaucacaccacuacacuccagccugggcaacagagcaagacuccaucucuaaauaauaaauaaaaugguaacuuuuauguauauuuuaccaaaauuuaaaaaauuacaaguuuacauuucuuaaaauuucccaucaaaucuguaaguaaauuuaugccccgaggaacaagugcuauauuuauucuaagacaaccuccuccuuccuuaaacagaaucuuagggcuggaggauugcuuccugcccucuuuuguuugugauguaugcauuuugaaaauucugggccaggcgcaguggcucacuccuguaaucccagcacuuugggaggccgaggcgggcggaucauaagaucaggagauugagaccauccuggcuaauacggugaaacccugucucuacugaaaauaacaaaaaauuagccgggcgugguggcgggcaccuguggucccagcuauuugggaggcuguggcaggagaauggcauaaaccugggaggcggagcuugcagugagccgagaucgugccacugcacuccagccugggcgacagagcaagacugcaucucaaaaaaaaaaaaaagaaaaagaaaagaaaauucugguauaauuuacauacaguaaaaugcacagaucuuaggguuugaugaguuuucucucgacauguuuuugcacuuccuuguuuuugagaagcacugauuugagaagucaguggcuuuuucucuuuaguuugcaggguuugcugugauuuguaaucacguacuugaccuaggcuucccuuuuccaccaugguagcagaaagggcaugggauugagagcuuuaaguacgcgcucuuugcuuacugucuuauaccuugagcaugucacuucucucagacuuguuuucucaucuguaaauggaucuguugugaggacugacugagauaauguuacuagaagggcuuuguauaauauuuaagcagagugagagguaagcuuuuuguguaggucaggggaaauggagaaaauaggugcccugacucagaccagucuggcucuuuuuuuuuuuuuuuuuggagacggagucuugcucugucacccaggcuggagugcaguggcgcgaucucggcucacggcaagcuccaccuccuggguucacaccauucuccugccucagccucccgaguagcugggacuacaggcgcucgccaccacaccuggcuaauuuuuuuguauuuuuaguagagacgagguuucaccacguuagccaggacggucuugaucuccugaccucaugauccgccugccucggccucccaaagugcugggauuacaggugugggccaccgugcccagccaccgguguggcucuuuaacaaccuuugcuugucccgauaggucaccuuuggcucuucagagaugcagggacacacgaugggcuucugguuaaccaaacugaauuauuugugccaucucucaauguugacggacagccuauuuuugccaauaucacacugccagguacugacguuuuacuuuuuaaaaagauaagguuguugugguaaguacaggauagaccacuugaaaaauuaagcccaguucucaauuuuugccugaugucaggcacguuauccaaucuuuuuguauccuauucucuaccauaaauaaaauggaagugauguauuuguacguuauguguuaaagguguuauggugucucaaaagcacuuugggcucuuaagagacaagcgaaauuaaaguaucauaucauagguuaguuuuguagaauuguagaauuacgaaugccuuuuguuucccuggccaaauugugcccuggaguuccaggagaacaauguguagagcaugagauauuuuggcuuauuuguugcugacuucuaauuuuuuuuauuuuuuugagacagaaucucgcuguguuagcuaggcuggagugcaguggcgcaaucucggcucacugcaaccuccgccuacuggguuccagugauucucuugucucagccucccgaguagcugggacuacaggcgugugccacccacucugauaauuuuuuguauuuuuaguagagacgggguuucaccguguuagccaggauggucuccaucuccugaccucaugaucugcccgccuacgccucccaaagugcugggauuacaggcaucagccacagcaccuggccuauguauuuucaauuuaacacaaucaagcucacagugccaaucagagguguuuuuuuuuuuuuuauuuuuauuuuuagagagucucacagugucauccaggcuggagugcaguggugcgauuucagcucacugcaaccucugcauccuggguucaagugauucuccugccucagccuccuggguagcugggguuauaggugccugucaccacaccuggcuaauuuuuguauuuuuaguagagaugagguuucaccauguuggccaggcugaucuugaacuccugaccucaggugaucugcccaccucagccucccaaagugcugggauuacaggcgugagccacugcguccagccuguuuuuuuuuuuuuuuaaaucauugaagauugguauaauacuucacuauuuguuugaagcucaaaugauuuuaucaggguaaacccuaauaaacugauguuccuguggguaaaaaaaaccucacuaaagaccagcagugugugguggcuccugccuguaaucaugccuguaauuccagcacuuagggaggcuauggcgggagggucgcuugagaccaggaguucuugaccagccuggacaacaaagugagaccccagcuccacaaaaaaauuuuuuuuuaauuaccugggcaucuuagcauaugccuguggucacagcuauuugggaggcuuaggugggaggaucccuugagcccaggaguuugaggcugcagugagccaugaucauaccacugcacuccagcccaggugacagagugagauccugucucaaaaaaagaaaaaaaaaacucaaaaaccccccaaauacauggguuucauaggauucaaacuacuauguguguauagauccuguuuuaaggaaguagauauauaaaaaugagcauugcuaaguuaaauuugguaaauuugccuuauagaauacccucgaguacguuuccagugaguguaaaauaggaauugggauacccaauucaguuguacuagauuuucuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuagauuuucuaaguacacauuguuuugguuauguguuuugugacuaccaccccaaaacuaauaaccaccuuuuuuuuuuuuuugagacagagucucacugugucacccaggcuggagugcaguggcgugugaucuuggcucacugcaaccucugccucucggguucaagcgauucuccugcuucagcagcugggacuacaggugugcaccaccaagccuggcuaauuuuuugcauuuuaguggagacggggguuucaccauguugaccaggcugaucuugaacucuugagcucaggcagucugccugccucagccuccuaaagugcuaggauuacaggcgugagccacugcgcccagcccaccauuuuauuuguucauaauucuguaguccaggcugggcucagcuaggcaguuacucugcuggugguagucguugguguggcugccuuuugcuggcagcugggggcugggccugucccucuuuuuuuuuuuucucuuuucuuuuuucuuuuuuuucaagauagggucucacucugucacccagguuggagugcaguggcaugaucuuagcucacugcaaccucugccuccagggcucaagugauccucccaccucagccuccccagucgcugggaccacaggcaugugccaccaugccuggcuaauuuuuuguguauuuuguagagacgggguuucgccauguugccaggcuggucucgaacuccugagcucaggcgaucuacugacguuggccucccaaaguguugggaucacaggcaugaaccaccaugccuggccagggccuguuccucuuuauguggucucucuagcaggguagcucagggcuuucaaaaguauaaaagcagaagucagcaggccuuuuuaaggcuucggccuagaauugccagugucgcuucauccacauucaguuaguuaaagcaaucacaagcccagcccauuucaaggugaaauuacuacagaggcaugaacaccaugagguguccauagggggccaucagcauaacacacugccacauacaugcacucacuuuuuuucuuuaaccuaaagugagauccaucaguaguacagguaguuguuggcaaagccucuuguucguuccuuguacugagacccuagucugccacugaggauuugguuuuugcccuuccaguguauacucugaaagagcgaugccuccagguuguccggagccuagucaagccugagaauuacaggagacuggacaucgucaggucgcucuacgaagaucuggaagaccacccaaaugugcagaaagaccuggagcggcugacacaggagcgcauugcacaucaacggaugggagauugaagauuucuguugaaacuuacacuguuucaucucagcuuuugaugguacugaugagucuugaucuagauacaggacugguuccuuccuuaguuucaaagugucucauucucagaguaaaauaggcaccauugcuuaaaagaaaguuaacugacuucacuaggcauugugauguuuaggggcaaacaucacaaaauguaauuuaaugccugcccauuagagaaguauuuaucaggagaaggugguggcauuuuugcuuccuaguaagucaggacagcuuguauguaaggagguuuguauaaguaauucagugggaauugcagcauaucguuuaauuuuaagaaggcauuggcaucugcuuuuaauggauguauaauacauccauucuacauccguagcgguuggugacuugucugccuccugcuuugggaagacugaggcauccgugaggcagggacaagucuuucuccucuuugagaccccagugccugcacaucaugagccuucagucaggguuugucagaggaacaaaccaggggacacuuuguuagaaagugcuuagagguucugccucuauuuuuguuggggggugggagaggggaccuuaaaauguguacagugaacaaaugucuuaaagggaaucauuuuuguaggaagcauuuuuuauaauuuucuaagucgugcacuuucucgguccacucuuguugaagugcuguuuuauuacuguuucuaaacuaggauugacauucuacaguugugauaauagcauuuuuguaacuugccauccgcacagaaaauacgagaaaaucugcauguuugauuauaguauuaauggacaaauaaguuuuugcuaaaugugaguauuucuguuccuuuuuguaaauaugugacauuccugauugauuuggguuuuuuuguuguuguuguuuuguuuuguuuuguuuuuuugagauggagucucacucuugucacccaggcuggagugcaguggcgccaucucggcucacugcaaccucugccuccuggguucacguaauccuccugaguagcugggauuacaggcgccugccaccacgcuggccaauuuuuguacuuuuaguagagacaguguuucgucauguuggccaggcugguuucaaacuccugaccucaggugauccgcccaccucagccucccaaaauggugggauuacaggugugugggccaccgugccuggcugauucagcauuuuuuaucaggcaggaccagguggcacuuccaccuccagccucugguccuaccaauggauucauggaguagccuggacuguuucauaguuuucuaaauguacaaauucuuauaggcuagacuuagauucauuaacucaaauucaaugcuucuaucagacucaguuuuuuguaacuaauagauuuuuuuuuccacuuuuguucuacuccuucccuaauagcuuuuuaaaaaaaucuccccaguagagaaacauuuggaaaagacagaaaacuaaaaaggaagaaaaaagaucccuauuagauacacuucuuaaauacaaucacauuaacauuuugagcuauuuccuuccagccuuuuuagggcagauuuugguugguuuuuacauaguugagauuguacuguucauacaguuuuauacccuuuuucauuuaacuuuauaacuuaaauauugcucuauguuaguauaagcuuuucacaaacauuaguauagucucccuuuuauaauuaauguuuguggguauuucuuggcaugcaucuuuaauuccuuauccuagccuuugggcacaauuccugugcucaaaaaugagagugacggcuggcaugguggcucccgccuguaaucccaguacuuuggaaagccaagguaagaggauugcuugagcccagaacuucaagaugagccugggcucauagugagaacccaucuauacaaaaaauuuuuaaaaauuagcauggcggcacacaucuguaauccuagcuacuuggcaggcugaggugagaagaucauuggaguuuaggaauuggaggcugcagugagccaugaguaugccacugcacuccagccugggggacagagcaagacccugccucaaaaaaaaaaaaaaaaaaaaaaucaggccgggcaugguggcucacgccuguaaucccagcacuuugggaggucgaggugggcagaucaccugaggucaggaguucgagaccagccuggccaacaugguaaaaccccauuucuacuaaaaaauacaagaauuagcugggugugguggcgcaugccuguaauccuagcuacucaggaggcugaggcaggagaaucacuugaacccaggaggcgaagauugcagugagcugauaucgcaccauuguacuccagccugugugacagagcaauacucuugucucaaaaaaaaaaaaaaauucaaaucagagugaagugaaugagacacuccaguuuuccuucuacuccgaauuucaacugauuuuagcuccuccuuucaacauucaacaaauagucuuuuuuuuuuuuuuuuuuuuuuuuuuuuugagauggagucucacucuguugcccaggcuggagugcaguggugcgaucucugcucacuacaagcucugccucccgaguucaagugauucuccuggcucacccuccugaguagcugggauuacaggcgccugccaccaugccuggcuaauuuuguguuuuuaguggagacgggguuucaccauguuguccaggauggucuugaucuccugaccuugugauccacccaccucagccucccaaagugcugggauuacaggugugagccaccgcguccagccagcuuuauuauuuuuuuuaagcugucuuugugucaaaaugauaguucaugcuccucuuguuaaaaccugcaggccgagcacaguggcucaugccuguaaucccagcauuuugggagaccaaggcggauggaucaccugaggucaggagcugaagaccagccuggcuaacauggugaaaccucaucuccacuuaaaauacaaaaauugccggccgcggcggcucaugccuguaaucccagcacuuugggaggccuaggcggguggaucacgaggucaggaaaucgagaccauccuggcuaacacgggugaaaccccgucucuauuaaaaaauagaaaaaauuaggcgggcgugguggugagcgccuguagucccagcuacucgagagccugaggcaggagaauggcaugaaccuggaaggcggagcuugcagugagcugagauggugccacugcacucuaaccugggcgacagagugagacaccgucucaaaaaaaaaaacaaaaaacaaaaauuauccagguguggcggugggcgccugugaggcaggcgaaucucuugaacccgggaggcggagguugcagugagccaagaucacaccauugcacuccagccugggcaacaagagugaaauuccaucucaaaaagaaaccaaaaaaacaaaaaaaaaacaugccguuugaguacuguguuuuugguguuguccaaggaaaauuaaaaaccuguagcaugaauaauguuuguuuuucauuucgaaucuugugaauguauuaaauauaucgcucuuaagagacggugaaguuccuauuucaaguuuuuuuuuuuuuuuuuuuuuuuaaagcuguuuuuuaauacauuaaauggugcugaguaaaggaaauag

SEQ ID NO: 191673 - RNA, 78865 nt, Homo sapiens
gccccuggcuagagaagccgcagcccgcaguguccgacccagucgucccgcgccggagccggccccguagcgugccauggccugcuacaucuaccagcugcccuccugggugcuggacgaccugugccgcaacauggacgcgcucagcgagugggacuggauggaguucggugagugcggcccggggaggggaggggaccagggcgaccggagcccccagcgaucccgccuggagcggccgccaagcucccucgggcacccggguucagcgggucccgauccgagggcgugcgagcugagccuccuggaccggguccgccgcggaccucggccugucaccugaaggugccgcguggucucugaggacgucugucgacgagcaggggccgccgccacugcgcucugaguccagagaacgguggguacgggggcccuccugucagcgcugcuggcucggugacguccccagguggccucucauccagcccacaacagccugcaaagugcgagccucgacccuguagggacccacggugcugucacuucuugggggggugugugugugugugugugugguguguuuaguuuuaguguauauuagaaggaucuaugauuuaacauauauauauauauugaaacggaguuucgcuguuguugcccaggcuggagugcaauggcacggucucggcucacugcaaccuccaccucugggauucaagcgauuuuccugccucggccucccgaguagcugggauuacaggcgcccgcuaccacccuggcuaauuuuuuguauuuucaguagagaccggguuucaccauguuggccagacuggucuugaacuauuuuuuuuuuuuuuuuuuuuuuuuuuuaagacggagucucacucugucgcccaggcuggagugcaguggcgcgaucuaggcucguugcaagcuccgccucccggguucacgccauucuccugccucagccuucugaguagcugggacuacaggcgcccgccaccacgcccggcuaacuuuguauucuuaguagagacgggguuucaccguguuagccaggauggucuggaucuccugaccuugugauccgcccacccugggccucccaaagugcugggauuacaggcaugagccaccgcgcccggccuccggaacucuugaucucaggcgauccaccugcuucggccucccaaagugcugggauuacaggcgugagccacugugcccagccuauuuaucauauuugugauuaaauguacuuuaccauuauaguuuuaaaaucagauauuuacuuuuaguguacauuguuuugaucacaguauuuaugacuaucaaccuguuuugagaucagauguguccuaauagauucaguguguauaauggggccuaagcacaagcacuuacuuucacucuauugcaaggugcacaguucuagauaauuccgugggaaggcacucagacagccuccauauguuuuguuuguuggugccugacggaugacuggcggagagggccauggacucugcggggaggccgcuugccuguugucucugcuuuccagguggagaucugcauuccaggcucuugcuguaugacuuugggccaguuuguuaaccucucugagccucagcuucugaaucuguauguaaacuggagaugauaauuauagcuucuucauaaaguugugaggaaugaaaauacuguauaaaagcacugacaccuaaguguuaaauauucuuauaagucauaaguuguaauauucucuuuucauuuuuauuuuuuugagacagucucauucuguggcccaggcuggaaugcaguggcgagaucucggcucacugcagcuuccgccucuuggauucaagugauucucuugccucagccucccgaguagcugggauuacaggcaugugccaccacgcccacuaauuuuuauguuuuuaguagagaugggguuucgccauguuggccaggcuggucucgaacuccugaccucaugugauuuggccgcuuuggccucccaaagugcugggauuacaggcgugagccacugcuccuggaccuggcuucacuacuuugaauguuuccugggcagugaacaaacuuugugugagacucccucucauuuuuuccacauuggcccagcccucaguuacaaaugccagaacaacuucuguuucuaggaaauucaauuagaaggcauaccuaugacuuaaaaaaaaaauaaagcuuuacugagauauucacauaccauacaauccaccuguuucaggaguacaauuuagugguauuuaguauauucacagggcuguguauccaucuucacaaucaaucuuagaacauuuuaaucacccgaagaagaaacucuguacccguuaacuuccaauccccuccuuccauuuuccugaguuuuagacauugccuauuuuggacauuucauauaaauggaaucauauaauauauagugcucugugacugacuuguuucaacuaacaugagguucauccauguuguagcaugcgucaauacuuaguuucuuuuuuuuuuuuuugagacggagucucgcuuugucacccaggcuggagugcaguggcgcaaucucggcucacugcaagcuccaccuccuggguucaugccauucuccugcuucagccucccuagcagcuuggacuacaggugccugccaccaugcccggcuaauuuuuuuguauuuuuaguagagaugggguuucacuguguuagccaggauggucuugaucuccugaccguguaauccaccuaccucggcuucccaaagugcugggauuacaggcgugagccaccgcgcccagccaguuucuuuuuauuguaggauaauguuccaugguauggauauacuacauuucauucauuuaucaguuguugggcauuggguucuuuucacuuuugggccauugugaauagugcugcugugaacacucacauacaagauuuugugcaguggugcaaauguagcucaccgcagccccaacuuccugggcucaagcgaucuuccugucuccugaguagcuggacuacaggugugcacugcugcacccagcuaacuuuuguauuuuuuguagagacagguuucaccauguuacucaggcugaucuugaacucuggagcucaagcgaucugcccaucucaccuucccaaauugcugggauuacaggugugagccacugcaucuggcuuuauguuuaacuauuugaggagcuaccagauguuuucuaaaguggcugaaccaccaguguaugaggaugaccauuucuccacauccuugucaacauguguuauuuuuuucuuuuuuuaauuuuuuuuuuuuugagacagagucucgcucugucgcugaggcuggagugcaguggcaugaucucggcucgcugcaaccuuagccuccuggguucaagcgauucuugugccucagccucccaaguagcugggauuacaggcaugcaccaccgugccugacuaauuuuuguaucuucaguagagacaggguuucaccguguuggccaggcuggucucaaacuccuaaccucaggugaucugcccgccucggccucccaaagugcugggauuacaggugugagcaccauguccggccuuauuguugcuuuuuugaugguagccaccugagccagugugaaguggcaucuuacugugguuugauuugcauuucccuaaugacuaaugcuguggagcaucuuuuccugugcuuguuggccauuugcacaucuucuuuggagaauaccucugcgaggcuccccacugggauggauaugaucugaacaccuugccaggcauguugacucugacacaucugcccagugcuggccucucugaccuccucuucuuccacacccacugucacuccccugcuccagccacacugaccucccugggccagacacagggucuuugcaggugcuguucccucugccugggacguucuucccccuguguuaccuggggcuagcuuucuagucuauuaguuuccuccuguugcaguuauagauuacuacaauaucaggggaaccagcccgcaguauuucaauguagguucuuuucuauuuucccuaagugucggccggucugagaaauaaagaguacaaagagagaaauuuuacaucuaggccucugggggugcuguuacacauugguaggaccgugauggugaccccgagccacaaaaccagcgaguuuuuauuagggauuucaaaaggggagggguguacgaauagggaguaggucccagagaucacauucuucaaagggcaauaaaagaucacaaggcaaaggugaaauuagaauuacuggugaagguccaugucccacugggcacgcauugucuugauaaacaucuuaacaggaaacaggguuggagagcagacaacccgucugacuagaauucaccaggcuggaauuucccaauccuaguaagccugagggcacugcaggagaccagggcauauuucaucccuuaucucaacugcaucagacagacacccccagaguggccauuuauagaccuaccccgggaaugcguuccuuccccaggguuaucaauuauuaauauuccuugcugggaaaagaauucagcgauauuucuccuacucacacguccaucuauaggcucucugugagaagaaaaauauggcucuauucugcccgaccccacaggcagucagaccuuaugguuaucuucccuuguucccugaacaucacuguuauucuguucuuuuucagggugcccugauuucauauuguuuaaacacccacguuuuacaaucagauuucauauuuuucaaacacacguuuuacaaacaauuuauacaguuaaugcaaucaucacaggguccugaggugacauacauccucagcuuaugaaaaugaugggauuaagagauuaaagacaggcauaggaaauuauaagaguauaaauguccauaaaaucuucacaauuuauguucagagauugcaguaaagacagacguaagaaauuauaaaaguauuaauuuugggaacugauaaauguccaugaaaucuucacaaguuguauucuucugccguggcuucagccgguccuguucggggccccugacuucccacaacacuacaaaguugguggccuguaacaccucaaguuuauuaucucagcauucuggaggucagaaguccuaacucaggguggcucuagggaggagucggucuccuggccuugacuggcuuccugaggccugcagcauccuguggcuuauggccccuuccuccaucaucaaggccauggguguguaucaucacaucugucucugugacuucugcuucuaccaucaccucaucucugaaucugauguucuggccucccccuuacagggacccugguaauuaccuuggccagacccagagaauccaggauaaucucaucucagaauccuugauuuaaucuaaccugcaaagucccuuuugcuauguaagguaccauauucacaggucucggggcuuaggauguggauguuuuccaaggguauuauucugucugucacaguccuucagguaagcuccuguggcaccucuuugaaaucaagaggacuuuccugccccuguuccucucuagcccaucaccguguuucauuucccucauuccgcuucacagccuuugauguccccucguuccugaauuuuuuccaccugucucucccuauggaauggaagccccgugcgggcaggggccuuaccugucuaguuuuucacugcuguauucccagagccugggacagugccuggcuagagggcaggugccagaaugaaugaugagcugccaggccuugguguggugaggaugcgggcugcccacucuuacccauuggagcuggccuggagccuuuggucagcccacuuccuacacuggaucagagccagcggugccuccggcccacugcuccucgcccagucccagugcuccaguucccucuucagcugaaugaacgagugacugugauugacccuucaguccuaaaaauucuuggcuuccugugggucauuuuagaaagaagacagucccucagagcugauggugauacugggagaguguagugagaacgcuaaagugauucagaagaucccgcagccacagacagccacgcucuuucagauccgacacuuguuggcagauaaucuggccacgccuaguucuugucuccgugauggcagcugccucuguugggcuuugccugagccuguguaaaaaggguuuccuacagcuucagccccaggugugugcagaggggcucggcgcaggggcucuucuguguguggccguuccccgucucguucacucaugcgugugccagccuuugugcacagcccugcuuugcccugcccagcugugugacaucaggcaggugacuaucucucucugagccuuuaguuuccucauccaugaagcacccucacaguguugcugagaggcuuaggagacucagcuuauuguaaagggucaaguuagggcuuuccucaucccccacccagggaggggugugggcauucgauucuaagaugggucauuucaggaggcugugccaucccugcuguggaggacuuugaagacaggcaagguuuucuacugccucgggugaacuccugcaggauucaggaacucaagagugauagucccuguacuguuaaucaucagggauaaaaacauuuucaggccaggugcaguggcucacgccucuaauuucaacacuuugggaggccuaggugggaaaauuucuugaagccaagaguuugagaccagccucgugauccgcccgccucagccucccaaaguguuuggauuacaggcgugagccacugcacccagccuuuuuuuuuuuuuugagacggagucucacucuguugcccaggcuggaguccaaugaugcaaucucagcucacugcaaccucggccuccuggguucaagugauucuccugccucagccuccagaguagcugggacuacaggcgcccgccaccacacucugcuaguuuuugcauuuucaguagagaugggcugggcguaguggcucacggcuguaaucucagcacuuugggaggccaaggugggaggaccacgaggucaggaguucgaaaccagccuggccaacauggugaaacucugucccuacuaaaaauaugaaaauuggccaggugcgguggcucaugccuguaauccuagcucuuugggaggcugagguggguggaucaugaggucaggagauugagaccauccuggcuaacacagugaaaccccguuucuacuaaaaaaaaaaauuagccgggcaugguggcaggcgccuguaguccuagcuacucaggaggcugaggcaggagaauggugugaaccugggagguggagcuugcagugagcagagaucgcaccacugcacuccagccugggcgacagagcgagacuccgucucaaaaaaacaaacaaacaaaaaauuagccaggugugauggcacucgccuguaaucccagcuauucgggaggcugaggcaggagaauugcuugaaccugggagguggagguugcagugagcugacaugugccauugcacuccagccugggcaacaagaguaaaacuccgacucaaaaaaaaaaaaaaaaaaaaggccgggcgcgguggcucaugccuguaaucccagcacuuugggaggccgagguggguggaucacgaggucaggaguuugagcccagccuggccaacauagugaaaccccgucucuaccaaaaauacaaaaauuagcugggcaugguggcacaugccuguagucccagcuacucgggaggcugagguaggagaauugugugaacccaggagguggagguuguggugagccaagaucgcgccacugcacuccagccugggcaacagagcgagacucugucucaaaaaaaaaaaaaaaaaaaaaaaaguagagacgggguuucaucaugucggccaggcuggucucaaacuccugaccucguuauccgcuugccuuggccucccaaagugcugggauuacaggcgugagccaccgcaccuggccaaacucuaugaaaaacagguuuucauagaauguagauaguuuaacacuuacagcuaauacuuauaucauguuuauuguguguuaagcacuguucugagugcuucuguacauagaacucaucuaauccuugcaacaaucucggaggcaggugcugcuguuauccuuguuugacagaugaggaaacugaggcucagggggagaugaacaccuuccccaaaaacacagcaaguaagcagcagagacaggauuugaacccaggccccgaaucccaauaucuggccucugaaccaccacuacuguccugcugacuuucgcacauguuuucauaucuguagaaaaagucuggaagauuagacaccaaaauguaacuggugguguccuuggaguccuccaagugggauaaucauggggacuuucauuuucuuguuucccaaauauucuacgaugaccagcuauuaccuguccaugcugagaaaaaagcugcagcuuagcagaaggccuugguagugacucauccccucaagaucucuaucaugucccgacucuaaagggucugguugagacuggguacgguggcugaugccugugaucccagcucuuugggaggccaaggaggguggaucacuugagcucaggaguuugauaccagccuggccaagauagugaaacuccaucucuacuaaaaauaccaaaaaauuagccgagagugguggcacaugcccuguagccccagcuacuugggaggcugaggcaggagaauugcuugaaccugggaggcauaggcugcagugaacugagaucacgccacugcacuccagccugggcagcagagcaagacuccgucugaaaaaaacuaaauaaaauaaauaaagggucugguuaaaugcugauuggucaacaccuuaagauauggcaccgucauggaacaaaaaugucuaagcuggaaggcaccuuagaguuuaauuccuguuucucuuguauuaccaucacgaguaaggaaaguucagcccacagagagucaggcuguggcugaguuccugcugccacccacgagggguggcccugggcuucuguuuucccauuacgucaugcugccucccaagaugggaguguguguggaugaccaaugcuucguggggggagaugguccuuccuuuuccauccguucucuucucuguauugcuagaagcagccgcugacccagcugacaucacuucccacugaccagcaaucuggccugggguuuccagugacuaacauagcaauuuaggaacuuuccaucuuaauugggcacuucuccuggaggcuuucugugugcaggagacugucaccagcccauuuuguccaaaggguaggggauugugcaaucuggucacagcacucacuggcucugaaauuuucuguggucccuuguaacucuuaggaucaaguccaaacuccaaagcugggcauucacuugagggucuuuguuaugugguccugggcuucaucucuugccuucccuucuucuacucggcccaccuauguuuauauauuuuuuuguuuuguuuuguuuuauuuuuuugagauggagucucacucuguugcccacgcuggagugcaguggcgugaucucggcucacugcaaccucugccucccggguucaagugauucuccugccucagccuuccacguagcugggacuacaagugggcaccaccacgcuuggcuaauuuuuguauuuuuaguggagaugggaguucaccauguuggccaggcuggucucgaacuccugaacuuaggugauccgcccaccucagccucccaaagugcugggauuacaggcaugaaccacugcacccggcugauuacuccuaguuuuaauaaaaaugccuuucucacuucaguaaaccaguggaauacuggucauaaaaauccauuuaugggccaggcacagugguucaugccuguaccaaaaaaaaaaauuagccaggaaugguggugugucugucaucccagcugcuggggaggcugaggugggaggauugcuugagccugggaggccaaggcuguggugauccauguuugcaccacuguacucaugccaccugggcaacagagugacacccugucucaaaaaaaaaaaagauuuuuaaauuuuuauuuauuuuuaauuuuuauauuuuugagacucagucucugucgcucaggcuggagugcaguggcacgaucucagcucacugcaaccuccaccuccuagguucaagugauuucuccuaccucagccucccgaguagcugggagauuacaggcguguguuaccacaccuggcuaauuuuuguauuuuuaguagagacgggguuucaccauguuggccaggcuaguaucgaacuccugaccucaggugauccaccugccucagccucccaaagugcuaggauuauaggcaugagccacugugcccagucccugugguauaauguuaauaaauaagaccaggaugcagaaucucaggugaggcaugguggcucacaccugcaaucccagcacuuuaagagguugaggugggaagauugcuugaggcgaggagugcgagagcagccugggcaacauagugagaccccaucucuuaagaaaagguacaaaaucagcugggcacgguggcucacgccuguaaucccaguacuuugggaggccgaggcaggcgcaucacaaggucaggagauugagaccauccuggcuaauguggugaaaccuggucucuacuaaaaauacaaaaaaauuagccaggcgugguggugggcgccuguagucccagcuacucgggaggcugaggccggagaauggccugaacccgggaggcggagcuugcagugagcucaggagugcaccacugcacuccagccugggugacagagcgagacuccgucucaaaaaaaaaaaaaaaaaaaaaaagaaaagauacaaaaucuuaccugcagcguggcaacaacuacauccaaagacacaucuauguagagggggugauuuuuggaaaggggaaguacccuaauggccuuaggaggguggugagaugcuguguaacuuuucccccuguauuguccauguuuuuuuuuuuuuuuuuuuuuuuuggugaacaaccaucaauuuuaugguaaaacaccaaaagaaagaaugcauuauuuuuauuguuacuagugguagcucccugcaaguuuugucccauacuucagaauuggcaaaguauuuuuguauccauggcucucugauccuuauaacaguucugugaagacgaugugguauguguguguguuuucauucagucauucacuuagcauaucuuuuuuguuguuguuuuuggagacaaggucuugcuguguugcccaggcuggagugcagugacaucaucguggcuugcugcagccuccaacuccugggcucaagugauccucccaucucagccuccugaguagcuaggacuacagaugcaugccaccaugccuggcuacuuuguuuauuuauuuauuuauuuauuuugagacagagucucucucugucucccaggcuggagugcaguggcgcgaucuuggcucauugcaagcucugccucucggguucaugacauucuccugccucagccucccgaguagcugggacuacaggugcacgccaccacgcccggcuaauuuuuuguauuuuuaguagagacgagguuucaccauguuagccagcauggucucaaucuccugaccuugcgaucugcccgccuuggccuuccaaagugcugggauuacaggcguaagccacugcgccuggccuacuucguuuauuuuuuguagagacagggucuuuuuuuuguuuugagauggagucucgcucugucgcccaggcuggagugcaauggcgugaucuuggcucacugcaagcuccgccucccagguucacgccauucucuugccucagccucccgaguagcugggacuacaggugcccgccaccacgcccggcuaauuuuucuauuuuuaguagagacaggguuucaccguguuagccaggauggucuugaucuccugaccuugugguccaccugccucggccucccaaagugcugggauuacaggugugagccaccaugcccggccuacuuuguuuauuuuuuguagagacagggucucacuauguugcccaggcuggucuugaacuccugagcuccagcaaucccuccuuggucuccuaaaguauuggaauuacagcugugagccgcugcaccuggccucauacacuuguugaguuccccugaccaggacugggacuuagcugagaggaaugagaugcccagggcaaaauguaaggaggcgcugaugcucaggguccugcggugccaccugaagaugagcgccuccugcauuuuccuucccuaggugccucaccugacucacccucauccuggccccaccuccacucugaaccaggcacuauucucaauucuggggaaguaacagugaaccaaacagguagagcucccugccuacacggaccuuccauuauagaaggggaggcaggcagagcuaguacccacugaggcucccacgggcgcagugacugccccaggcauagcagcagccaaugcucaaggcuuugacccuccugucccguggucuuucuccuaagucauauguacuggaccccaugggugcccagcagagucagcguuguaacuugggccaccuguggaccucagcuaauggugguguuuccaguguggaggcggugguuggggaggauguccuggaaaagcccagcuaggggcuaguguggggaccuguccuagagggacugccucucugacucuaagcagaguucucuccgucccuuccagccuccuacgugaucacagaccugacccagcugcggaagaucaaguccauggagcgggugcagggugugagcaucacgcgggagcugcuguggugguggggcaugcggcaggccaccguccagcaacuuguggaccuccugugccgccuggagcucuaccgggcugcccagaucauccugaacugugaguaacucagggcccuccuugaguggggcccaucacgcuccugagcaguuuccauccgugugaguugcacucucuggccuuaauacuuuuuuccucuuuuaauuaaaaaauuuaaugagugaguuuaccaugcacauaagaaacugguaacaggccaggugcgguggcucacgccuguaaucccagcacuuccggaggcugagguaggugaaucaccugaagucaggaguuugagacuggccuggcuaacauggugaaaacccgucucuacuaaaaauacaaaauuagcugggcuugguggccugcgccuguaaucccagcuacucaggaggcugaggcaggagaaucgcuugaaccugggaggcggagguugcagugagccaggauugcaccacugcacuccagccugggugacagugagacucugucuccaaaagaaaaaaaaaaaagaaacaaaaaaaagaaacugguaacagugguuaccuguggggagaggaacugggcugccagagaacacaguauuggagggagacuuuacuguaaauuauuucauaccuuuuaaauuugggcuaucuguuccaaaaauaaauacauuaauuaauuuaaaaaaccccaauagcuauaacaaaaauucaaaaaagcaugcagcaaaaaugauucauauugcuucuuuuccccacuuuacaucccaagaaguaaugauugguaaaaauuucuggcuugucuuacuagaaauuuucucugcaugggcaaggguauuauauaucugcaauuccuuuuuuaaaaacuuuuuuuuugagacagggucgugcucugcugcccaggcuggagagcaauagugugaucaaagcucacugcagccuugauguccugggcucaaguguccuccugccucaacuuccugaguaauugggacuauaggcacaugccaccaugccugacuaauuuuucauuuuuuuguagagauccaggcuggucuugaacuccuggucucaagugauccuccugccuuggccucccaaagugcugggauugcaggcaugagucacaucacccugccugcaacccccuuuugauacagcuaguagcacaucauguauugugaauuuuuuuucaccuagcaaagaccuuggggacuuuucauauugacacauucuuucuaauagcuacauuguauuccuuugacagaugcucuaugauuuguuugccccuauugagauguguuuauguuccuucuagcauuuuucaguuguuuuuuuuuuuuuugagaugaaguuucacucugucucccaggcuggagagcaguggcacgaucuuggcucaccacaaccuccaccucccauguucaagagauucuccugccucagccucccaaguagcugugauuacaggugcccacuaccacauccagcuaauuuuuuuuuuuuuuauaugaagucucucucuguugcccaggcuggagugcaguggugagaucucggcucauugcagccucugccuccuggguucaagugauucuccugccucagcuuccugaguagcugggaccacagauacccaccaccaugcccggcuaauuuuuguauuuuuaguauagacgggguuucacuguguuggccaagcuggucucaaacuccugaccucaaaugauccaccugccuuggccuuccaaagugcugggauuauaggugugagccaccgugcccagucaacuuuuuguaguuuuaguagagacaggguuucacuauguugaccaggcugaucuccaacuuccaaccucaggugaucugcccaccuuggccucccaaagugcugggauuacaggugugagccaccaugcccagccauuuuucuauucuguauagugucaugauacacuuagauguauagagccuguuuugcacacauguaaguguagccaugggauggcuuucuauuauaguauuggaaugucuggguugaagguuuuugcauuuuaaguguugauugauauuuaguauuaacaaauuacccuccucugagagaacaggaucaugugugauggggacauauuuagcugguaauaccucccuacccugaaggguggcugugaagucgaagagaauaagugccugauguucagcuggugcucagcagaaggcaguggggauggggggucugguuacccccaccccuccucacauccccaaagagacccccucagcguagggcagggagccagucuucugcauguacuuaacugagcaccugccugguucugcccuagguucuggaauacagcacaggcaaugugacagguccuccgcccucaugaggacacagucuugugaggagacaguuaaugcauaggaaaacuaguacagaaaugggcaggcaggauacagugaccagauaggggagccuccuaggacagggggucaaggaaggccagugugaggaugugaaccuagaggaauaggaagaagacagccacaugacgcauuggguaagagcucaggagagaggggccagcaugugcaagggcccugaggagccaguggugggagccccagacaccuggggaggagcuguccugucugggguuccugagcugggaaccaccuggcuggaccaucagaccagauucagcaccugccuaucccucaggucuucuggagucauugagggcuuccaggaggggggacugggagcaaaggccugagggugggggccuagagaguaccacccucugagauaaaccaggagagcaggggaugcugugguggacgugcagguggagagaucuagagcuacagcccaggcugggcuuuugggggcauuguggggcagaccacaccagucacggggaggccaguggggcagcgagaacaucuccucccuucagcuggcaagcaacuuuccaggcccuccugucuggggucgggaauggggcgaucuggcuaccaaugggagugauguuccagcacaggacgguggcugggccugcuucugcacaggcuggacccugacuccucugugugcccccagcagcauagugguggcuccucuugagucaugguccuccccauccccuggacuucugucuccaccccugcuggcugccucccuaagcacaccuuccuccucagaguggagagggucagcuagcugcccaggccacagccuccccauuccuggaacccaccugaaaccccucccugcccggugcuccugagccgcugccguuccucuccuuacauucccccugcgaaaguugucagaaucaauauggagugacuuuguguuaaaaaaaaaaauaacccuuggcugggcaugguggcucacgcguguaaucccaucacuuugggaggccgaggcggguagaucaccugaggucaggaguuugaaaccagucagaccaacauggugaaacccuguuucuacuaaaaauacaaaaaaauuagcugggcuccuguagucccagcuacucaugaggcugaggcaggagaauugcuugaaccugggaggcggagguugcagugaggggagauugcacacugcacuccagccugggugacagagcgagacuccauuucaaaaauaaauaacccugacaaauagaacuagggaaggccaugaagggaggacugucaugcauaaaugcccaacaacaauaacugucacggaagacucuacaaaaaccacaaccuugcauaaagaccauuguaaccacacacaaaaaauacuucugcgaggacaucugcccagcaaaugccuauccgacccuggagacuggaaucacucuuguuauucaaggauaguuaucucaaaacaguuauguaauccucuucacuuuuccuuugaaaaaccucccuggauacacacuuaguuuacuauggcacguguacucucauuccaaugcccuauuccugaguaagcaucauuuucuuuuuuuucuuuuucuuuucuuuuuuuuuuuuuuugagauggagucuugcucugucacccaggcuggagugcaguggcgcaaucuuggcucaccgcaaccucugccucccagguucaagcgauucucuucccucagccucccaaguagcugggacuacaggcaccugccaccacaccuggcuaauuuuuguauuuucaguagagacggggguuucaccauauuggccaggcuggucucgaacuccugacccgaggugauccaccggccuuggccucccaaagugcugggauuacaggugugagccacugugcccagcuacaucauuuucuuuuuuucuuuuuuuuuuuuugggacagagucucacucugucgcccagccuggagugcgguggcacgaucucggcucacugcaagcuccgccucccagguucaugccauucuccugccucagccucccgaguaggugggacuacaggugcccgccaccacgcccggcuaauuuuuuguauuuuaguuagagacgggguuucaccuguuagccaggauggucucgaucuccugaccacgugauccgcccgccucggccucccaaagugcugggauuacaggcgugagccacugcgcccggccuuguauuuuuaguagagaugggguuucgccauguuggcuaggcuagucucaaacuccugaccucaggugaucugcccgccucagccucccaaagugcugggauuacaggcugagccacugcgccaggcccuuuauuuuuuuaauuuuaauuuuuuguuaucucuauaguaguucaaacagaugcccacuaauuuguuuuuuuuuuuuugagacggagucucuuucugucacugaggcuggagugcaguagugcgaucucagcuuacugcaaccucugcuucuggaguucaagugguucuccugccucagccucccaaguagcuaggauuauaggugugccccgcugcaucugguuaaguuuuugaauuuuuaauagagaugggguuucaccauguuggccaggcuauucuugaacuccuggccucaagugaucugcccaccucggccuuccaaagugccaggauuacagccgugagccaccgcgccuggcuggaugcccaccaccucuuaaaggguguuaaugauaaauuugaagaaaacaguacuugaaagccccacacaccagaaguccuggacaugaaguggcuuccugagggacuuaccucuccaggggaugugccuggaugugacuguggccuuuugaaggccaugcuugaacucagugguacgacaggggcccacugggggccauaucccugcacagucucuugaaaugugaacugcaguggcugccuggucugaauggguagagggcuggcucugugggucucuguuccuugauauuuccucagccuuaguugccaaggccguaguuauuuaauuugucaaacacugaauacucuaagaauuagaaugggccgggcgcaguggcucaagccuguaaucccaacacuuugggaggccgaggcgggcagaucacaaggucaggagaucgagaccauccuggcuaacacagugaaacccugccucuacuaaaacaaacaaacaaaaauuagccuggcgugguugcgggugccuguagucccagcuacucaggaggcugaggcaggagaguggugggaacccgggaggcggagcuugcagugagccaagauggcaccacugcacuccagccuggcggcagagcgagacuccgucucaaaauaaauaaauaaauaaauaaauaagagaauuagaauaaaucaguacagaaggcuuagaacagaaagcagcuacccauuccuugcccuagcaaaucugcuggccagagucagccccuuuuuccucuuuuagccauccaugucuugggcuccucuauuagccuuccagguucacuacuguaaaacaagcgcagaccacaguggcugagaaaagacaggcguucguuucccucuccugugacugccaggcugccccgggcucaaguggcagcuccgugguuuuguggcccaggcucuuucuucuuuacuguucugccaguguggacacaagacuucucacaucugagauggccccucugugccccuacaugcacaucgcagacagcaagaagggaaaaagaggaaaaagguggguacacuccacuucuuuuaaggacaugaccaggaaguugcucaccuacuuucccucauaagcuauuggccaaaccuggucacagaaccacaccugcuugcaagggaggcugggaaauguaaucuuugguugcaagguuuuaugugcaacuaaagcuucuaguacucuagaaaaggaggcaaucaguauuggagggaccauuagcaguuucugccacgguccauuuuggccacccagauaucuguauacaccugucuugaccugcauaaaacaucugcuuuccacaagggagauaggccugggggccuaaucagucacuuccuuuagggcaaaucugguaugugugggugauguguagccuucucuaauggccccagugacccagggccucucaaccaaagagaagcugucugcauccccuucccccagcacacccaaauuccaugguggaauuugaacaggaagccacaauaaaaaacuccuacuugagaugagaaacacgagguaguuacuugucuauagcagucaacaaaucuggcagaggagcaauuguaaaacucccuucccuguuuuuuuguggaguuuuuguguguuuuuuuuuuuuuuuuuuuuuuuugagacggagccuugcucugucgcccaggcuggagugcaguggcgcgaucucggcucacugcaagcuccgccucccagguucacgccauucucuugccucagccucccgaguagcugggacuacaggcgcccgccaccaugcccggcuauuuuuuuauuuuuuuuuauuuuuaguagagacgggguuucaccguguuagccagggugaucuccugaccucgugauccgcccgccuuggccucccaaagugcugggauuacaggcgugagccccugcgccgggccaaaacuccauucccagguaaaggaguaaguucuuugcuuggcccaucuggcagcccuugguucucagugaucugugauucgcgaagcauccuaagcaucaguaucaccugggaacuuguuagaaacgcaaauuauugggccccaccucaucugcugauucggaaacucuaguggugaggcccagcagucuggcuuaaguuccccagaugauucugaugcaccuugaaguuuaagaaccacugcucggcccggcgcgguggcucaugcauguaaucccagcacuuugggaggcccaggcaggcggaucaccugaggucgggaguucgggaccagccugaccaacauggagaaacccugucucuacuaaaaacacaaaauuagccgggcgugguggugcaugccuguaaucccagcuacucaggaaggcugaggcaggcgaaucgcuugaaccugggaagcagagauuguggugagccaagaucgcaccauuguacuccagccugggcaacaagagugaaacuccgucucaaaaaaaaaaaaaaaaaaaaagaaccacugcucuggcugggcgcgguggcucacaccuguaaucccaacacuuugugaggcugagguggguggaucacuugaggucaggaguucaagaccagccuggccaacauggugaaacaucgucucuacuaaaaauacaaaaauuaggccaggcgugguggcucaggccugugaucucagcuacuugggaggcugacgcaggagaauugcuugaaccugggagguggagguuugcagugagcugagauugugccacugcacuccauccugggcgacagacuacacuccgucucaaaaauaaauaaaaauggaaauacaaaaauuagccagagguggcggugggcacguguaaucccagcuacucgggaggcugaggcaagagaaucucuugaaccaggaggcagagauuguugggaggcagagauugcaaugagccaagauugugccacugcacuucagccugggugacagagcaagacuccgucucaacaacaacaacaacaacaacaaaacacugcucugauaccugguccuccgugauuucugggaaguggagcuuccacguucauuauucucuguggccuuaucugaaacggaacuggaaagaaugugcuuuuauuuagggcuccuuggcuuucacaaaccaccuccugcugguguggguuuggggacuugaguggagcuguaggagucaaauaaucuccagcuuuuaucagauucagcugugguuucuuuggcaacacaguucugucaaaaaacuagaagcuucugcucucuuggcuucuaaucaguucugcugugguaaucacagccgaagauccagccuagacacaucuuaauucucagcccugaaguguuuggucuguuauuuccuggcuucugcgcuuagccucgccuccucaccccccaauuuaaugugcuuaccuggagcuucccuugaagccaccugaaacaguaaguuggaugggaaggcaggacucuuaauuugacuuuugccuuugagcucucuguauuuggcagagaaccucuucugagggucaguaguagaacucagaaagguggagcagagauuagauuauuagaaagguuaguaccacagucuucccugcugcugaggcagacucuugagaucccccaagauggggauucuuguugacuuggauuguuagcuacaggcugggucuuuguuuucuuucuuuccuuuuuuuuuuuuuuuuuuuuuaaauagagacagaaucucgcuuuguugcccaggcuggaaugcaguggggcagugguacaaucuuagcuuacugcuguuuugaacucuugugcucaaacaguccucuugcuucagccucccaaguagcuaggacuauaagugcaaaccaccaugcccagcuaacuuuuuuuuuuuuuuucagauuuuggaauuuuugcauuauauccuuaguggcugagcaucccuaauucgaaaauccaguaucugaagugcauuucuuuugagugucauguuguugcucaagaaguuuuggauguuggagcauuuuggauuucagguuuucagauuagggugacuccaacuguuaucacuauuuucagucccucuauagguuggcuuugcaguguuaacaaauguacuuacauuucuuccauaagcuauaggcaaugucucccgaugccccauuuuguaaaaugaagcccuuuuuauccucuccucuccacuuucacuucccaucuucuggcaaagacuaguugaaaaauaguccucugugaauguugugaccucugagccuccaggaaagaacugggucuuggaugaagauucacccucugggucagacaggaaggcggaauacugccuuuguguccuaauugaaagcugccucauugucauguggagaguacuacaugcacagggcaucugcaguagcagaucauggucuagaguagcauuucccacaccaugugccucagaagacugguccagcaagauacccugcugcaaacaaaaggguucaugaauaacuaaacucgggaaaccccgcauacuuuaucacugccucugccuuuggagauuuacaaugcauaccaacugugaaggcucugauacguccugcagcaaagaaacuuauuuaggcuauuguuucccauucauauuugaccaugguacuccuuuucauuugauacugauaugcccaugagaucaauauacuuugugagucacugcucuggggaaauggugaccauggugagggugcugggcaucucagggaagccccaugauggagaaccuagggggucagaggcaguacuuguauguucagaccagcauccagugugagaagagucuguuucuggggcuaggguccgccaucacccuggggcuuaacgaugagaggccuacuccagagagggauuuuuccagaugaccaggcuuaggaggggacugugggccgggcuccagaccuuauauacuggcaucuuaggggcuuaagagcaggaauugaggcagaagugaguaucccagcuguggcucccaggcaaaggagaauccacuauaaucaaugcugagcucuagagcugauuaagugccaccaaaggcuggguuaggugcugagccuguagaugguggggagcagauggcucuggcucugaggguggagucuggaaacugggugcacuggccugugaggugaaauucucccucugcccugccacagggauuuagauaugcaggagcuggacaagagaguuaauaaggaacuaaaaauacauuuuuugucuuuuugagauggagucucacgcugucaccugggcuggagugccauggcucgaucucggcucacugcaaccuccgccucccggguucaagcgauccuugugccucaaccucugaguagcugggauuacaggcaugcacuaccacgccuggcuaauuuuuguaauuuuauuuauuuauuuauguauuuauuuauuuuugaaauggaguuucgcucuuguugcccaggcuggagugcaauagcgcaaucucggcucaccacaaccucugccucccggguucaagcgauucuccugccugagccucccgaguagcugggauuacaggcaugcgccaccacgcccggcuuauuuuguauuuuuaguagagacaggguuucuccauguuggucaggcuggucucaaacucccgaccucaggugaucccccugccuuggccucccaaagugcugggauuacgggugugaaccacugugccuggccuaauuuuuguauuuuuaguagagacaggguuuugccguguuggccaggcuggucuugaaucccugaccucagugauccacccgccuuggccucccaaaauauugggauuauaggcaugagccacugcgccuggccuaaaaauacauuugcugagugccuacugugcgcuagaugcuggggaugcaaccaugaaaacacagccaaggucucaggccucauggagcuuacaguccagugggagaugaauuauaagaagcuaacacacagaugcaugucacccacugcaguaugagugcucaaaggauaaauguaggucagguggggagggcagguaggagagugcaagaugagaggauuugaucucaucaggggaaguuucucugaggcagugaaacuugagccuccuccguaaggaauaguggaccaagaagugaaggacgacacacacauaucuagccggggggagcagcauguacaaaggccugggggugggcugaggcuggggacagggcagggucaggccacccagugccaugcaggcuaccgccaagaguuugcuuucaccggagagugaagggaagacguuggagggcuuccaccugggaguauccccuguuuuggccacuauauggacuggggggcugggccugugagguuccagaugucaacugaguaggacaggaagacacuucaggaauccgaagggauuugggaagugaccaagguuuucucuucccaucuguugcuacuaucuaccugaagucuugaguuucacaauuuucaugcaguuucuucuugguugugcaacucuugacaguuucuaacuuuggguuuggcaucucggccagagucauuuccuuccuggagcugggcucucauugaguggaaaauuuggggcugcuauguaaaaugaaacagaagagaaugaacccuuccucuccggaaggggccgggcugugccagguccagacagggcuugugugucugcucucuuggaaggcugcccugccuccgccccuuuccagcugcuagggcacaacagaacaugccuacauccagacccugcccacugcagacuugccacuggaggcgacacuguuuugggccaaaaccacaggccaggggucagagcaccuggguucuaguaauagcuuguguuuagcaccugauaugugccagguaagcaucuuuucucacaacucuuauuaucccuauuuuauagaagaggaaacugaggcucagagauuaaguaauuucccaaggccacauagcccauagugaugaggccaacaugggaauucaggucugccugaccuuacccgcuucuugguagguuacuagauugcaucaucacuugccccaucuggaaaauggguaaagacauugcccuaucuacuuuucuuguagacugggaagguucaaagcauacgagauggugagguuuucuuuguuucuuuuuuuuuuuuuuuuugugagacagagucucacucuguuguccaggcugaagugcaguggcaugagcuuggcucacugcaaccucugccucguggacucaagcaauuauccugccucagccucccgaguagcugggacuacuggcgcccaccaccacgcccagcuagagguuuucuuaaaguuaauugcugaguggcuaaggacaggucacuugaccuuuuccuuccaugcauucauuauuccauuggaaaaaagcaaggcuuuaaucacuguuggucucuugagagugguguuagaaugaacagaguguggaaugccucuaagccaguccccaguguuucagagaggaaggguaagagcuagggugaagugaaccauccuuuauugaacuccugcuagaugcuuagcucuuacaacuagucuccuccaguugcaaguuuuggacacauacucagaugaugcauuagccaggauaggcuugguuaugcugcgguaucagauaaaccuugaaaucuaguuccucaacgcaacaaauauugauuucccacucaccugaaguccaguaagggucaugcagccuccugcauucuuguagccagcuaagucaucuagaacauguggcuuccaaagucacuguggcuggggaagagaggguuggaagaggcucacuagcuguuaagugcuucguccaggaagugauagauagcaucuucacuuaaaauccacuggcuaggccgggcgcgguggcucaagccuguaaucccagcacuuugggaggccgaggccggcggaucacaaggucaggagaucgagaccauccuggcuaacauggugauaccccgucucuacuaaaaauaaaaaaaaauuagcugggcgugguggcgggugccuguagucccagcuacucaagaggcugaggcaggagaauugcuugaacccgggaggcggagcuugcagugagccgagaucgcgccacugcacuccagccugggcaacagagcgagaaucugucucaaaaaaaaaaaaauccacuggcuagaaccagucgugacgcccagccuaauugcuaaggaggcaggaguaugagacagagcagaugguuauuugguaaguacucucucagcuacagguuaccucaguuccagggcgcuuacaguaagguucugccuaacuguggccuacaaggcccugcauggucuaccuuugcccggcucuucaaccucaccucuaccacuuucccccucagucauuccccucagccacuacggucauccuucacuugcggggauaugccaaguguuugcugccuaaggaccuuugcacacguguucccucuccuuggaaugcugucucuccccagcuucccuacauucuuccaugcuaguccuuuucauccucugggugucugcauauguggccccuucucauggcagcuuuuccuggccagccuauggaaguagguccaucaggcaccccucccucgaguuuguuuucagcauagagcaccucccaguuuauaauuagaugucuuuuauuuaacuagcuuaaugucaguauuacggcaguuuugauaaaggauuccccauucccuaacacaaaaugaaugaaugaaugaaugagaaagaaugagucauuucagcagcagguggaguacaaguucaguggagaaccagggaucgcacaauuaggaaggcaggcugugcucucagguuugccucauuucaggucuagcuugaguugggaguguguguguguguguguguguguguguguguguguguuguguguugugugugacuguguauggccuggagggccaaacccagggauuaggagggaaaggaaaagagagggcgcggaaagcuguguuugucccugauagagccagcuggcacgagggugcuuuaguuauagcugaaucacuuuuguuuguucuggaagggaucuauucuggccacaugagucagccuaagaacaaauuacuguguaguuugacgggcgugaaggguuggggggaauuuccagagugugcucacccaggaaagaccuuguugccagcucugaguccccucugcuccaacagcuccuggauuugccaccgugugaaauguucucaggcagcuagugugacggcccaggccccgucagccaaaggcccagcacccauaaacauccuuuaguccuuucuccugaaggaacugggccauaaacaagcacauaauaaauaaaucugcauucuaggcuucgcuuucuucagauauaagacaacuaccuuauacuugguagcaauuaucccccagagcuguuaccugaauuaaauaggccacagauaugggcaagaacuuaggaaaaaaagccugaccuagaguuagaguggucauuauaauaacaguaguaggaggccaaggcggacggaucaccugaggucaggaguucgagaccagccuggccaauauggcaaaaccccgucucuacuaaaaauacaaaaauuagccgggcgugauggugucugccuguaaucccagcuacucgggagggugagguaggacaaucgcuugaacccaggaggcagaaguuguaaugagcagagaucgugccacuguacuccagccugggcaacagagcgagacuauagcaaaugaugguagcuuagaucugcuggguguuaauuuuuuuauccucauggcuggucucgggucggggguccacuuccacaucucauuugucggaugaggaagccaaggcuuaggaggaucccccugcuggugagccugacugcaggacacacuccagacugcgggaguucauuugccuuccguggcaucagugauucaugcucauuaggaagagcacaggcauuccgaaaacaaaucagagagaaaaagaaaucaugccuggcaaccagcucuggugaaccaugacaggggcacagagaagcgcuucugccccucccccauuuccuccuuguaucugggacucagcccucaucacuguggguucucagccucagcaaggcagcuuucacggauauccagauuccaggcugggugcaguggcucacaccuguaaucccagaacuuugggaggccaaggcagguagauugcuugagcccaggaguuugagaucagcuugcgcaauauggcaaaacccugucucuaccaaaaaaaaacaaaaacaaaaacaaaaacaaaauuagccuggcgugguggcgugcuccuguggucucagcuacuugggaggcugaggugggaggauugcuugaacuugggagguagaggcugcagugagcuaugguugcaccagugcacucuagccugggucacagagcaagacucugccucaaaaacaaaaacaaaaaauccagacucugucugagaacugccgugucaaccuucuggugccuguggccaccuaagcuauagauuagcuguuccuuccgucaccugcguccccuuccuaucccugggggucccagcagggagaacccugggcugcccaccuccagugugugacugaggcuggcugccaauggcgugggcacaggcccccaccuccccugcugcugggcuccuauguuacuuugcucucauggccacuguaccucucgggacugugcaccaaguugcugcccaccuagaaucgguuuccauuagaguguuuaaaauguuaaaaauagccuuccacccuaaaugcuuccuucggaggcccgaguugggaaucagagguucuuuucuaucugcaccuuucuggcagaacugaaggaggguggcuguuugcacaguguugugggccccugcccugggccagccacuucacauuugucaucauggagcccugggacggcccugggaggugugggguuauuauucugauuccacaggagaggcgcaugaagcucagaggguuaggaggucugugccugggcgugaagcuggaaucgcagagcuugggucuggcucaagccagagccgacgcuuccccacgcuuacucuugugauccuaguucuacucuuugaucacagucuguguuuuuggaucucaugauccugcagaaucaacuuuauguguggaauucucuugagaauuuaauccugggaggaaagagugcugucuuggaagccugaggcugccccugucuaucugugauaagaaguccgugagcagcucacuccugagccuuggccuuggcagauaggaagcucagugcgagaguuaaagcuugucacagcccuuucuuguaggcauuuggccuccuuugccucauccugccuuugguguucuauuuuuauuucacuagcucucuggugugccagccugaaugagugggcguugcgucuuucuagcuagcagggagcagguuuggagggaugaggacagaggccauuuucuccaucuucauguuuggacagugggacaggcaugcaugggccugccuguccacccagcucagaccaugccggcagcuccaggguggagaugagggcgguucauguuuauacgcaccauuuauugcuugcauuuuaaagacaucuaaaaacucaaagcuugagaagauggggguuucacaggaaaccagaacuucuuguuggggcugacauggggcucuguuggcuuacauccguggcuggugugaccuggugccucuugugugggaggguggauguuagccccaagugugcugacaggucuggucacagguagcccugccgacaccgccccuccccaucuguuccucacuccugcucacuuccaaaugcccuguggugccagguggggccaccgcaugucacugcagaaggaacaagaaaaagaaagagaaaagcuggacucucuuuaggaugaaaacauaaugacauuuuuuaucuuccccacggguggagcccacagaggucggccacaaauggguugguggccuugauguuccugccaaauguguuuugacagagaggcaaagauuugugcugaacaaaacauuacccugaauaggacacuggacugggagcaguggcucaggccuguaaucccagcacuuugggaggacaaggugggaggaucacuggggccuaggaguuugagcccaggcugggcaacauagugagaugcugucucuacacaaaauuaaaaauuagcugggcgugguguugccuguaaucccagcggcaugggaggcuaagagaggaggauagcuugagcucaggaguuugaggcugcagugagcugugaucacaccacugcauagccugggugacagagcaacacccugucucaaaaaaaaaaaaaaggaacaggacacugaaguuaaguaaggcuguaaguaucacccucauccccguuuuacugugaugagaacaaugaggcucagccaggcaggccuccgacaaggagaaggugccucauuugcugggaucaugggcgguucuggguguaggugagaccuuuagggagcauuuuauacuguugcgggccuggccucugcaggaggucacuguugggaagugacuucagcgagcccagccggcccugagccaggggagccacugcugcccuuuugacacagaugucacaaggaugacaagccuuuccaggagcauaagccccacuugaggcaguuugaggagggaggguggagggagagaggcagucucucccugccagagaggggaggcugggaaagaugaggacugggaguggcgggggguagccuuccaagggagcacaggcagagcuuucacuucugugcacccugggagcgacagcucuguuccagacccgugcuugaaucagcacucaccccgacauuguucauugucauucuguacaagggacugguuuucuguuguuguuguuuuuugagacagagucuugcucuauugcccaggcuggagugcaguggcacaaucuuagcacacugcagccuccgccucccagguucaagcgauucuccugcuucagccuccugaguagcugggacuacaggugugcaccaccacgccuggcuaauuuuuguauuuuuaguagagacgggguuucgccauguuggccaggcugguccagaacuccugaccacaggugaucugcccuccuuggccucccaaagugcugggauuauaggugugaaccacugugcccggccuagggacuguuuauucuccuccugggccuguggaaggcagugggaugccaugaggcagacagugauccugugauuccugcaggcaaggcccuuguuggagagaaacuggcuucuagacuccgaguuucagccacaaaggccuuggccugauggcaaucaggauggggggguguggccuauagaaccacugaagugcccguggagcccagguugggagagaagugcauguucucugggugcccuuacgucagugguucugggaggagaccccgccuuccugccucagugcugccugccucccuguuucccuugggcaggucuuguuccccgcugagccucagcuuccugacuugagaucuccaggguuguggggagggugcuugaauugaacguaucaauacacaacguggacauucguuggugaaaaacagaagugagguggaucugaaucucaugaagggcugauucaucgucugcucacuggagccagagggguccccagggcaaacgcuacucacacuagcuuggaagacucaguucucgucauuacuuuagcuagcuugcuaacugauuuuuuuuaaaagaaguauacuuuacuguguaaauaaugcauaaugauuuuguugaaaaauucuaugauaugaauaaaucacaaagaaaaaaaccccacaauauaaaacaggccaggcgcgguggcucaugucuguaaucccagcacuuugggaggccgaggcagguugaucacuugaggucaggaguucaagaccagccuggccaacauggugaaaccccaucucuacuaaaaauacagaaaaaaaaaauuagcuggaugugguguugcaaaccuguaaucccagcuacucaggaggcugaggcaggagaaucgcuugaauccaggaggcagagguugcagugagccgagauuccuccacuguacucuagccugggcaacagaguaagacucugucucaaaaaaaaaaaaaagaaaaagaaaaagaaaacuaaaagacucucauccuacucuucuuauccucaauauguggacuauuuaagagauaaccaauauuuuaagacuauaaccaccacagaaauaaaggucccauauuuugagcuaagcagugucuccauuagucuucauaaaaguuguccaaaggagggccgggcaugguggcucacaccuguaaucccagcacuuugggaggcugaagagggcggaucaugaggucaggagaucgagaccauccuggcuaacacgcugaaacccugucucuacuaaaaauacaaaaaauuagccgggugugguggugggcgccuauagucccagcuacucgggaggcugaggcagaagaauggcgugaaccugggaggcggagcuuguagugagccgagauugugccacugcacucuagccugggcgacagagugagacuccgucucaaaaaaaaaaaaaaauuauuuaaaauaucagugacaguaaagaaaacacaaggaagaagccacucaggccgggcgcaguggcucacgccuguaaucccagcacuuugggaggcugaggagggcggaucaugacgucaggagaucgagaccauccuggcuaacacagugaaacccugucucuacuaaaaauagaaaaaauuagccgggcgugcuggugggcgccuguagucccagcuacacgggaggcugaggcaggagaauggcgugagcccgagaaucggagcuugcagugagccaagaucacaccacugcacuccagccugggcgacagagcgagacuccgucucaaaaaacaaaacaaaacaaaacaaaacgaaaauuuauuuaaaaugucagugacaguaaagaaaacacaaggacgaagccacucaucaccccccgacauucagccuuguuguuauuuuugugcauucccgaugucuccccaacuccucccacccuggggaagucagugaucaccccuuuguuccuguuugucuggggauuggggcgucugccccugggggaauuggggcuggugguggcagugauggcagugguguuucaauaguucugcccuagcugggugggagacagugaaaccagucccagguuugacuguuguuggcuguuuuacuugacacaagucauuucacuuaucugagccucaauauacucaaaaauaaaaugcagauaaaccuaugaacuaccagagauuguugugaaaauuaaauaaauaugcacggugccauaccaguguggugcuaugcaaauuuagguccuauuauuuuaguucaaaagcuuggguuugaaaagugaggucccaggguaacaauugguuuuguuuagagaggcacaguugaccaguucaaagaaauguugcuggagauguuuugucccagcccuaccugggacaucuguugugacauccccugugucaugcuuuaugucaugcucugugugacaucaagcgagucagcagcccuuccugggacuucagugccccaguuuuugucauucucaaacaugagucuaucccaaaccaccagagaaugagggacuugaaugcagggcuauagcaucagguuuuaucugggaggcaauggggagacagaaagauucaggcuaaggaguguggacauuaucuaggcaauggggagccccauaaaggcuucaagcagggaagugacgaggccagauguauacuuugguaagaaguagccuggcaaggguguggaggcugccugagcuggcggcagggcccagccagaagggauaagaucagggcccaguggaggaggggagaggaagcuguuucacagagcagcucugagaagcuggcuggaagcugagguugacacacccucgaagcaccuuugggguuucccaaguugauguaaaaaggaaaugauuacccucgagaaggcaggggaguucuucggccaguccugcgugccuuuggcaugugaucuuagcaagucauuuaaccugcucaggccucaguuuccucaucucugaacagggaugagaagcagagauguugugaggauucaugucugugcagcugggccugggccugguacagcccguccucaguggccauggcugcuguuuuaggauucucauccaucaagugggaaggaugcguuugucuccacugcgugaaagggagguuguaggacagccagaacuuugaucccuaggggcuggagugggagcuuagagggauggugucuuugacccgcucacguguucagggaaaugugcagucuacagcgcccauucccaucucuacucuccuuucccacaugacaccccagcgggaggcaaacggacgccauuaucaccuccguuuuauaggugagggaagggagaccgagaggaggaaggugacuuguuggaggucacacagcugguuggguggaagcagguguaugugacuuagcacgucagagcuccaccuucaccaggacugccauguucagccacugcucuuuuuuuuuuuuuuuuuuuuugagacagagucuugcucugucgcucaggcuggaguguaguggugcgaucuuggcucacugcaagcuccgccuccccgguucaagugauucuccugccucagccucccaaguagcugagacuacagccgugugccaccaugcccaacuaauuuuuguauuuuuaguagagaugggguuucaccauguuggccaggcuggucucgaacuccugaccucaggcaguccacccaccucggccucccaaagugcugggauuacaggugugagccaccgcgccuggucuaccgcauuuuacagauggggaggccggggccagaaagggaaagacccucccgcccugcaacaccaugcauuuguggcagagccagaauuagaacccaggucucugacuuccagaaccagucucucaauggcuaccccacuucauggaauaguaauaacuuucuuuccaccuuguuuucagggaaaccggcuccugaaaucaggugucccauuccagccuucccugacucugugaagccagaaaagccuuuggcagcuucuguaagaaaggcugaggaugaacaggaagaggggcagccugugaggauggccaccuuuccaggcccagguauuuuaaauuuaacuuuuuuacuuaaagcacuuuuauuuaaggaaaugaagauauaucuauaaggacauucagcuuagcauauaagagcaaaaaauugaggcugagcaugguggcccaugccuauaaucccagcuccgugaggcugaggcgggaggauggcuugagcccaggaguuugagaccagccuaggcaaccuggugagaccuuuucucuacaaaaaauuuuaaaaaaaucauccaggcaugguggcaugcaccugguagucccagcuauucaggaggcugagguagggggauugcucgagcccaggagugcaaggcuguggugagcuaugaucacaccacugcacuccagccugggugacagagcgagacucuuccuaaagaaagcaaaaaaucuggcaacaacaaugggggauaauaaaauuaaugucagacagucacaacaaaguacuaucaacagugauguagacgugcauauguacauggaaacauacugacaauaucgggagguagaaaaguagaaaaaaucagguaacaaaauguauauaacaucuguuaccauuuuugugagcagaaaagaaauagcucgguaauuggaggcuuucuagugccagacacuauuccaaguacuguacuucaaagauauugacucauuuaaucuucaacuaacuaugaauuagguauugugauuaugcccauuucauggaugagaaaacuaaagcacagcgagguuaaccaaccuggcugaggucauguacugccgggucccuguuuucaccaguggucucccguguccccagcacagguuggcccugcgugcaggcucuggaccggaugucugaccauuucucuguccauucuccauaggccccggcccucgcagccaugcaguggggaauugaggggugcuuccugcccaccacuuuccuccccuccaucagucacagucugcugaagcccagagagggagagcagcuugcuuaaggucacacaaauaggaaguaaugucugagcugugugauuugaacacucacaucccuaagcaucauacucacugcuaucccaaauccuuuuggaccacuucagauuugucuccgucgccugugcccaggcaagggcucagggacaguuuccaaaugacagaauggcucagccagcagaugaccucccuaggggagcugcugcucagcccaaucuccauucucaccgccucaccccuggagcccugccucaccuccugucuccugcggccuccugaguggugagccagagaccccaaauccauguaaucucaguucacuguugccguuucugaagccaggggcggcaucagcugaaaggaacauguuuugugggcuuuuguauuagacagacucauauuugaauccuagugcugcuguuuuguagaaugacuuagcguuuguaccucaguuuacucauuuguaaaaugaggagaauaauagacccuauuucaucacguugugguaagaaauccugcaccugaguguugcaccauggaggugcucauuaaauguuaucugauauuaugaacauuccagacacuccagauagguugaaucuagaaaguuaauucuaggccaaggagucuggauuauuuccuguagcuaaauauauguauuuuuaaguguagacuuuugaucagcaaugaaagauaaggggaaaugguccugaccaaagggaaaauuauaacaaaauagggaaauuguaggggcgugcuggucaggauggaagagguaauaggcauagcaguuccuucugguauucuuuaucuagguuacuguaaagauaaacaucacagccagccgggcgugguagcucaugccuguaauccuagcacuuugggaggcugaggcggguggaucacgaggucaggagaucaauaccauccuggcuaacacggugaaacccugucucuauuaaaaauacaaaaaauuggccgggcgugguggcggguacauguagucccagcuacgcgagaggcugaggcaggagaaucacucaaacccaggaggcggagguugcagugagcugagaucgugccacugcauuccagccugggugacagagugagacucugucucaacauaaaaauaaaaguaaaauaaacaucacaugucucugucagccuuugcuguuuacuuucuuuccuuuuuuuuuuuuuuuuuuuuugagauaggccuugcucuguugcccaggcuaggugacgguggcacggucauagcucacugcagccucaacuucccuggcugaagcaauccucccacuucagccucucaaguagcugggacuacagguguacaucacuacggccggcuaauuuuuuauuuuuguaaagaugggaucucauuauguugcccaggcuggucucgaacuccugggaucaagcgauucucccaccuuggccucccaaaguguugggauuacaggcaugagccacugcacagagcccuauuuacuuacuuucuuuuuuuggcagugggauggaaucucugucacccaggcuagagugcaguggcacaaucucggcucauugcaaccuuugccucccggguucaagcgauccugcugccucagccuccugaguagcugggacuauaggcacgcaccaccacgucugacugauuuuuguauuuuuuguaaagaugggguuucgcuguguugcacaggcuggucuugaacuccugggcucaagcaauccaccugccuuggccucccaaagugcugggauuacaggcgugagccacugcacccagccccuauuugcuuucuugauggcacuuggagcaaaugugcccaggcaggucaagaugauaacuacaauuugcaggcagagacaggaaguugauugucuaucuuugccuaaauugaaaauaagaaaucauucauuucaucaaaccacccaaagcuugucuucuuucgggaaaaccccaagguuccacugagccccagaguucaaacucaucaauuaucuuaaaggauuuugguaggagugaaguauacugagcccacaucuugaucccugugauacccuggcucccccuugcaguaggugggaaggaagugggaagagacauggaggaggaaaauauguuuguuuguuuuguuuuuugagacagagucucgcucuaucacuaggcuggagugcaguggcgcgaucucggcucacugcagccucugccuccuggguucaagugauccuccugccucagccucccgaguagcuggcacuacaggugcgcgccaccacgcccagcuaauuuuuuguauuuuuaguagagacgggguuucaccauguugaccaggauggucuugaucucuugaccaccugccucggccucucaaagugcugggauuacaggcaugagccaccgcgccuggcugaggaggaaaauaugugagcagaggagccauggauaggcuaugagcaccucggcaaagcagucucgaagcuagaauucagaugaaaggguuuugagcagcugaaauaacuguuacaaagccuuagcuguaggagaggccacugggcuaucagucagaaucuguuuacuuacucuacacauaguuucaccagccuugguaaaauaccaaguacugcaugugucacagccugaccuuugugcucuauaaacaucagcucuuuuuaccuggacaagaaacagaccauuauugcucuuuuuacauuugagaaagcucagauaagugaggcacagcucaucugaggucagaucuugaguagugcuggagccagcgcuugagccaaauucuguuugauacuaauaaaggagauggggcagcuggggguagacccgcugccagcaucagggcaggacauagaagaccccaugucagauacagugccgcugcuucugcaauucuuguaccugcaaugacacagcucggcaggaccagagguggugcauuuugcuugagaaagcaggcauauuagccucaguagaauagcaacaaaaaggccaaggcagucggaucaccucaggucaggaguucgagaccagccuggucaacauggugaaaccucaucucuacuaaaaauauaaaaauuagcuaggcauggucucaggcgccuguaaucccagcuacuugggaggcugaggcaggagaauugcuugaaccugggaggcggagguugcagugagccgagaucacgccacugcacuccagcuugggugacagagaaagacucuguuucaaaaacaaaaacaaacaaaacagagcaaaaaagaaaagcaagaaaaagaaagcuucuggaagcauuuccauaggaaaugguuuguuuuuuagcuaaguccuggcacuugaucugaccucugauuagcugugccucacucuuggaaacaagauuauguagaagccccaagccccaucuaucacuaucacccaacaaguaucccaucuuguucaucuacucuccugccccaucucccuccccucccuuagccauuauuuuaaaacauuuuuauaugaaaaaauuacaaacauacaaaagccaagagcauaaugacccuccauguccccaucagcuggcuucaguaaugauccacccauggccaacuucugauuaguuuguauggaauccagggagauuuucauauccuugauagcuggagaauuccuucucauucuccucucucugcccuuggacauacagugggggccuuuaaagauuaugguugugaguuucuccuaccacagauaacuacccuaggcacgaggagccaauccgauuagaccccagaggaggggagggcuggguagggagagauggagaguaauggcugguggguccugucugauuuuccagaccagaguccauuucuuuuccccaagaccacagggauaaauaaacccaacuaauagcccucaugugucgcaggagcaggccucagggauucccccaaacugagaggccugggggagccuccugagcaaaccccaggcauuaagucagauaggaaacucaugacuugugugaggcaagcucugaccucagauuuacugggcacagaaggacccugugugcagagacagcccugcccuguggccaggccuggcagcaggauggaacucaaguuagucuggagcagcgguucccaguguggggcccacaccugcagugguacacagaaccuggguguuagcacaaauauagaucauguguagaagaacuagggacuucauggauauuacuguuuaacacaaggcugaauacauaacacuggaauuaaaguugguugaaagaaaaccgucaggugacucauagugagguggcacagacauggccaaaaacuuggagaccggaugaacauaacugcagucugagggaugcgggccaaggguacugagcugaggccaagagaaggcagggcaaggguggaaguggccaucacagagcagccuuucugcaggacgggggcccugugcuggccagcagaggccuccauuaguccagguccuuggugagaggcagauaccaagacaggauaggauuucaucaacaagauaggauuucauuaggacaaauacuugcaagaaaaugcagagggagcugggcaaggcugggagagccuugggaccauggugcgccauuuccgaggaaggcugggugggcacuugcuggccugccuucggucuaaggcagacucuccaggguguccguuggccaucacaguccuaucugccuaguguacccucugcacacagugccuggggaacagccccugggaagcaugguccggaugcagaugcagggauugauuggagccagccacagccaggcccgcagauagccaggcucccagcagcugggggucuccagcucgcauucuccuggcugcuagauucacacagcagcagggcaaagaucccaggaaugaggcugagggcagccccuugacaggcuccagaccuugucucaggugauuucauguuaucagcuaucuguguggguuaauuguuuagccaggcugauuuuacuuucagucucgugaaauaaaauuuuuuguuuuuuguuuuuugagacugagucucgcucuguugcccagguuggagugcagugguaugaucuuggcucacugcaaccucugccucccagguuuaagcgauucuugugccucagccuccugaguagcugggccuacaggcaugugccaccaugcccggcuaauuuuuguauuuuuaguagagacaggguuucaccauguugaccagacuggucucgaacuccugaccucaggugauccaccugccucagccucccaaagcgcugggauuacaggugugagccacugugcuggccaaaacaaauuuuuuuuuuuugauacagucucgcucugucccccaggcuggagugcaguggcacagcucagcucacggcaaccuuugccucccugguucaagcaauucuccugccuuagccucccaaguagcugggauuacaggcacucgccaucaugccaggcuaauuuuuguauuuuuguagagaugggguuuuaccauguuggccaggcuggucuuaaacucuuuuuguuuguuuuuuuguuuguuuguuuugaaguggagucucacucugucacccaggcuggagugcaguggcacaaucuuggcucauggucuuaaacucuuaaccucaggugauccaccugccucggccucccaaagugcugggauuacaagccugagccacugugcccaggccaaaauaaauuuuuuaauagccaaaguuccagaugagucauuccuuuccugauguuguaagccacaaauaccugaagcagguagauuuauccaguaaucuuggggucaaguccaguuuccuuuggaagggucagguccccaguuacucagaagcuguccuugccauggggcuuccuagguauuuccagaugaugauguuugaagccucuggccuuuggccaaggccugcuucugugcggaccagccaccauggcucaccucacccacggucugugccugcgcccaccgaggagccccccuaccagauggccucauuagucuucagauuaaucuucacauggggccuagugaagaaauuucacccucuuuaaccucacguuuaagugacccuaaacuacuugucaaacauuccgucuugugaaucuuguucacucacuaagggauuggggcauagacauggccaagcaugguggcucacgccuauaaucccagcacuuugggaggccgaggcaaguggaucacuugaggucaggaguucaaaaccagccuggccaacauggugaaaccccaucucuaauaaaaauacaaaaauuagccggcaucauggcgcacgccuauagucccagcuacuucguaggcugaggcaggagaaucgcuugaaccugggagggggaguuugcagugagcugagauugugccacugcacuccagccugggugacagagugagacucuguuuccaaaaaaaaaaaaaaaaaaagaacauagacacuggaaccacugaugacugugugccccaugugaagauuaaucugaagacuaaugaggccgucugguaggggggcuccucggugggcgcaggcacagacugugggugaggugggccaugguggcugguccgcacagaagcaggccuuggccaaaggccaaggcccuuggaaaagugacuuaacuucuccaugccucauuucaccaucugcaaagaggcaaugaaaauggugcagugguaccuuauuuccugauuggcaugaggauuagaugaguuaacgcacgggaaggauuuuuuuugagacagggucucauucugccuccuaggcuagagugcaguggugugaucauggcucaauauagccuugaccuccugggcacaagugauccucauccucccaaguagaggggaccacagguguacaccaccauaccuggcuauuaaaaaaaaaucuuuuguaggacugagcgcaguggcucaugccuguaaucccagcacuuugggaagccaaggugggcagaucacgaguucaggagaucgagaccauccuggcuaacacagugaaaccccaucucuacuaaaaauacaaaaaauuagcugggugugguggcgggcgccuguagucccagcuacucgggaggcugaggcaggagaauggugugaacccgggaggcggagcuugcagugagccgagauugugccacugcacuccagccugggcaacagagggagacuccaucucaaaaaaaaaaaagaaaaaaaaucuuuuguagaaacgggaucuugucauguugcccaagcugaucucaaacuccugggcugaagcaauccuccugccucagccucccaaagugcugguauuacagaugugaaguauuuagaacagugccuggcaugauguuugcuaacucauguaccuagauguuaacuuacuccagccccgggcccuucuacugccccaccucugcaugggcugguuccacugccccauaucugcuuguugaaaacguuucuccauauuucaagcccaggucaggugccacuuccucugugaacccuccucaucucccagccuguuauggucucuccugccucugaccucgcucucccgugggauguauccucggaggauaguuacugcaucccugcccugguggagguuucuggaaggcaggcuugguagcuaguucaccucugugucuuuuucugcucuuugaguaggaggugagauagugcagggccuagaagucaaacagauuuccgucugaauuucggcucuaccaucuacuggcugggugguccugagcacugcgucuaccuccggugucuccgugucuccacuugccaacugggaugauaaacaggccccagguuguaggggagucagaggcuuauccugaggugaugcuugaggaguguguugguuggcacauggugggugucaggaauuggcagcaacaaguguuuggggagugaacaggagacuggcauagucugaggacuagaccaggaucccuccugucuuccuccccgaggcugcauccugacccauagucccuccuuuccaggguccucuccagccagagcccaccagccggccuuucuccagccuccugaagaagaugccccucauuccuugagaagcgaccuccccacuucgucugauucaaagguaaauccaccccucggcugcagcccccaagccaugucucccagcguguaguucccucucaaaaaugcaauuucucuaccccuugagaccaguuuaaggguggagaggagaaaggaaauugccaucaaauuaccccaagcuucuaagacuguaaguagaggaggucaauaauagcggggagagggagggagggcacuucagugaauauacuucuuguuuuuuaauuuguuauuauuauuauuuuugagacagagucucgcucugccacccaggcuggagugcaguggcacgaucucgggucacugcaaccuccgcuucccggguucaagugauucuccugccucagccucccaaguagcugggauuacaggugcaugucaccaugcucggcuaauuuuuuguauuuuuaguagagacggggucucaccauguuggccagcuuggucucgaacuccugacgucaggugauccaccugccuccgccucccaaagugcuuggauuacaggcaugagccacugcacccggccauuauuuucuuuuauuauuuuauuuuauuuucgaccuguggucucagcuacuugggaggcugaggcgggaggauggcuucagcccaggaggcagaaguugcagugagcugugauccuaccaccacauuccacccugggugacagagugagacccugucuccaaaaauguaugaccauauugguacgaagauaaauaaaauccaagcaggauuaaaaaugaggacauuucuuugacucuaaaaguccauuuauuuucuucugauuuuaaaauaaauuaaaauguucugauggccccuaaaaguguugugagccuagacccuuugcauccagugccugggggagaagccagcuuugcaugagugugguuaaugaagcucuuccaugucccagguguggugucacaugccuguaguccuggcuauuugggaggcugaggugggaggaucgcuugagcccaggaguuggagaccagccuaggcaacacagggaggccccaucucuaaauuaauaaauagaucaaccuuccaugaaggauaaacccaacacuuugggagguugguaugggagguucacuugagcccaguacuuugagaccaaccugggcaacagugugagauccugugucuacaaaaaaguuuuuuuuguuuuuguguuuuuuuugaggagucucgcuccauugcccaggcuggagugcaguggcacgaucuuggucacuguaaccucugccucccagguucaagcuauucuccugccucagccuccugaguagcugggauuacaugcacaugccagcauguuuggcuaauuuuuuuuuguauuuuuaguggagacaggguuucgccauguuggccaggcuggucuugaacuccuggccucaugugauccgcccaccucagcaucccaaagugcugggauuacaggcaugagccaccgugccuggccaaaaaguuuuuuugagacaaagucucccucuguugcccaggcugucucgacucacugaaaccucugguuccccaguuuaagcgauucuccugccucagccuccugaguauccgggauuauaggugugugccaccacgccuggcuaauuuuuguauuuuuaguagagacacgguuucaccauauugcccaggcuggucuugaacuccuggccucagaggauccgccugccuuggccucccacauauggugagauuacaagcagugaaucacugugccuggccucgccaaaaaaaaaaguuuaaaaaauaagccaggcgugguggcacacaccuguagucccagcuacuugggggcgcugagaugaaaggaucccuugagccugggagguugaggcugcggugagcugacaucaugccauugcacuccagccuuggugucaaagugagacccugucucaaaaagaaaucaaaacuauguguguggcaugauaccaguuuuguuaaauaaauccuaguauaucuaauuggccggaaauacacuaacuuuaauagcaguuaaauggauaaugggguuauggauacuaauuuucaaaaacuguuaagagcauauguaacuuaaaaaaauugaaauuuaggccgggcgcgguggcucgugccuguaaucccagcacuuugggaggccaagucgggcggaucacgaggucaggagauggagaccauccuggcuaacacggugaggccucaucucuacuaaaaaaauuacaaaaaauuagccggacaggguggugggugccuguagucccagcugcucgggagacugaggaaggagaauggcgugaaccugggaggcggagcuugcagugagccgagaucacaccacugcacuccagccugggugacaguacgagacucugucucaaaaaaaaaaaaaaaauuacguacauguguuuuaaagagagaaguuauuaaaaacggaaacagaacuucuuuuuauaggcuuauauacacaugcagucucuggaauucuguuuaaagcaagcuugucuuacuugcccaugguugugugcagcccaggauggcuuugaauguggcccaacacaaauuuguaaaguuucuuaaaacauuaugaguuuuuuuugcaauuuuuuuuuuaaagcucaucagcuaucauuaguauuaguguauuuuauguguggcccaagacaauucuucuuccagugugguccagggaagucaaaaauuggacaccccugguuugguuauaugaaccuguauccuacuucccaggagucuggaaccccaguaucuaugcugugaauuagaccaagagugcugagcucggccacugaccagcugugggaccucacuucagcuguuuuauuuccucagugcuuacuucuguaaacugaaauaaaggaaacaucaaccaugugccaggaauacucacaucuuagucuucaaaauuacucuucgggguacuauuguuaccuucauuuuugcugauggaaaaaauugaggcucagagagguuaaguaacucacccaaggucacagagcaagauacagauggagcugggauuugagcuugggccuauccauguccuuuuuuuuuuuuuuuuuuugagacagagucucgcucugucacccaggcuggagugcaguggcgcgaucucggcucacugcaagcuccgccuccuggguucaccccauucuccugccucagccucccgaguagcugggacuacaggcgcccgccaccacgccuggauaauuuuuuuuuguauuuuuuaguagagacgggguuucacuguguuagccaggauggucuugaucuccugaccucgugauccgcccgccucggccucccaaagugcugggauuacaggcgugagccaccgugcccggccuauccauguccuuuuuacaguuuccauuggauaaguugauccccuccaucccuccaucucugguguuccaaggucccuugagguagcagagaaaacgagauuccauaguaaucuccaucucuucucucugggucuccaggacuucagcaccuccauuccuaagcaggaaaaacuuuugagcuuggcuggagacagccuuuucuggagugaggcagacgugguccaggcaaccgaugacuucaaucaaaaccgcaaaaucagccaggggaccuuugcugacgucuacagagggcacaggcacgggaagccauucgucuucaagaagcucagagaggugagcacuucuugguuucuaguggggguggaggcugcagggguggggcgggaucuucauguucugaugucuuucucuacagacagccuguucaaguccaggaucaaucgaaagauucuuccaggcagaguugcagauuugucuuagguaagccuccccuuuguuuaguaauaaugauagcuaaccuuuauauagugcuuccugugugcccagucauguuuuaagcacucuauuauauauaaacucauuuaguccuuacaagaacccuauaaauguagcuacuauuaucacauuauuuuacagauggguaaauugaggcacagagggguuaaaugucucauccaaggucacacagcuaaugaguggcagagccaggauuuggaucuaccugguuuggcuccagaguccauucuucuccuguguagcaauucuauguguagauuagaauuauaaaggaaacuuggcuuacuccaacuccuuccuuccacaugggaauaaaucuucucuccuuuuuuuuuuucuuuucuuuucuuuuuuuguuuuuugagacagagucuugcucugucucccaggcuggagugcaguggcgugaucucggcucacugcaaucucugccuaccagguucaggugauucucgugccuuagccucccgaguagcugggauuacaggcgugcgccaccaggcccggcuaauuuucauauuuuuaguagagacgggguuuugacauguuggccaggauggucucaaauuccugaccucaagugaucuuucugcuuuggcuuccuaaagugcugggauuacaggcgugagccaccgugccugacuuuuuuuucuuuuuuaagagcuagggucuugcucuauugcccaggcuggaauggccuuggaaugauuguagaucacugcagcuuugaacucaugggcuggugauccucccaccucagccucugagaagcugggacuacaggugugcgcccagcucauuuuuugcuuuuuuuuuuuuuuuuuuuuguagagauagggucuugcuauguugaccaggcugguguugagcucccgggcucaagugauccuccugccuugaccucccaagauguugggauuauaggugugagccacugugcccugccaugugugugcuuuuuuuuuuuuuaauuauuuuucaucugaaacacuugugccuuauauuguaggguauuuuaagaaauaaagaaaauugaguaucuguucauucuguaaccaguguuaaaaaauaaagaaaauugaccagguauggugguuuaugccuguaauccuagaacuuugaugcugaggcaagaggauuccuugagccaaggaguuugagaccagcuugggcaacauagcgagacccugucucaacugaaaaaaauauauauacaaaaacuuuuuuuggcugggcaugguggcucgcaccuauaaucccagcacuuugggaggcugaggcgaguggaucacuuaaguccaggaguucaagaucagcugggcaacauggcaaaaccccgucucuacaaaaaauacaaaaauuagcuggguguggugguguaugccugcagucccagcuacucaggaggcugaugggaggaucacuugagcccaggaggcagaaguugcagugagccgagaucaugacacuacacuccagccggggcaacaaagugagucucugucucaaaaauaaauaaaggccaggcaugguggcucacaccuguaaugccagcacuuugggaggccgaggugggcagaucaguugaggucaggaguuugagaccagccuggccaacauggcgaaaccucaucucuacuaaaaaaaauucauacaaaaaucagccugguguguuggcaugcaccuguagucccagcuacucaggaggcugaggcaugagaaucacuugagcccagaaaguggagguugcagugagcccagaucgcaccacugcacuccagccugggcaauagagugagacucugucucaaaaaaaaaaaaaaaaaaaaauuaauuaauuaauuaaaaaguaaaacaaauuuaaaaaggaauaaagaaaauuauaaauaagaaaauagaaacuuuuucacagcaccuauaaauaagcacuacuguuuuaauauuuugauauauuuucauuuuuaauuguuaaaacuuuuuuuguagagacacgaucucacuauguugcccagguugguuuugaacucccuggcucaagugauccuccugcuuuggccuccaaaaguguugggauuuuagaugugagccacugugcugggcccauauuuugauauguuuucuuuaaugcuuucucuauucauacauguauaugaauacucacauguguacacacacacacacacacacacagauacacacacacacauacaucuaauaaaaacuggaaguaugauucccuuuccacuuuggcuuagugcuuucauggagucggcagucacuccuucauucauugauucagaaaauguggguaguuaagcccuuuucuaggcucuagggaguguacgccagaagcauacagagccccugccuuggggagguuuaugguccaguggggagacugacauguaaauaacucuaauaaguaugcaaaagcgaguaauaggauggcuugcgggaagcagaggagggcggagagauaaggcaggaggccauuuacagcagucuuggggaggcugaaucagagccugacccaauccaagugacccaaggcagaggagaggggaaugaagggacauuuuaaaaguuauuuguggcagugaauggugacugauuugauacgggagauaagaagguuucuaggaaacuggguggguggugaugugccuuucugggauaauaaauaugggugaagaagcagguuugggacuuguugaggcuaggaugauguugaccugagcaucaggaugcaaauugacauucaggucuggagcuuaggauggggcuggagauaagagauuugggaauauuccuuauagcaaugggagguuccuggaggagcaacauacaaaacaagaugaggaguccagcuggcagaaagaggaaggcaaaggaggagggucuuagugaaaagggccaggaaagaguggucagagagguaggaggaaagucaggagggaauggugacugagaaccagcagaagaggauuucaggaaagaaccccaguccuagagucaggcaggugugggaucugguccuggcuuuacugcuuucuaguuugugaccuugggcaagucccuuaaccucucagucuccguuucuggagauggggcaguugagaugucauguguugcagagcaguaaagcaggaugaggaccaccauacucguugaaggcagacaguuuucaucuuuccacccuggggccaggcccuuaggggucagaguaugugguaccugggagguuauugguggcguuggaggaggagagggcagaagaggggugggacaugaggaaguagaucauucuuuccgucugacuccucacaccugcacugacgcccgauuccagaugcugccaccccaaugucuuaccugugcugggcuucugugcugcaagacaguuucacagcuucaucuaccccuacauggcaaaugguucccuacaggacagacugcagggucagguaagggacugggucauggucagagaaugggaccaggcugcacccagccauggggucaaggguuaaggacuuacagaaguucagaggggagaggggccaucuaggugagaccagggagacuucaaggagagaaguggggccaggauacauaagaucugguuaagugcucacuuuggcagcacauauaccaaaauuggaacgauacagagaagaucagcauggccucugaaugaggaugacaaaauaugaaaaagaaaaagaaaagcucaaaaagaucugauuaaacaucuucaggaaaaaucuauaaaaaauuauuugacgagaagcauuucauucaaaucaagagcaggacaaagguaucucauagaacuaacuucguucgucaugguucuggagguguuagccaaugcaguaggacaagaaaaagaauuaagagguaaagaguauggaaaaguggaggugaauuuuuauuauaaaauguucuucuaauauauaccuauuugcuuguguguuuauggaaugucucuggaaagauacacaagaaacugguuuacuggcugcugcuagggagcagaacuaggugauuggggccuaggauaagaagcaaacuuacuauuagaguauuauaucaugugaagguaauccuuaauaaaaauuacaguguuuuaaaacaggucuucugcuuaucuuauccucaaauagaggggaaagaguuauuccauaacagaauuauugcuucccauggcagggacaagacaaagcaguuacucacggcauacuaaugaucuuuagcuuuucugggcacucacuguaugcagguugcugugauaaggguuuuacguaggucaucaccuccaggccgugccacaaccaaagcaauuucuucccucauuuuucaaaagaggaaucucugacacauagagacaaagugacuugcccaaaggaacauagaggacaaaugucaggccagagcuuacauuggguucgucuggcucuagguuucagaguuuuugagaagaaauuagcaggggcuguccaggccaguucuuagaggaugugggaccuacaccagggcuucaaaaauaggugaugaggcugggcacaguggcucacgccuguaaucccaguacauugggaagccgagguggguggaucacuugaggucaggaguuugacaccagccugaccaauauggugaaacccugucucuacuaaaaauauaagaauuagccaggcgugguggcgugugccuguaguaccagcuacugaggaggcugagacaggagaaucacuugaacccgggaggcagagguugcggugagccgagauugcaccacugcacuccagccugggcgacaaagugagacuccgucucaaaaaaaaaaaaaaaaaaaaaaccaaaacggugaugauuuagccugggagagucagucuuagaacaacagugggagcaaaugagaggcuuuagcccaucccacaauccccaucagcccuggugaaguuuccccuaauacagauaaaaucagcguaaggcccaggugcuuggcuugcaaacacaagcucccuagcuccucucccauccagcuucuuuuagagagaaauuccagagcagccucuguaauggacaugauaaaaauaacugcugauugagcaccuacuguguggcaggugcuaugcuagggguauaccauauacucccuugaauccuuacagcaacccuaaaauauagggauuaacauuuccauuuuauacccaaggaaacugaggcucagagauguuaagugucuuuuuccaaaauuauacagcuaaugcaugucugaacugggaguuacaccuagaucugucugaugucaaaacccauaguacagggucaggcacauggcucaugccuguaauuccagcacuuugggagagcgagguggacggaucgcuugagcccaggaguucgagaccagccuggccaacauggcaaaacccugucuccacgaaaaauacaaaaauuaguugagagugguggcacgugccugugaucccagcuauucgggagucugaggcgggagagucacuucagccugggauuuuaaggcuacagugagcuaugaugcugcacuccagucugggugacagagcaagaccugucucaaaaccagcaaacacaaaacaaugaaaaaacucacaguaucaugcugagcccugugacagaggacaugaagggugggaggaggaucaggagccugggacccugccaucaggacuucguuuuuuuguuuuuguuuuuguuuuuuuuugagauggagucucgcucugucacccaggcugcagugcaguggugcaaucucggcuuacugcaagcucugccuccuggguucacgccauucuccugccucagccucccaaauagcugggacuacaggcagccgccaccaggaccggcuaauuuuuuguauuuuuaguagagaugggguuucaccguguuagccaggauggucucgaucuccugaacuagugaucugccugccugggccucccagugugcugggauuacaggugugagccaccgcaccuggcugccaucaggacuuuaaaaagguacauugugacuauuuguccuccugcuuuucuuucucuuaggguggcucggacccccuccccuggccccagcgugucagcaucugcucagggcugcucugugccgucgaguaccugcauggucuggagaucauccacagcaacgucaagaggugagagaggugggcuggacccugcuggggccugggcugcaaggguggaacuggugccuauuccuggcucaccucccgcuccgccacucaccccuguccucuuuguuuuucucuuccuaccuccucuccucugcccuccccuggaugucuuuuucucuguuaugcccucaaaaaugaguguuuccgggcugugcuccaaguccaauugcucucaggaugaauugccuaccugucacauuugucuuucugagcugcuguuuucccaacaagcccuccacaccuugcugcgucgcacuguccacucagcagcuggccuggaccucauccucgaacuuugggccaugucugccaacccccugggauuuugagcuccucguucagugucuuuucugagaccuguccccuucuuguguagcuguugguguuagcaucuugucuggaaggcuccugcagguuaggccugcaccccugcaugucagugccaugcacaugagagggagagguccccaucuggagacgguuaggauagggagggauuccgaagauaccagaauaucuggcagaacuggcuccagagacacagaacucguauuuccccaaaguucucuuuccauuugacuuguggaaguccuuuccucuuuucucucccccaauuuuuuuuuuguuuuuugagacggaguuucacgcuugucacccaggcugaaaugcaguggugcgaucucagcucacugcaaccuccaccucccugguucaagcgauucuccugccuuagccuccugaguagcugggauuacaggugcucgccaccacacccagcuaauuuuuguauuuuuaguagauaggcuuucaccauguuggccaggcuagugucgaacuccugaccucaggugauccacccgccuuggucuccuauagugcugggauuacaggugagagccaccaccccggcucucuccccuaauuuuuauuugauugcaucaauaauucuaauagcaggcaaggaaaugaaagggugagagaggucaccacuaaccuaccccaugacucaucagcuggccucuagguuuuguuucuuuuuucacuuccugccuauacaaauccuuaguccugagguagcaccuggguaccaauucacauccuguuuuuuaccccuucauuuaaacauaguaaacauuucgcuacauuguauaccgucauguuuuuuagugucuuagucuucccgugaaggaauuugcccauaauuuacuuaaccacuccuggcacacacacccgugcauuugcgggcgugcacacacacacacgcuaaaaaaguuuuuuuuuuggccgggcgcgguggcucacgccuguaaucccagcacuuuggguggccaaggcgggcagaucacgaggucaagagaucgagaccauccuggcuaacacggugaaaccucgucucuacuaaaaauaccaaaaaaaaaaauuuuuuuuuuuuuuuuuuuuuuugagauggagucgcgcucuguggcccaggcuggagugcaguggcacaaucucuguucacugcaagcuccgccucccagguucacgccauucuccugccucagccuccagaguagcugggacuacaggcgccugccaccaugcccggcuaacuuuuuguauuuuuaguagagauaggguuucacuguguuagccaugauggucucgaucuccugaccucgugauccacccaccuuggccucccaaagugcugggauuacaggugugagccaccgcgccuggccaaaaaaaauuuuuuuuugagacagggccuugcucuuuugcccaggcuggaguacaguggcgcaaucucagcucaccgcagcuucccaccuuagccucccaaguagcugggaccacaggcacgcaccaccaugccgugcugaauuuguuuguuuuaguagagaugaggucuugccaugcugcccaugcuggucucaaacuccugggcucaggugauccuccugucucggccucacaaaguguugggauuacaggcaugagucacugcaccuggccugcacuauauaucuguacacauguggcuuagcuuuuucccauuuuggaguauguucucaguguuugcuccuggggguuagaugacuagaucaaaugauuuuuuuugagacaguguaccacucuguugcccaggcuggagugcaccucugcuuccggguucaagcaauucuccugccucagccuccugaguagcugggacuacaggcgcacaccaccacggcugguuaauuuuuguauuuuuaguagagauggaguuucggcaugcuggccaggcuggucuugaacuccugaccucaggugaucugcccaucucggccucccaaagugcugggauuacaggcgugagccacugugcccggccaagagggaauuuuuuuuucuuucuuuuuuuacaugaucugggcagguuuagucacaaaggaugcuggccacuuagaccugagucagccaggccagagcuggggguuggaacaguuguggaagagacugagucugcacagccuguaggcguggcaagcugaggcugaucaggguuggcaucuguggggaucagggaggcugcacuuuggccacauuccuggggcagcaagacuaagucugaacuccaucuccauuugcuggagggagugugcuccugaugcccucucuuccccagucagggcuggcucagaagcuccaugcugagggucuuuagagaccucaacuugcaggaggugagguugcuauauugucuccccaaagggucuccauggcaacuuguuguuauccagcucaaaaugagaagguucccucuccuuucauuuccacagcucuaaugucuugcuggaccaaaaucucacccccaaacuugcucacccaauggcucaucuguguccugucaacaaaaggucaaaauacaccaugaugaagacucaccugcuccggacgucagccgcguaucugccagaggauuucauccggguggggcagcugacaaagcgaguggacaucuucagcuguggaauaguaagaguguccugcucugcguagaguggggcccaccuugauuuguccuucccacggcuccuuuguaaucacaggauacgguagaggcacacagacagguuccaucaaaguacaacaggggcugacaaacuguggcccacaggccacuuuggccuguggcguauuuuguauggucugugagcuaaggguaguuuuacauuuauaaaggauuauauuuuuaaacacaaagaauaugugauagagacugaacaugcuccccaaaagcucacauauuuacuguguggcguguuacagaagaaauuugccagcccuugaaggaaaaccacucaugaguguccagguucuaguaggcuccagauauccucuccugacuuccguaauucccauccagccauccacuuguccauccaguugucuauuuguccuuauuuguucaucgcuguccgaucauccaucuacccuuuagcugcccauccauucagcgaccacugacccacccagcaucccacccuaccaccaccaccauccuugucugccauuaugucgugccaggcacuaggaauaugaauguaacaaaaacacagucccuccccucaggagcucauggucugcauguagcagucuccaaaguauauuucuguagaacuccaguuccuucggaccucuaggauugauguguuaaaaggguuugugcccugacaggcuuggaaauauugcauuaggcaaagucaagcagguuucuuuaccacaagauuaauucaagcugguugaaugguagugagccuuuaaucugguacuugugaauucaccagagagggguaugcaguguuucccaagcucauuugacuauggaaccuuguguucucagaauaucuguccuugucaguguuccauggaacccagucugggaaaugcuggcugagaagaguaacagucagguuggcuucagccaagugcauacagcugccccuugggccucacccucuuuucuucucuagccuugaacucuguacuuccucucucugaccacagucuccugucugucuaccucugcuaccagaaccguggcccugagucaccucugcccucagccagaaccccagauucugcaccuccgugucucccagcugguuccucugccucccucagccccacugcaaguuguucagugaagcucagcagggcuaguccaggcuccuucuccuuuaagaaccagggggaugggcagggagugguggcacaugccuaaaaucucaguacuuugggaggccgaugugggcagaucaccugaggucaggaguucaagaccaaccuggccaacauggugaaaccccggcucuacuaaaaauacaaaaauuagcugagugugguggcaugugccuguaaucgcagcuaccugggaggcugagucaggagaaucacuugaaccugggaggcagagguugcaguaagccgagaucgcgccauugcacuccagccugggcaacagagcaagauucugucucaaaaaaaaaaaaaaagaaaaaaaagaaccagggggauagaaccccuaggcccggcucaguuacuuucagcugugugacuuacaccuagcacuucugucucugggccucaguuaagccuucuguaagauggggcuaacgauacacauggagaugaaugggauaauguauauaagcaggugagcauggcacccugcacccugcaccuaccaagaauauuaugaugacugugguuauuguuauucccaccuuuacacccuccuucugauaucuguuuacucuugaccuucuaacugguguguuagcgucacagaugacuuccucauccauccauucacccucccaccuauccaucuauucauccacccaugcacccacccucccacccacauacccauccauccauccauccauccauccauccauccauccauccauccauccaucuaccacccauccauccauucauucauugaaugccuccuggcuccugccacccuuuugcucagcccugccucugguugacugauaacgcuuuugaacuuugauuccuccuguggggaucacagugcauugcucaguguuuuuuggugagugcucagugaccucuauaaaggacuuggcucagagccugcucugugaaaggggcacaggaagucuuuguuuauucauuuccccuuguucugucccuuccuggcagggaccugucaggagucccuuuucaauuggcuccugucccacuugcagcagugaugcccucugcugcccuuuucuggucacugccagucuguuauuaauccugggugguuuaaaaccuuuauccuuuccuuccuccaggcuuggagggauucuuggcuauaaaugugacccuauucugacuugcuuugagagaugcugugggagagagguuccacacuaaguguggggucuucacaccuuuaauauucacaacugcuaguccccauuuaacagaugaggacacugaggcucagguuuuaguuacuugccuaaagaucaccugagcauauaaggaacagagucagaauuugaacucaggccugacuguagagcccuuagccaucauagcauugucucuacugagaaacccuguucaaagcaguuuccuguuuaugaagacauauaucaugguuugccaauuuuguggugacuuacacguauacaggguugugcuccuucugcgaguggaugcgcuaaugaauaaauaauguuaguaaaggccugugagugaaacaugcuauggaugcugcaagauuugucuagaauagauaccugccugcaugcagagucuuuccuucccugagauucacagagcaaugccugcuugccauagcugaagguuuuuugguguuuuuuuuuuuuuuugagacggagucuugcucugucgcccaggcuggagugcaguggugcgaucucaguucacugcaagauccaccucccagguucacgccauucuccugccucagccucccaagcaccugggacuacaggcacccgccaccgcgccuggcucauuuuuuuguaucuuuaguagagacgggguuucgcuguguuagccaggauggucucgaucuccugaccacgugauccgcccaccucagccucccaaagugcugggauuacaggcaugauccaccgugcccagccagcugaaggauuuuuaaaugaaacaaucuuuaaaaaauaguguauauauacguguguguguaucuauauuuaucuauaccuauauauaucuuaugguaauacauauaaacacacacacacaugaauuuuugaaaaccaucuucucugccuggcuaucaauuaauuacaaccuuccacuggcagcuugguggcaucuuuaauuggaggagguguuuagugauauucccauguuccagauuuugggcaggugugucugcuggcaauggcagagcugcaccuggagcucagaacugagaagagaagacagaaucugcugccuggcugugugcacgagcgucugaaccaugcuaacucacguucuguucucuccagguguuggccgagguccucacgggcaucccugcaauggauaacaaccgaagcccgguuuaccugguaagggaacuugucacaucuggcugggagguauauuugggccucacagcucuguagagagggcaacgaccucaauucuagcuaguuuuacacaugcaaaugaggcccgguacaagguugcauuugcauccccacaaagcagcuuuaaccucccauccccaccugccagccaaccauugcuuuuucaugauaauagcaucuggggcuuggugcgguggcucaugccugugaucacagccuuugggagacugauguggguggaucauuugagaccaggaguucaagaccagccuggccaacauggugaaacccugucucuauuaaaaaaaaagaaaagaaaaaacuuacaaaaaacccccaacauuauccagguguggucgcaugugccuguaaucccagcuacucgggaggcugaggcaggagaaucacuugaaccugggaggcagagguugcagugaaccaagauuaugccacugcacuccagccugggugacagagcgagacuccaucucaaaaaaaaaaaaaaaaaaaagauuuuggaauguuuauagaaagcacuuguauaaaagagaaagcacuucucuauauaucaggcaauucauuagggauuuuccucaaauugauaaaaguuaauuucagcccuuuuaaacaaguuucuauaauaaaaacaauuuccauuuuguaggccaaagaucugauauacacagucauuuaaaaaauauaacaaccuggcugggugugguggcucacaccucuaaucccagcacuuuggaggaggccaaggcgggcggaucacuugaggcugggaguucgagaccagccugggcaacauggcgaaacccugucucuacuaaaaauacaaaaauuagccaagcguaguggcacacaccuguaaucccagcuacuugggaggcugaggcaggagaaucgcuugaacccaggagacagagguugcggugagccaagauugcaccacugcacuccagccugggugacagagugagacccucucucaaaaaagaauaaaaauauaacaaccuagccugacuuuguguuaaauacuuuccauacauuaucuaccuaaaucaucucaauuuuuccaugauagagucauuauauucaucugcagaugaggaaagcuggcucugaguuuggccuaggaucucaguuggaauuaccaagugucagagcuggaauucugagucagaucucccugagccgacaucaugaguuuuuuuuuuguuuuuguuuuugagacggagucuugcucugucgcccaggcugcagugcaguggugcaaucucggcucacuacaagcuccaccucccggguucaugccauucuucugccucagccucccgagcagcugggacuacaggcgcccaccaccacaccuggcuaauuuuuuuguauuuuuaguagagaugggguuucacuguguuagccaggauggucucaaucuccugaccucgugauccgcccgccucggccucccaaagugcugggauuacaggaucuugaguucuuaaccacagcagucuccugcuuguuucuugugacaguccaaccauacgaauucaguauuaucauucccauuuacagcugagaaaacugagggcaagcugaagugacuugucucacgccccucagugagaccagugguggaagugggguuuaaauugaacccaaggcuuuugcagaguuucaaaucucauccaaacucuagucuuccucaucaguuugagagggggcaccuuuuccuacuggguauugaggccauuggaacagacagauuauuauuuuauuuauuuauuuauuucuggugacugggccccagaagcauccccugggcucugggguagggaggcugaaggccucgcuacuccaugcagaaagucacgacauguuccuuugaugaacucugugaguuccaccccuuuugggcagucaaucccauaugcugcagagaggucugucugggcagcucagaugugguuuggggcuguuugggggcaguuucucaucuccugacuauuuucuugagauggauuucccagcaguccucuggggcuccccggacaagugucacaguggaaggaggcuuuugaggcacugacaggaaguugucuagaauuauuuuuuugcuaaugauuucuaaaaauguggaaaauaacaauuuuuuaaaauguaguuucuuucucuuauucuagacucuuguauggucucuuaucauguucuguugugguaggugcaauccaaugguuaaucaagauuugagucagggaggaaagcuugcugauuuccuguggcccaggguaggaggaagcaggccuccuccaggcuugggaaaguguuaguugccacaguguuuccugagggcauuuggugguuuccaccuaaauugaaaauaugaguacccucugacacggcaguuccauuugugccuagagaaacaugcacacaugugaggagaggcagaugaacaaggauauuuguaguggcauuuuuuuuuuuuucgagacagagucucgcucuguugcccaggcuggagugcagugggcgugaucuuggcucacugcaaccuccaccccccggguucaagagauucuccugccucagccuccugaguagcugggacuacaggugcgcaucaccacacccggcuaauuuuuguauuuuuuuuaguagugacaggguuuugccauguuggccaggcuggucuugaacuccugacaucacucaggugaucugcccaccuugaccucccaaaguguugggauuacaggagugagccacugcgccuggccaaauuuaauuuaauuugauuuagagauagggaggggucuugcccugucacccaggccagagugcaguggcaugauuguagcucacugcagccucgaaugccugggcucaagcgaucuucccaucuuggccucccaaauugugaggauuacaggugugagccauggcgcccagccuguaugaguuuugacaaauguauacagucauguaaccaccaccacaaucaagauacggaauauuuuugucaccccagaaaauucccuccacuuacagguccuggcaauuacucaucuaauuucuguccacauagcucuaucuucuuuagagggucauaucaaugggcccauggcagaugcacccauuuguuucugucccccuucauguagcauggugcuuagauucauccauguuguugacgugucaguaauucauuccuuuucauugcugaagaguauuccauuguauggauagaugacuguuuauccauuuaccaguugcuggacauuuggguuauuuccagguuuuggcaauucugaauaaagccaacacaaacauucuuauuuuaaaaaaaugaaaaagaggccgggcacaguggcucacggcuguaaucgcggcacuuugggaggcugagguggguggaucacuugaguucaggaguucaagaccagccugggcaacauggugaaaccccgucucuacuaaaaacacaaaauuagcccugugugguggcgagugccuguaaucccagcuacucaggaggcugaagcaggagaaucgcuugaaccugggaggcagaguacagugagucgagauugugccacagcacuccagccugggcaacagagugagacucugucucaaaaaaauaaaaaaguaaauugaaaaagacauguauguucugacagggacauaucuccaagugaacaaagcaaauucagaauaguauauaguaugaucacauuuuugcuaaaaauagauggaugaaugaaugaaaacauuguaucacauauuuucuucucuauaaauugaggauaauaguaguacccccccccaccgacaagguauguuuguuuguuaucauuuuuggagauagggucuccuaucuccuaucuucuuugucacgaaggcuggaggagugcaguggcaugaucauagcucacugucaccucgaacuccugggcucaagggauccucccaccuuagccucccggguagcugggauuauaggcaugagccacugugccuggcaucugacagguuuauugaagguuaaauaauaugugagaugccuaaaauaguaacuagaacauaauaaacaauauauguuaacuauuaguauuaucauuauuauuugagauaaggucucugccacccuggcuaguauguaguggugcaaucauggcucacuguaaccuuguaccccuggccucaagugauccccugcuuuagccucccaaguaauugggaccacaggcacgugccgccacuccuagcuaauuuuuauuuuuauuuuauuuauuuauuuuuauuuugagacagagucuugcucugucgcccaggcuggaguacaguggugcaaucuccgcucacugcagccucugccuccuggcuucaauugauucuccugccucagucucccaaguagcugggauuacaggcauggaccaacaugcccagcuaauuuuuguauuuuuaauagagacaggguuucaccauguuggccaggcuggucuugaacuccugaccucaagugauccaccugccucggcggccucccaaguaccugggaccacaggcaugugcccucacgcccagcuaauuuuuaauuuguuauuuguagagauggggucuuguuacguugcccaggcugauauugcuauuauuuuaacagcuuuuaggauacuguuauaauuauuauauaaguaaauauaaaaccaaaauaauuauagcuguauagcagaaaauaauauaauccaaacuauuagcaggaguuaccuuuggagaguagaaaugaaagguaaacuuuuguccccaaauuuuaaccacuuauguuuaauuuuaauuuuuuuuugaaauggagucucccucuguggcccaggcuggaguacaguggugugcuuuuggcuuaccacaaccucugucucccagguucaagcaauucuccugccucagcuucccauguagcugggaucacaggugugugccaccauggcccagauaauuuuuguauuuuuaauagagaugggguuuugccauguugcccaggcuggucucgaacuccugagcccaagugauccuccugccuuggccucccaaaguguugggauuacaggugugagccaccgugcccagccaaaaguugcuuuuuaagggugguuuguuugaaacuagaccccaaaaauguccauauauuacuuugguuauguuuguuuuuuucauuuuuaaaaaaaaauuuuauguggagaugggaugucacuuuguugcccaggcgaguuucgagcuccugggcuuaagcauucgccugccucaaccucccaaagugcugacauuacaggugugaaccaccacgcccgggcaugguuauguuucuuaagacucuuauucuuggccgggcacgguggcucaagccuguaaucccagcacuuugggaggcugaggcaggcggaucacaaggucaggagaucgagaccauccuggcuaacauggugaaaccccgucucuacuaaaaauacaaaaaaauuagccgggcaugguggcgggugccuguagucccagcuacucgggaggcugaggcaggagaauggcaugaacccaggaggcggagcuugcagugagccgagaucgugccacugcacuacagccugggcgacagagcgagacuccgucucaacaacaacaacaaaaagacucuuauucucucacaaccucucccgcaaugcccuuuuucauuuuggaugucguuggauuuuugcauagacuaggucauuugcccuauguagacagacugucucacauucuggguuuugcucauuacauccuguggucuccuucccuuguuucucuauuccucauauuuccuauauuuggcaguuagcacuugugacuuguuuagagucauggucauugccuuugucaagaacacuuccuggaggcgcugugagccucccauugcuucacuacacggggcguagccuguuguccuacuuuuagugcuaagaccgaucaguguguuaagguuuuagugcuaagauugaucagugguuucagguggagcugccgacuccuccauggugaaguucccucgacauccuuucaucgcguguucucagucccccaaccccuguuuaaacacuaggugucuucuguaguuuuuuugauuaucgucauagucuuugcaucaagauacauagcaaugauggcagguuuccauuuggggcaaauugugagacccugccucuagaaaagaagaaaauaauacacuucuacuguucuugauuaucagcuuuaaacacuaguacacuuuaaaaaaaaaauaaacauuuaggcugggugcaguggcucacaccuauaaucugagcacuuugagaugccaagacaggaggauuaguugagcccaggaguucaagaccagccugggcaacauaaugagacuccaucucuacaaaaaauuuaaaaauuagccaaguacaguagcaugugccuauagucccagcuacuugggaggcugaggugggaggaucgauugaaucgaggagguugagacuguagugagcugugauuauaucacugugcccggccuauuuuuauuuuuauuucuuauuuauauuuugagacggagucucacucugucgcccaggcuggaaugcaguggcgcaaucuuggcucacugaagccucucccuccccaguucaagcaauucuccuaccucagccucccgaguaccugggacuauaggcacgcaccgccaugcccggcuaauuuuuuguauuuuuuaguagcgacgagguuucaccgugucagccaggcuggucucgaacuccugaccucgagugaucugccagucucggccucgcaaagugcugggauuacaggcaugaggcaccgcaccuggccuacaauacauguuuuuacaauauuuaguauguuuguaacauucauauaugcuaaucauauauaccauauuacucaugaaauauacaauauaauuuauauuaaauaugcuuacauauuuguauaaaauuauuauauagcauauguucuauuguaugcauaguucagauugcugcauuuuaugugguacaaaauauaaaauauauguaaauacaaaauguauaagaaguauagacauaauauuuucuuuauaguggcucuccuguuauguauauaggucagaauccuacauuugaaauguuuguaucauaagagauuguccauguaguuaauaagauuaaauuauuaagugcuuaucauguaguaagugccauauaaaugguagcuauuauuacuauuaguuauuaucacuaaaagacuauugaauguuccgugucagaugucacucucugugcuuuaggugcacuguuucauugaaugguuguguuaguccuagguguagguauuuuauuauuuuuuugagacagaaucucgcugucaccuaggcuggagugcaguggcgugaucucagcucauugcagccuccgccccccaccucccccaccauagguucaagcaauuccucugccucagccgcccuaguagcugugauuacaggcgugcacuaccaagcccagcuaauuuuuauauuucuaguagagacgggguuucgcccuguuggccaggcuggcucgaacuccugaccucaagugauccacucgcuucugccucccaaagugcuaagauuacaggcuugagccacugcgcccggcccugguguagguauuuuuguuguucccauuuuccugaugaaccaaccgaggccuagaaaaauuaaggccccacguuuguggcaugaguucacuauggagugcccugugcauguaggaaaucgaauccuucuccauuucuuggggguuuuacuucuuucuggaauccuugcauuuauucuuacgauguccggucgguuuucugagcauuuuuugcagcucuggaggugaguggggcgcgugcguuggcucucgcagcucugcagcucacgcaagggcguuucuacccuucuucccacagaaggacuuacuccucagugauauuccaagcagcaccgccucgcucugcuccaggaagacgggcguggagaacgugauggcaaaggagaucugccagaaguaccuggagaagggcgcagggaggcuuccggaggacugcgccgaggcccuggccacggcugccugccugugccugcggaggcguaacaccagccugcaggaggugagccucgcccgcagcggccucgcugccugggccacgcguggguccaccucaucggggacggccccuucgcagaggccuggugcacaaaccaggguugugcuugcuugcaagccgcagaaccuccuagagcucccaucagccaaagggcgguguagggauggauagugcggagcccgaggacggguauugcagggccucagggcgcaggaccaaacccguggauguuaacugaacucgaugaacucucugugaaucggcuuuauucccccuucucuauaggccccuuccccuuuccucuguguucucuggagggaacggcucugcccgcaguuuauaacagagagaugagccuccacccugagucccaccacagagggagaaccugauuggcugaacuugggucaguuguuuaccgcuuggccaaucaggcaugguggggcgguccagcaugcaaaccgggcugcccagggcuccaucccuggauggugucggcgccaggucccaaagaaagggagugugcucagcccaugcacuaggcggacguccuagaaagcagccacuacacgggguaagagauuuuuuuggacaugagaaguagccguggcuuccaugguaaaagguaaucaagagacuacugcuugaucuuuuuuuuuuuucuuuuugagacagagucuccuucugucgcccaggcuggagugcaguggugcuaucuccaaccuucgccucccggguucaaguaauucucuugccucagccucccgaguaucuugaauuacaggcaucagccgcucuguccggccuugcuuggucuuucuaaggacaaacucuccacugccugggaggacccuuagaaaucaucuagcagagugauuuucaagugguguugggcacagaggggcuccuugagaauacucaggaauugcuguuggcagcaagagggguugggggaggugcaggcccccaccugugacucggaccagacacccacuuuugacuucucucaguuacuguauuggguucucuggaaaggguuugguagcuggaaaaaaucuucaauaaccacugcuguagcccaagccucccauuuuacagaagggcaagugaagggccacagacgagaagaugaggccacagaacuuguuuuugucagagcucucuggacucccaguucagccuuauguccaucgucuugcgcugucacguggcaggagcuggaggcuucagucuuuguucucagccuuugcuagcacaggugucccccaaguguccaugugccccgauguucagucauucauuccgcaguuguacacuggggccaggggacacaucuguucgggaacaaggcagacccagguccacgcuccuggaacucauggacauugcauaguaauugucuuuguggugagcgccaggacaguguaugaugaggaccccacccuguugaccuuccugaggaagggggguuuaagcacacgaagagcaauccaggcagaaggaacacccugcaaauggccugagcugagagagagcucagcacguucaagggccuggaagaagguccgaagggcuagaacacaacacauggggcacaguggcuuguguugggugugucgaggaaggaguuguccaaugauagaaggcuuuguaggcacaguaaggauuuuugcagagccacuaagguuuuuuuuuuuuuuuuuuuuuuuuuaacagaaucucacucuuucacccaggcuacaguguaguggugcaaucucggcucacugcaaccuccacuuuccagguucaagcaauucuccugccucagccucccgaguagcugagauugcaggugugugccaccacacccagcuaauuuuuguauuuuuaguagagaugggguuucacuauguuggccaagcuggucucgaacuccugaccucaggugauccaccugccuuggccucucaaagugcugggauuaugggccugagccacugugcccagccucacuaagguuuuuaagcagagguaggacauaaucaguuuuauauucuaaaaaguucugucuccuucaaccaauuauucuuucaguaagacuuucauucuuuuauucauuccauuauuuuguucagugugucacuuaaggugcaggugaaacugcuauaacaaggagacugcaaaaugcagugguuuaaauaagauagauguuuauucucuuuaguguaacaguuugaauuuacgcaguccaguguuaauguggcagugccacaguauuggggacccaggcuccuucuauguuguuuguuugcuauccuuaccauguggcuuccaugucagggucuaagauggcugcuguugcucaggccaucacaccugcaauccagccagugaaagaggguuaaaaggaaaagguggacacacucccuuucuuuuaaagauauaaccuggaaaugcaucacuuuuucucacauaauagagagcagaacuuagcuacauggccacgccuagcuccaaggaaaugcggucuuuagauuggcaaauauuuauugggcaucuacugugaagauuuaucucaagaaguaacaugugaccugggccuugaaggaugagacguuugccacguaaaauaaaggggauagggcacuuuagguguaagaagagguaggagauggccuuagcucuuaguacaucacaaccaagcugggaagaugaaagaacagcugggucagggacuggaagauaauaagcaggccuggguuugauggucaccuuugccauuuacuguacuggcuggguggcuuuaggcagggaacuuaacuuuucugaucuuuuaauuuuuuauuuauaaaaauucaugcauuguguaugaaauggauacauuaguggccgggugcgguggcucacgccuguaaucucagcacuuugggaggccgaggcgggcggaucacgaggucaggagaucgagaccaucuuggcuaacauggugaaacccugucucuacuaaaaauacaaaaaauuagccaggcgcgguggcgggcaccuguugucccagcuacucagaaggcugaggcaggagaauggcgugaacccgggaggcagagcuugcagugaaccgagauacgccccugcaguccggccugggcgaaagagcgagacucugucucaaaaaaaaaaaaaaaaaaaagaaagaaagaaauggauacauuaguauacugaauuuuuugcaaggcacugaggagaugagauuuguuauuguuauuacggguauaaggguauguaugugugcucugugugugugugugugugugugugugugugugugugugaagaagaaacauuccuuccuugcuuccgucuaauuuuccuaaccucccuaaccacaaaaaccuuccagggcaacaucuauauuauuugugcuuuuuugauugaaaguguuaggaacuuaaacucuuacacacacacacgugcacgcacacacacacagacauagggagggggaagaauaugaaugagugaauuagcgaaugaaugaacuuagugucucauuuaaccaaacaacagagaggacaggcauugcucugguuucagggaaguuagacccaggaucucaaacaccaaagguacagccauugugucucucugucuguggcucucucuucguugcuugccucugcuuuacucuguguugagcuuucauuuuccccuacuguaaauggguuuucuggguguaguggggcgucugguucuaccacuagagaggaaaggcuggaggucuuuccccaauaagcucuagguggaaaaguuucagggaaggauucugauuggccagcuucgaucacaugcccaaaucuagacuaaucccuauggucagaggagugggguacuaugaucugcccauguugggucacgccgucucaucuaugacagggcgguuggugggcaagcacaggucuuuucaaaggaagggugugguuuuuucagacaaaacaaccagcauuagguucuucagucugcuccccgcccccucucugcugggaggccagauguuagcauuucuauuucagagagaauuccugaugagcucccuucucucucuucucccaaagguguguggcucuguggcugcuguggaagagcggcuccgaggucgggagacguugcucccuuggagugggcuuucugaggguacaggcucuucuuccaacaccccagaggaaacagacgacguugacaauuccagccuugaugccuccuccuccaugaguguggcacccugggcaggggcugccaccccacuucuccccacagagaauggggaaggaaggcugcgggucaucgugggaagggaggcugacuccuccucugaggccuguguuggccuggagccuccccaggaugguaagccggaagucagagugcauuuggaugcucauguguguguccccaacuucagcccaucauuuuuucuuucuguugccuucauucacuccuucauuugguuauucagccauucaccaaccagccaguuuuucacagagaaaccugggaggcauccuugacaccucccucucccugcccuggacuguguccgguuaaucacccaguccuguccauuggccuccaaaaucucucucaccuccaucuacuucucugcguucccccuuugucugagcuccuguccucaggggacugcauagcuucccugaguccuccuccauccuggccccucccucacuagguccuucuccaggagccagccagaguagcuuuuaaaaacacagugccggccaggcgagguggcucacaccuguaaucccagcacuuugggaggccgaggcggguggaucaccugaggucacccuggccagaucaccugagaucgagaccagccuggccaacauggcgaaacccugucucuacuaaaaauacaaaaaaauuagcugggcaugguggcgcgugccuguaaucccagcuacuugggaggcugaggcaagagaauugcuugaacccgggaggcagagguugcagugagccaagauugugccacugcacugcagccugggcgacagaacaagaguccgucucaaaaaaacaaaaaacaaaaaacucaaugcaugucaucccucguucaaaguccucaaggccccauguggucuguuccugucugccucuccucucaacacaaacaccauccucaccagucacuucuaaagauaucuuccaggcugggugcgguggcucaugccuguaaucccagcacuuccagaggcuggggugggcagaucaccugaggucaggaguucaagaccagcuuggccaagauggugaaacccugucucuacuaaaaauacaaaaauuagcuaggcaugguggcgugugccuguagucccagcuacuugggaggcugaggcaugagaaucacuugaacccaagaggcggagguugcagugagccgaggucgugccauuucacuccagcccugagugacagagugagacuccgucucaaaaaaaaaaaaaagaagauacuuucuggcugggcgcaguggcucacgccuguaaucccagcacuuugggaggcugaggcgggcagaucacgaguucaggaguccgagaccagucuggccaauauggugaaaccccaucucucuacuaaaaauacaaaaauuagcugggugugguggcaggcaccuguagucccagcuacuugggaggcuaaggcaggagaauugcuugaacccgggagguggaggcugcagugagccgagauugcaccacugcacuccagccugggugacagaggaaaacugucucagggaaaaaaaaaagguaccuuccauuccugccacucagguccaaggauaccaaguuucuuucugaaauaaaaaauuaggaagccccccccccccccccccgccuuuuuuuuuuuuuguuuugagacaguguuucacucuuguugcccaggcuggaguauaauggugugaucuuggcuuauggcagccuccgccucccggguucaagugauucuccugucucagccucccgaguagcugggauuacaggcaugugccaccaugccuggcuaauuuuguauuuuuaguagagacaggguuucuccauguuggucaggcuggucuugaacucccaaccucaggugauccgcccaccucggccucccaaagugcuaggauuauagguaugagccaccgcacccgaccaggaaggcccuuucaaugcagugucccugucccuuaguaaacaugguucaaugaaugucccaggcucugaccacuccuguuucucuuuuacuccuccugccauggggaggggagaggaagaagaaagacaggaugugagcauuuuuuucacuccacccucccaccccucaacaucauaaauaggaacagggaaacccucuccuuucuggaaggccaggguagguugcagggcuuccugcaaagacagaggagaugaaaaugcucauuacagcugggugcaguggcucauaccuguaauccuaguacuucgggaggacgaggugggcugauugcuugagcccaggaguauaaagaucagccugggcaacauggugaaaaccugucucuacgaaagaugcaaaaauuagccagguguggccagccaggcauggugacucacgccuguaauccuaacacuuugggaggcugaggcgggcggaucacgaggucaggagaucgagaccauccuggcuaagauggugaaaccccgucucuacuaaaaauacaaaaaauuaguugggcgugguggugggcgccuauaaucccagcuacucaggaggcuaagucaggagaauugcuugaacccaggaggcagagguugcagugagccgagauugagccacugcacuccagccugggcaacagagugagacuccaucucaacaaaugauaaauaaauaaauaaauaaauaaaugggcugggugcuguggcucacaggccgggcgugguggcucacgccugucuguaauccuaggacuucgggaggccgaggcggguggguugccugagcucaggaguucaagccuagucugggcaacacggugaaaccccuucucuacuaaaacacaaaaaaauuaacugugugugucguccagccugagcaacagagugagacuccaucucaaaaaaaaaaaaaaaaaaaaaaaaagccaggugugguugugcacgccuguagucccugcuacuccggagacugaggugggaggaucaccugaaccugugaggucaagguugccuugagcugaaauugugccacugcacuccagccugggcaacaaagugagacccugucucgauaaaaaaaaaagaaaaaaaaaaaaagaaaugcucauuacacucagggccugauucagaaaccugauuuaagugacuuuaagaauuauaauaauaguaacuuucauucaagucgcucuuguuugcuuucuguugaacaucaguuacagaaacuucguggcaaauugagaucaaugaggccaaaaggaaacugauggagaauauucugcucuacaaagaggaaaaaguggacagcauugagcucuuuggccccugaugaccggaacacagcugaggacccuuguccucaguuggaaagaugagcaucagaucaagaaaaaggucugaggcagaauccaagaucugccaggaaacacacaacaaaacaucugcuguccugggugggagggaaacuucauuucacuggaaugaguugggagagaaaggcccucagcuuuuagagacacaaaaauccaugaagucucuuccuuucugggcuuuguuagucagagcaggggaucagaggagacugaagcagaaacccugcacacgggcccaggauguggcugauuuugugguuccggggaguaugugaugauaaucacccccagcagauuccauuaccucagcagcucuuguucccccgccacuggcaguucugcaaugccauagcauuuuccagagcuaagaucucuggguuguauuugcugacagccugcaagcuugcaugcucugaaagauuuuuuuuaguuuuuaauuuuuuuguagagauggggucucgcuuuguuggcgcaauccucccaccucagacucccaaagugcuggaauuacaguugggagccacugugccuggccuggaagacuuucaacuugugucucagugcaguucuugacucaccucucugggccucagguucuacaaaugccagacaccuagcgaagagcucugcaggcuuuccacugccuguauuggaaaucuugcaauucacauaauuauucagucacugccugguaccuuuaucuucccaucccacuaauguuaguguuuuuuaauggagcuuuuauucugagaauauguguuugucuguuuguuuguuuuuugagacagagucucacuuugucacccaggcuggagugcaguggcacgaucucagcucacugcaagcucugccucucagguucaagugauucuccugccucagccuccugaguagaugggacuguaggcaccugccacuaugccuggcuaauuuuuguguuuuuaguagagacaggguuucaccauauuggccaggcuggucucgaacuacugaccucgugaucugcccgccuuggccuaucaaaguguugggauuacaggcuugagccaccgcacccggccgagaauauguguuguuauuuaugacuggauuaugaagaaucaggagaaugcauuucaugucugauucugcugcuaauuaagucaaucauuuaauuuuugggaccucaguuucuuuguaaguaaaauaacaccugcuuguucuucaucccugggcuguugggaggaacagaugagacaguggcuauagaagcacuuggaaaaugcacuuguccuguuuuguaaaauaaaaagguauuaaauguguauuucugccauguaccuaaugauuauucagugcguauauaucugaaaagucauguugcaaaucuuucugugaaacagaugcuauuuuaaauucacugggagaaauauccuauuuaaaguaaucuauaguaauuucuuuuuauauaauaaaaauauauuuguaaaguc

SEQ ID NO: 191674 - RNA, 48811 nt, Homo sapiens
ugacuuucucaccaauuacaaaaaggcuuuauuauauuuugccaaauguuaaucgcuuucauuaugucuccaaacauuauuucaccacucauuuuuauaacaagugcagugaagauaugcuuaucgaauauuguacaauacuguuguguucuguaacacucuuucgggaacagcuuagauguagguaacaagagaugccugcguaugaaagugcuucauaaacuguacuguauaaauguaaacuacuaccauuuucagguaaaaucagagaauaaaugucucuuguuggaaguguccucucaggacuccucuaguccaaucuccccagugaguggaugagggaaaagacugacgccagaggcaggaggcucuggauuggagaguuagaggccaacgcaaguauagaaucugcaguccuagcacagggaucuuucuccucccuuguguaauuuaucuuuaaaaacacugauaguuuucuggugcugggagcaccaugcccuuuaaaacuuaugaauuaauggacgauuacaacaaaaagaacuuuuuaccuagcccucaauaaauaguuguuggugaaauuagaaauuugagguugaauuguuaaagaucgucuuggucacuccucucucgugaagaaacccaucgacucagaaucaccuccuacaaccaauaaaaaaaaagaccauuucuuaaaacagaaauguaagaccauucugacaccacagcugacaccacagcuacauuucacaaagggcggucuauauaaugaugauacuguucccaccuuuagaacagaaacaucuggagaaaaugaauguaacaauauaaaccuuacaagcauacaguaucuacuuucaccaggcaaagauuuuaacagcuaagcuugccucugcugugguauucuacuagcacauuucagaaacaggugggcgggaugaaagcuagcauuuuacauuagagcuaggucugugauggcauugcuguaacggggccagcuacugagaagggagaaaugagguugaugagcauuuuaugagaaacuagccuaguggagauaagugggaccaacugaagggaagacgugcuggggcccuggagaccgaccagcaggucugcaggggcaggguggugugaaaagaagacaggacgacaacaaagacauacuggauguugggaggagccaauggcaacguuaaggcucuacacacagagggagggaaugcagaaacacggacacacacuagacaacucggccagaccagagagaaacaagccaagaugacaggaggcgccuugguucaauacagaagcccagaagcaggaacaagucaacagggacaccucuggucucugggaaugagaccugugagaaguccuggccuggccagggggucacaggccaccuguaagagagcaguuucagcugagugauggggacaucacagguaauaaaguggggaauuaaggaauagaggaagucagcauagauuucguguccaauggguucaauggggaaaaggugagagacuuaagagccugccugagaaggcucuguuaccaaggcaaaacuguauucauguauuuucuugggaccacauguuccagauacacuaugauucacagaaucuuugggaugacaugaauuucucugaguuuacccaccugaacuuuaauccuuuucauacauucuggugacuccauuuccuugucagucauaguagaggguuuaaucaaauagcacagcauaaguuccuauugagaaaugaaaaaccacuucuguauccuacaaaauaauaguacaaauuugggugcaucagcaggaaaugcagguggucuccagucccucucacugugcacuccaaguggaaacucacagagcacaucaguuuccuccuggggaaaccauaacugggauuuacguucugacuaaguaccugccguuuaguaaucacugaacauggcaacagauauaagcagauacauugauuauaaacacagcauuaagaauacuaaauauaguaaguccucaaauguccuugauagguucuuggacacggacuuuaagugaaaugauguugauacgguuuggcugugcccccacccaaaucucaucuuguaguucccacaauccccacgugucauggagggaccucgugggaggugauuagauuaugggggacgguccccaugcuguucuugugacagugaguucucaugagaugugaugguuuuauaaggggcuuccuccuucacucauccucucauucuugcuccugccacccucugaagaggugccuuccacuaugauuguaaguuuccugaggccuccccagccacauggaacugugagucaauuaaaccucuuuucauuauaaauuacccagucucaaguauuucuuuauagcagcaugagaauggacuaauacagauguacagcaggucuucaaauaaacuucaacauuguuuucuugaaaugaugagaagaaaaaacgguuuuguuauacgacauuaaaguugcaguuuccaagaacauaucaacaauguuaagugaggacauauuaaguauaugcuacaaguccccuaaaaugggcauaaaaauucuagaaacaguauaggcucccuaauuuucuauaggaccaagcuaaagccuaggcaaccuaaccugcucuaaagggcagucaucucuagcccugcaagacccucuggccucagccccaccucaccuccagcagcaugaggaugaaauuagaggguaucuacaauuuguuuucagccagcaaaucacugaguaaugagaacacacacagcuuucuuucuugauaguccuuguguaagcugagucccuccuaucucugauggcaacacgaaggauauagugaaacaaaagccagggagccagagagcuguggguuuggaucccgaguaugcacaugagcugugugaucuuggauuagccacucaacggcuccaaccuugguuucucauccucaggaugaggauaacaacagggugggaaagugcuuagcaacaaauaucaagucccuuccucucuaagagaucugcaaacuuucaauguuuugacuccuuugugaauauguguaugagugaauguuaaauugcaguauaaaacaagucacauagcaacgauaccccugggaagagaagcaaugccuacccagaucagaucaccaugggacacuccaaagcuccgucauuggagcucagcagcaguugggagggaggggacaauaaaauguaacaugaggggaggacaacuucuagcgcaauaagggaaggguacgaaugaccccaaaucuuccagcaugucacuggcaggaauguuaugaaguuucuacaacuaacuuuuuugauucuacuacauuuaagaaaaaaaaaaaaacugaaccauuuaagugacacuccaauggcaaagcugauguuguguuaccuuagagacauuaacggaaacucugcucaaggcagccagggacuuccaacugagaggccugcggagagagccuucaaaauggucaucaacuagcucgauaaugacagaauaacuggaaaauacagaaaaagcauguuaaaaguaaucaugaaauaaaucuguuuaaaaagaauauuuguccuaccaagaacaaauauacagaaaaugaaauuugcaucaucugauucuaaauuccccuaaauugcuauugagaaaauauuaaugaaaaauucauacuuuaaguuacaaacuuucaggcugauuccaaaacuuacaggaaaaaacaaauacuuuucccaaugugaaagcuguaaauucacacaacuguuuaggcacuaauacuaacuaauuuuuuuuuuuuuuuuuuuugagacggagucucgcucuaucacccacgcuggagugcaguggugcgaucuuggcucaccgcaaccuccgccuccuggguucaagcaauucucugccucagccuccugaguagcugagauuacaggcgccugccaccaugcccagcuaauuuuuuuggauuuuuaguagagaugggguuucacuaucuuggccagguuggucuugaauuccugaccucaugauccacccaccuuggccucccaaagugcugggauuacaggcgugagccaccgcaccuggccuaagugauguuaaaaugaacaauuacggcacagauuaacucaguguuuaacacuagaacauauauuaucauaaacuaugcaucauccuauauauaguauaaugacauuaguguguaaggaggcaugaacauauagcaucuauucguaucaggccaggaagaacaugacuuuuguuccuauggcaccaaaaaguuaaauuagaggccagaaauuccuugugucccuuuaacccauuaguuuauuuaaaaaucacuccgaaccuugcaugguaaaauggagggccuuuccgauauagcacugcaaagaagaaagaaaaaaaagaaguauaaccacucaaaauaaugagagaggaguaagacucaacaaaaagcuugcuuuauuaacuuuucuucuccaaaaggaagcaaauacucaauaaucuauauguagacagaucaucugcaauaugccuguggucuauuuuuucagacagggucucgcucugucacucaggcuggagugcaguggcaugaccauggcucacugcagacuugcccucuugggcucaagcaauccuccacacucagccuccugaguugccaggacuacaggcgugcaccaccacacgcagcuaauuuaaaauuuuuuuuuagcaacagcaucccacuauguugcccaggcuggucuuaaauuccagggcuugagugauccuccugccucagccucccaaaguggggguuuacaggugugagccaccacacccagccaccaucaucuauuuuuaaaauccaaacuauuuuuuuccugaaacaaaguacaauuaguaaagaaaucuguugccaagacccuaacaccucguuucacccuacaaauaaauuccaaagucaaaguacaggcaaucuugccuugccucuugucuuacacucuccagagugagugugaaucauacugagagguguaaaauucauagaauguggaucaauauuuuguuauugauuucagaucaacguaaugcaaagugucugacucacuacucuggccagcuacugugacagggguugguaaaagaagaggaauaagacucaugccuauuuuuaagaaauucaaagucaagugauagaagucauaaccauacaugccauucaaguaucaguuugcuccauuacugaggaccugaagaagaugggggaauucagucuguggaggucgagagcuacucagugaaggagccuggggccagggacucugacacacagacucuggaaucuggcagggaacccuucagaggcacauggucuguggcagggacuggcuaacuguucaccaaauccaguuauuucucccccaggugcauggccagaccacagcucucagucucccguacaguuagguauggaacgugaccuuggaagcugugugcugaagacugggagccaccaggaagcaguuacuaaagcaucuuuuggaguugauugggccgccaaucagagacagccguguuggauuucacaugaacaaaaaugaacucuuauuguuaagccccugagacuuaggguuuauauacaacuacagcuaugggaauugccauaacgacacaauuacaucuguaagcuguuagcuguccucugugcuaaaaccagcucagaaaaguucaaggccgggaggcggagcuugcagugagccgagaucccgccacugcacuccagccugggcgacagagcgagacuccgucucaaaaaaaaaaaaaaagaaaaaaaaaaaagaaaaguucaaggaaaaguuuuguuucccuugaggaauggauagaauuuuccuuuuuggacacaucaauccuguaacuaaucauguuucuuuuuggcucaggaagcucagagccaaauuuguagcaugacuuuaguaaccauauagggccccaaggacgacacaguaacccuucacuuagucuuguuuugcgucuguauuuuccauggucacauuuccuuucuguauuuccuauuuaaguuguauuuaaaguacucaacaagucagcucaaauucacugaggcacaaauguaaguaaauauccaaacauacaauuuucaacuuuuugagauggaguguacuggaaagaaaccauguacuggaacaaaagugaacuugggaguuuuguucccugcccaaucuuugccucuucaaguugugugccuuuaggcaaguuauuaacuucccugagccuccguuuccaaaauccuaaaaugaagacaucaggggaaauugagaucuuuucuaguccucaaaugacauuaccuguaaucaaacacacaucuuuaauccaauaugcaccuggagcauuacacagcuucaaaguagcucacacccacaaggcaaguaauuucugaugaugggcuccgacacagcacagcuuaguuuaagcaagaacacuggcagcagauggacccaaggucaagucagcagugccaagaccaugggacaacucuuuaugucaauuuccuuauaaaaauggggauuauggugaaggcagaaguauuagcacgguguauggcauacaguaagcaucacaaaguuaccuaugcuaguaacaauuacagucuguguggcuuaaugaugaggauacguucuaagauaugaguccuuaggcaauuucguuguuguguaaacaugguagaguguacuuacacaaaaccuagaugguacagcccaccacacacauaggcuaugugauaucacuuauugcuccuaggcuacaaaccuguucagcacgugacugugcugaaucuguagacaauuauaacacaaugguuaaauaucuguguaucuaaacauagaaaugguacaguaaaaauacgauauaaaagagaaaacccguauaccuguauaggggacuuaugaaugcagccugcaggucuggaaguugcucugggugagugagucgugagugaaugcgaaguucuaggacaguacugugugcuacuguacucuuuauaaacacuuuuuuucugucuuuagauuuuuuuauacacauauauagagagagagacauggucuaccuauguugcccaggcuggucuugaacuccugggcucaaaggauccguucgccuuguccucccaaagugcugggauuacaggugugagccgccaugccuggucucuuucuucaauaauaaauuaaccuggcugggugcagguuaacauacaaugaaccaugauggauaugaccguggucccauaagauuauaacggagcugaaaaaucccuaucaccuaaugacaucguagccaucaugcugucauagugcaacggauuauucgcauguuugugguaaugcuggugugaacaaaccaccgggcgcgguggcucacaccuguaaucccagcacuuugggaggcuaagguggguggaucauuugaggccaggaguuugagaccagccuggccaacacauugaaacccuuucucuacuaaaaucacaaaauaauaaaaaaaaauuagcugugguaaugcaugccuguagucccaccuacuuaggaggcugacgcgggaggaucauuuuaaccuaggagguugaggaugcagugagcugagauugugccacugcacuccacccucggggauagagugagaccuugucucaaaaacuacauaaauaaauaaaaguaaaaauaaggucugaaagaacagggaguauaaaaggaaaacucuuucuuacagaagaaugcuagacagagguguggaaugaaugacaaaaccagaaaaugauuagugcaauaauuaaaucagacaacuauuauaauuauuagauuauacuuaugguaucuacuuaugguaucacuuaugguacuuaugguaucacuacuuaugguaucacuccacaaaugacuuguuuuuuacaaaagaaaaacuguaauuauaugacagacauugacaauggccaccaucaaacuuagcaucaccacagcaggaaaaccugacuucaugcacuuccugacacacuccaauaagcacacacaucaccuacgugugcuaagagaacccgagcuugagucugaucaucaggaacaaucagacauauggagaauggggaacauccuaaaagacuucgaaaaaagucaacaucaugacaaacgaaacaagaagguagagugaccaugucagauuaaaagaggccaggcacgguggcucaugucuguaaucccagcacuucgggaggucaagauggguggaucaccugaggccaggaguucgagaccagccuggcaaacauggugaaauccugucucuacuaaaaauacaaauguuagcucaagcacgguggcaagcaucuguaaucccagcuacuuaggaggcugaggcaggagaaucacuugaaugugggaggcagagguugcagugagcugagaucgcgccacugcacuccagccugagcaacagagcgacacucuguuucaagaaaaaaaaaaaaaaaaaagagaccaaagagauugcaguagguuuaauggcagcucccagaaagauauguucauguccuaaucccugacuugugaaugugaccuggaauguggaaugugacuuggaaaaagagucuuugcagauguaacuaaguuuagaauuuugagaugagaucauccugaauuagcuggauggccccuaaaucuaaugucaaguguccuuauaagagaaaggggauuugacacagacagacaagguagagacuggagggaugcaguaaccagccacaaaacgccuggggccacaagaaucuggaagagacaaggaauggauucucucccagagccuuuggagggagccuggcccugaugacaccuugauguuagacuucuggccccuagaacugugacagaaugaaucuuuguugcuuuuaagccacccaauuugugguaauuucuuauaagcccuaggaaacuaaaagguagauauaauaaucaaaugugauuguaacaagaaaaucaaagccaggggccugcaugguggcucacgccuguaauccuacacuuugggaagccaggcaguaggauggcuugagcccaggaguuugagcccagcuugggcaacacagaaagaccccaucucuauaaaaauuacaaccaaaauagccacaaaagacauuacaaggacaacuggaaaaauuuaaguauagacuggauauuuggaugauauuaaguaauucuaauuuuucucaggcauuacaugguauguaggagaaugucccuauucuuuggagguacacaugaaaaauacuuacggauuaauauggauuauguacguaaacgugaagaauauuaacaaaaauauaucaaaaguuugacuagaaaaacaagccaggagguggcuuagaaaugaaucaaaggcccggaugccacggcucacgccuguaauuccagcacuuugggaggccgaggcaggcagaucacuugaggucaggaguucaaaacaagccuggucaacauggcaaaacccugucucuacuaaaaauacaaaaauuagcugggugugguggugugcgccuguaaucccagcuacuugggaagcugaggcaggagaaugguuugaaccugggaggcagagguuguagugagccgagaucgagaucgugccacugcacuccagccaaggcaacaaagugagacuuugucucaaaaaaaaaaaaaaaaaaaaaaaaagaaucaaagaggaagaugaggagaagacacaucuucuuguucugugacaaacagagagcugcucuguugaccuccauucacggacagaacuguuagucucugggcuggacgucacaacaggucaugguuucuucugggucuggaaauucuauaacucugcuagcuuucaauggcucccaccauuccauuucugugcugggacuucaaauuggcagaaagcucagaaaucauacuuaucagucaaugcaaaucccuaacuaggguuggcugggaaggaggcuuaggaguaaccagaccuuugggucacaccaaaucaaaucaaaccauaacuguguacauaagacaauauaaauccugcguuaguuuucggcuucuuggcaggcaacaugacuuagguaugguaggaagauagggaggauagacccacagagcccuaaucuguguacuuaacgagcuguuaaguacuccagcaacuuaccuaacccuucuaaaccucaaacuccucugcuacaaaaggaagcuacuacuacagaccucacaggagugugaagauuaaaugaaacaacagaagaaaacaccaaggcaaggugccuggcuggcccuaggagcuggcagccaggggagcugcugaguagggaguguaaggaaaggcucccucuuggcuucuggccuggcuuccccaguaggcaaauaaggucaacuagguuggcagcugcacuugauuugagaaccauaucaccucuuccaaauacugcuccuggaaugaaauuugauugacaagauuuauucaagggaaaaguuucccugauaaggugugaauuucacaauggucuuguauuaggagucacuagcucucuaaggaaaaacaauuguuaagaguuuagccuauguuggcaguucuaggcuucaugugacuaggucauuggccuuugaaauuaaaauaauaucguuaaaaagcagcaggaacugugcagccaugccugaagaugagguagaguuuaggaagccgcuccucauaucccagacuagcacugcucaagaaccuuugcuuaugcagagaaugugaagacacuuuuaacacugaugcuggcccagucugacucugugugugggucagagaccuggucccacauuaauuguacaauuaauguauuaauuguacaucuguuucuagaugauaugucccagugagggcaaaggccuccaggggaguuguaaacugaguaguuuaucuuuuuuguuuucaaaauucuauuuaucuguccauccaucuauccaucuguccaaccauccuuauaaggcagaauaucuuuaaauuaaggaagcuuccccuaugcaucauccaaaguauaacuugaucauuaaaauaaaguugcagacaaaagaaccacaguaugagauuaagaacauuaauaaaaugaacaauuauaacaauacacuauaaugaaaguuaugagaaucugaucucucaaaauaucuuaauuuuuauuuuuuauuuuuauuuuuuauuauuauuuuuugagacagucucacucuguugccuaggcuggagugcaguagcgcaaucggcucacugcaagcuccgccuccuggguucacgccauucuccugccucagccuccugaguagcugggacuacaggcaccugccaccacgucuggcuaauuuuuuguauuuuuaguagagaugggguuucaccguguuagccaggauggucucgaucuccugaccucaugaucagcccgccucagccucccaaaguguugggauuacaggcgugagccaccgcgcccagccuauuuuuauuuuuuuuuaagagacucuuacucucuugugcaggcuggagugcaguggugugaucuuggcucacugcaaccucugccucccaaguucaagagauucucgugccuuagccucccaaguagcucagauuacaggcaugcaccaccacacccagcuaauuucuguauuugugcuagacacaggguuucaccacguuggcaaggcuggucucaaacuccugaccucaggugacccaccugccucggccucccaaagugcugagaauccaggcgugagccacugugcccagcagauaucugaaucuuuuugacuacaguugaccuuggguagccuugacucugcuucuucuuacagugcuuaucuguugcagaaacuacgucauguaguuauuugcuugugugucucccccaucccccuagaauguaaacuccaugaaggcagcucuguuuguccuguucacuucuguauucuugaugccucaaacaguaccuggcccacagcagaccuuuagucauuaucugcugaaugaggaacucaccuacuccagacccucacuuuaagauugggggaugcaguggaauacuaggcagccacaaaaauggacaagaucgugucuuuugugagaacauggauggagcuggaggcuguuauccuuagcaaacuaacacaggaacagacaaccaaauaccacauauucuuacuuguaagugggaauuaaaugaagagaacuuaugaacacaaagaagggaacaacagacgcuggggucuaccugagggugaagagagggaggagggagaggagcagaaaagauaacuacuggguacuaggccuaguaccugggugaucaaauaaucuguacaacaaaccccugucacaugaauuuacccauguaacaaaccugcacauguacccuugaaccuaaaaauuuuuuuuuuuugagguggagucucugucacccaggcuggaguguaguggcgugaucucagcucacuacaaccucugccucccgggaucaagcaauuuuccugccucagccucccaaauagcugggauuacaagugccugcuaccacgcccagcuaauuuuuguauuuuuaguagaaacgggguuucaccauguuggucaggcuggucucaaacuccugaccucaagcgaucugcccgccucggccucccaaagugcugggauuacaggcgugagccaccgcaccuggcccuaaauuuaaaguuaaaaaaauuaaauaaguaaaauauugauuuaauuaaaaagaaaagaucaagggaggcaguacugucagacauuucuaaaagcgugggcuucagaauucaaagugcagcuuugcaaguuacuggcccuggaaacuauuaugggcaaugaccuacuuuuucuaaacuguagucucccuaucagaaaaugaagacaauacggccggcaugguggcucacaccuauaaucccagcacuuugggaagcugaagugggcagaugacgagcucaggagaucgagaccauccuggcuggcacggggaaaccuugucuguacuaacaauacaaaaaauuagccgggugugauggcgggcgccuguauucccagcuacucgggaggcugaggcaggagaacggcgugaacccaugggguggagguugcagugagccaagauugugccacuggcacuccagccugggcaacagggcgagacuccgucucaaaaaaaaaaaaagacaguaagcgucuccacugcauaggacuacuguaaggauuaaacaagaugaugaauguaaaauacuuaguaaaaugcuuggcacauggcaagugcucaaugauggcuguggcgauuauuacaauuauaugauuguucucacuuggcagaugaggccacugaggcccggggauaagggacucucccaaauuacccgaucucauggcuagagacgugggggugggugcuauagaaugcuuuuucuuuuuuuuuccuuuugagacggagucuugcccugucguccagguggggugcaauggcgcgaucucggcucacugcaaguucugccucccggguucacgccauucuccugccucagccucccgaguagcugggacuacagacacccgcuaccacgcccagcuaauuuuuuauauuuuuuaguagagaagggguuucacuuuguuagucaggauggucucgaucuccugaccucgugauccacccaccuuggccucccaaagugcugggauuacaugcguaagccacggcgcucagccagaacgcuuuucuaagaucauagagcaaacaagagggaaagccugaacuggcguugcaagcuucuacuccuaggccuucucccuagacugccuuuucucuuuuugcacuuacccuuaacccaauccaaauauccaauaaucuuaucuaaacccaaaggauaccuucuuagaaaacaucaucaacagcacacaagaucaauuugauauucuagggugaaucugauauaaacucuauucucacacacaccacgccaagaauuacuuacguaaaucugucccguacuugagucccacuuugggcacccagcccuugcuucgaaaguaaugguaggccauguaggugguucugaacgugggcugaacuacagugaaagcuuuccagagcuucacuaucguuaaaggcuccuaaaguuauuuacaaaaaaacaaaaagcauuacuauguaugcauucacucuccguucagccagggcaccaacaucuauacuaaguguggagcugaagcagugaagaaaaugcaguucccccagcagagcaauuuauuuauuuuauuuuugagacagagucucgcucugucacccaggccggagugcaguggcgugaucucgguucacucccagcagagcaauuuagcaagaaggucugguccugcccuguccaguggggcagcugccagccauacauagcuagucugaacugagaguggcucuaaguguaaaauauacacugacuuccuacucaguaugaaaaaaaaaaaaaagagagaauauaaacuauuucaauaucuuugaauaaguuggguuaaauaaacuguguaauacuguauuaaaauaccaccugcuuuuuaaaaaauguuuuuaaugugguuaccagaaaaucugaaauuauacacauggcucccaucugaggcucucacuguccuucuauugcacagcacugcuccagaggacuuagaaaaggcagcauuugagcaugacaaguagugagggaaaaggacuggagggggugguggugggcugggaaggacauuccaggcagaggaagcagugcaugcagggggcucacuguaacaagcccaccaaggcuggagcacaguucgugacaacauuucacagacccuuagugaguggcuacucuaugucagcucauguucagaagaacaaaaaacacuuuuauaguaaaacuuaaaaacaaacaaacaaaccuccauuuaguguuugaaacuagagaauuuguuaucugauggcacaaacuaauaauuaacugcuuaaaagacaauuuuguuuuuaaugugggagucaaagagaaugagaauaguuuggucuagagaauauucugauguaucauuaccaaaaauacaaugacaacaaaauaacuagguaaguuuggaaaauuuuugcuuuauuucaguaguuacugaaacaaucaagucuucagcugauuuaaggcucagucacucagugagacuggcucaguuugucccagccuaagauuauaauacaauagacuagaguuguuuuuuuuuugcaguuguuccuaaugcaaaaauuccauaccugugugaccuugugaccccaaugugaguaacaagcaacagccuuauagagaaggcugaauuuccaacacagcccaguguuguucagauguugaggcuuuuaugucacagcuguaacguucugacacauuucagcuaaggcccgcgagaggaagcaggguggggcuaagaauugccaccauuugggaaaaugagccauuugucaggcagacauugcuuccaaacggcuggaauacccaugaacgguauuuaugcaaucagaauuugaugacugauuaaauuaugugcucccaagagccaaacagaauauaccuuaucugcuccauuuacuguucuguuuacuuuucucuuuuaaauuuuauuugaauuauuuuacaauuaucucccuuccaaaggcagcaggcaacaacagcacaaagucaugggcuuuggaguuacuuggacauagguucgaauauuuauucuaaccagacuagcugugugacuuuggguacauuauuuauuuucucugagccucaguuaccuuaucugcaaauucuuuuuuuuuuuuuugagacagagucucggucugucgcccaggcuggagagcaguggcgcuaucucggcucauugcaaccuccaccucccagguucaugccauucuccugccucagccucuugauuagcuggaacuacaggcgcaugccaacacgcccggcuaauuuuuuguauuuuuuuaguagagacaggguuucaccauguuagccaggauagccaggauggucucgaucuccugaccuugugaucugcccgccucggccccccagugugcugggauuacaggcgugagccaccgggcccggccccuuaucugcaaauucuaaccagguggagauaaggacuggaaauauugcguguaaaguaccuaaaauauagcuuuuaccauaguaggugccaaauacggguaacuuuuauuuuuguuaauuuuuaauacuguucugacacagauuuccuaaucauuauccaguacaagauacuguacuucuccuaguuuugaggaaugaaaugcaaucuaaaagggucaaagaugccuuuugcucgaacagucccaccucaggacccaaauccaaaacuuuagagaaaaauucaauuccuauuuuauucaguaagaguagaaacauuuguauuaaugcaauauagaaauuaguacaaccugcuuuuaacaacagggaaauuuuaaguggguuguauguaaacaaagcaucuuaccuucucauaguaaauacuuaaacaucccagagcauagaccaagaaaaaggccugaaaauacagcaagcagaaaaugcucauuacaaauaguuucacauucuugugaaaccauuuuacagacugaucucuuuucaccucaaauacaaaugcucuuaagucaucaucaaaaaggucacacacacacacacacacacacacacacacacacacacacauauauuuuguuuguuuguuuuugaaacggagucucacucugucguccaggcuggagugcgguggcacaucuccgcucacugcaagcuccgccuccuggguucacaccauucuccugccucagccucccgaguagcugggacuacaggcgcccgccgccacgcccggcuaauuuuuuguauuuuuuucaguagagacggguuucacaguguuagccaggauggucucgaucuccugaccucaugauccaccugccucggccucccaaagugcugggauuacaggugugagccaccacaccuggccaaaagucacauauuuuuaauauaaaugguucauucaaaugucuuagauuuuuuuaaaaaucuaagaaaauacaaauguuacaaacuggcuuaaaucaauaaaaauaaaagauuuuuaugaauguuuccauauuuauucccuaaaaaaccuauauaacugaagaaugauguuaacagcuauagcaauagaaacuguugcucauuggaguuucucccuguaaaauuaaauaaccauauuuaaauugagaaaaauauaucaacaaaaaaaaaaggugugaaaaguguggggcagugcugauuuugcuuaccugacaaaauacuaguuucccagucaucuuuggugaagugauuuucuagaacccuauguuugcacugaccucacauaaugauauauuuuacuguguggggggaggcuguaggaauggcaaagaaaauuggcuccaguugaauauagucacacuuaaauggaaaugaaaauggcuuucuguuaaaguaauacacugccaaacacugacaccacccaaagagccauguguuguuggcuuugccuguccagggcgcuuagggucuacagauaccacugaagggauucccaugagauuggugcagagcagguagugaccaaaugguagccagugguaaaauggggucacauuucuuuuuaaauaugaaggugaaaaauuagauugauaaccaaacaucaaauauucugcuucggcucucacugcugcuuccagcagacacagacgaggagggccccucuugugcagugugggagcagaaacauaauccccucccugucauaagcuuugaggcuugugugcagcaacaacgcacugacaaacugcucacucagcuucuuuccucacuguccuuccaccccaccacuaacccggcauacacagaacaaaagacagcacaaguaauauagguggaaggacuuccaagcagugaauacccugucauucucugccuggcuaucugaugacaucugucuucauagcagcaguucucaaaggguggucuggggauccugggauccccaagacccuugcaggaggucucaaggucaaaaccacuucauaauaauaacgugguguuaucugccucauuugugcucucuccagugacuauaagacgugugauggcccaagacugaaucaagaagcagaugcaagaaucuagcugacuuucaggaaauuagaccuuaaagcgacuugcaaaaaugaaaaacgaagccucuuccaaauuuuuuguuuuggaaaauuaguuauuuuucauaaaaaacuuacauuaaaguauuuaugucaagguauggguuguuguuguuguuguuuuuaauauggaaggcuucacaaacuugugucauccgugggcaggggucauacuaaucucugcauuguuccaauuuuaguauaugugcuguugaagacaucacuauuauuauuuuuaaauguguuaaacugauacucaacauuuuuguuuuaauuuauaauuugauaaacacugacagauacgagggaccacuacuuuaguuuuacccaaauccuaaucuagagcauuucuggagaugaagguggucaccuucuauuccacuuuuuccuauugccuucuuggucccaagucuguggguggcuccuuccugccuucugugacacccucccuguucugagcccucuacaguccacucuccauagcauccagauucaucuucuuggcacacgaaaaucacgucguuccccuaauuaaaacuuuccaaagagauuucacugcccuuagaauaaaguccaaacugcuugccaccagcuccaggucccugcaugaucuuaccacugcucuuuccagcuguccuggcugcacuucuguccccugaagacacuaagcucauucaggccuuugccucuguaaucacuacuccuacuaucuggcauguucugcuccagacucaaaggucacuucuuggagaggucuucccuggccaccaagucuaaguaacccccauccugaucaucuccagagcacuuacuuuugucugaaaaucuuccucuuacauguguuccuccgacuagaauguaaacucuggcagaacagaaacugccugcuguucccuuggccuagaagggggucuagcacauguuggguguucaaugcuuguguugaaagacaaaaaagacagguccccaguccugcccuuggcuuaggccccaacagccagagccacccuacagcaggucucugcaccucacucagcucaucucuucucagugugaacauugcguuccauuucuuucacagcuguugacagcccugccaaguggcccacaaucuuauuuugaccuuuucucuuuccaucacucacuacuuauuaauacagaauacugcuguuuuucagauggacuaccagccaaaagguacaauggaaaagauaaaguuguuuccuuaaauggcugagucccuugcauuuuaccacaauuugcacuucuugguucagaacaguguaacacaaagacugaaguuugagaucugacagaccugagcucaaauugucauuguuagcuagggccuuggaaguaucacuuaaauucuccaugccucaucuauacaauggggauaauaaugcuuucuuagcuaaauauuuaauaagaucaaaucguacaaagauuuaauaagcuaugaaaagcaccuaaaagcucaauuaauuuuaguuuuccuccuuucuggaacuccugaccucaggugaucugcccgccucggccucccaaaguacugagauuacaggcaugacccaccguggcuggccuuaguuuucuucccuuucuaauaacuggauagcacagccuggaaaaaaagguucaaucccauccuugccuaauaagagauucuuucuugauaucugcuaaaauguaaguucuucaaaaacugauguguuuucauuaucagcaagcauacauuuccccaagagugaaugaaaccaauaucucauuuuuauuggccuaaaauggugacuggcuuugaucaucuaugcaaaaugcgacuaggcacuuacuacagauggaggggaucuuaauucaacugaguugguuuuauuuaaaauuaaauuaucaguagacuggagaggucuguagagguugacaaucacauccccugcaaucucauuaguaaguuuuacuuucgcaguacuaauaagauggaaggauaaguuuaaugauaguuuuuaacaucauacugcuaaauguaguuagggcccucaaguguuguaauggaaaaauagaucucaauaacagaucccuaugaaacaauggaauacauuagcuaacuggcauggcaaucuaauuaucccugaaaugaauacucgcacagacugaacauuaaaucaucaccaugaccgguucacaaaaaguauggguuaaaaugucacuggcuaaaagcagagguaaggaagauguugcauguggaauaugccauguggcaugugggaauacaguuguaggugccuaaccaggaaaaaaguguauucuacuaaugugaucuagucacugugugugugaaagaccuagucacuguguaauacuuucaccauuuaaguaaaagaucuauuuugugaucauuaucaacaauuuagagacagaguauguaucugcuaccaggcagagaauaaaggcaggaaccaaacgagcaccuauuacaugugccaggaacugugcuggucguuguguauacaucacugaaugucauuagcuguuauaucaauucaagcaaaaauaaagcacaauuuccaagaaguguuuuuucaugugagugcuagcccucccucagcacacacgucuuucuccaaacugcccauaaaaaacauugcauugaaguccauuuuaaauuuacagaaaauauauucauuuaaaaauauucugccauuuugugaacuaaagcuaugucuucacuccacccagggaaguuggcuagcuugaagagggaugcgacacaaugaggaacauacauugcuaagugucuuccaggacagagaccucacacauaucacacuacauucaaucuucacuaucuuccucugaaggagaacguuacaucugaggaaacugaggaaugccaagaacacugucuauuguguguuauagugcaugcugcaaauauuuucuucccauuucaucuuuugccuguaauuuugccuuugucuuuaacauagaguuuuaaauuucuagguaaugaaaucuauauauuauggccucuuagaagaacuuauccauaucucaaaaauauauaaaaccuaggcaggguggcucacaccuguaauccuagcacuuucggaggccaaggcaggugguucacuugagccuaggaguuugaaaccagccuggacaacauggagaaaccccaucucuaccaaaaauacaaaaauuagcugggcgugguggcaugugccugugguuccaacuacucaggaggcugagaugggaggacugcuugggcucaggagacugaggcugcagugagccaauauuguaccacugcacugcagcuuaggugacagagagagacccugccucaaaaaaaaaaaaaaagcauaauuauccuuguuuucuauuucaaauuucccuuuauaucuuuaauugaccugaaauuuauuuugguuuauguuaggagaugggauuuuagcuuugucuuuuuccaaauggcuaaucagcugucucaacaccaugaaucuuuucuucacuaauauuaagugcuauuuuuauuguacccugaaaucccaucuauaaaugggucuguuuguagacuguggcccaaucuuuccuuuccuauaccaagacuauauuguuuuaauuguuacuuuauguuuuauuaacagcugcaguaagaucuuuuuuuuuucuuagcuacucuaaugauuucaagugaacuuuaaaaauuaauaacgcccuacagccaugcuacucucaaugugcccgaucuugucugaucucagaagcuaagcaguguugggccugguuaguacuuggaguggagacugccugggaauacuggaugcuguaggcuuaaaacaaggaucaaugaaacaaauggcaaaacugcaguucuuuucucuccugcccaccagcacacaaaggcuuuuaaaacaaaaccugauccucaaagcaguucaccugaaguuuccugugugucuggguauauaugcagaauauaaauauauuuauagagagaaauuagaguaguuuuucaaaccuuaaucaaaaggcucugcuguaaguauauauucuugcuaaaaggacccaaacugucucacaguugaagucucuggaaaauuuucagaaguuuagauagaaggaaagucacugaccuauugcaggggagggagacuagucaaacaacguagcaguaaaaaaauaaccacaaaauucuagggaagaaucuuagacauucuaaucaccagauucugauacuuggaauccauauuauggacacuaagcacgggaaaagaaaugugggaaaaacgggugagguacaaaauggaagagccgggcacaagacgaugcguaaacgagaucugacugagacugcugcugucaggcacgaggagagcugucgcccgacccuggugugucccuuuguuuccaagcauucccaccugguccuccuguguggggacuauugucuuuauuuucuaaauaagagaaauuuucucacgcacuuuaaaagcuuuauaaguauauacgaacaauacacagaaguaccaguaaggcagccucuaaaacuggaguuagacuaagaaaucgacauguaucaacaaacucagagccacagcugaaugauaucaacacaguuaaagaaugugacacagagugagugaggaaacucagcaaauggggagucuggugacgguggcaaggucuucgcacugcgcacaggaugggacuccgacccaaggguucgguggcagaccaaugcaugcaccacacugccuccagucuagauguuagcagcucuuugauauaccucaauucaaugguggcuuuucaagaaaaagaaugcaugcuaccacauuaaguaaaauaauuaauugaaagucauacaacaaucuuagaaucuucaguaucaaguaaaaaacaguuuauaccuccuuggggagaaggacacaugagccugacauccuuaagcacuuguauuauccagcucacuccucacaggcuaacucugugcucaccaagcagccuuccaauuauauuacccuucggcaucugaauuuucuacaugaagagaacaugccaauauggaaaggcaggugguggggccuuugcugauguuaauaaacucacauucuaguuuauuccccaggcucuugugagcacacucagcaugaaugcugcuccuagagcucaagucauuuucugugcucuaacaaauccgaacuucuuagucccucaagcaaaggauuagaccuggaaugcagggccuuacuggggugcugccauggugggaaucuugcugggaaugagugagcuggucugcaccaccccuauuaaaucaccucccaucaguuucccaacagcacacacaguaaaauuaaacacaucuacuuugaacuugggaaauauaaacguuaaagcuccuuaaccuucaaaaguugacugccuggcagcgugugguggcucaugacuauaaucucagcacuuugggaggccaagacgggcagaucacuugaggccaggaguuagagaguagccugaccaacauggcgaaacuccaucucuacuaaaaauacaaaaauuagcugggugugauggugcaugccuguaguuccagcuaccaggaggcugaggugggaggaucacuugaacccgggaggcagacguugcagugugcugagaucacgccacugcacugcagccuaggugacagagcgagacccugucucaaaaaaaaaaacaacaacaaaaaaaaccaaaaaaaacccccaaaguugacagcccuaacuucaugacagcauuaugcaacugcuuuuacuuuacagugaaaucaacuuucauuuaaaaaaaaauuugcucccccaaaucaaucuauuucucacuggaucuugcuaauuaaaaagcauuugauuaaaaaauuagccagacaugguguagcaugcaccuguaauucuagguacucaggaggcuaagguggugggauaccuugagcucaggaguaugaggcuucagugagcuaugauggugccacugcacuccagccugggcaacagagagaaacccugucucuaaaaaauauaagaauaaaaaauuugaagagcaaagcauuugaguguuugcgugugugcguguccacugaaggaugcagaagacggauggagacagaacucuucagaaauaacuacucagaaauaacugagguaaauacaguuuauagcucuucaauuacucuaugaaaauuuccaaaucucuguucugaaugagucaaggcaaaggcaugaaaacaccccuacaaggccgcauguccacaucuguggaagguugcagacuaaaagcuucccaugucagcgcugagcagacuucuaaguuagcuguguaucaccacucugagucccuuaagagagcuguugugaaucaccacagcaggggugagaccccauucugccuguguuccugacuaacauucacagaaacacuccgcggguacaugcagugcaccaaacauaggugauucauucaaaagaaaucugccaaaacagaaagacaaguagagcuagguuuaacggugugcucccugaaaacuucuggaacacaucucugaaauguucucaggugccaggcagcuucuaagaaggcagaguaaccucaucuccugucuccuauuacucuugccuuucaucaggggguguucaagaggaggcagcaggcagcagcagccuuuaaaaaauuugucaauaaaagacagcagcuggucaacuggaacagugcagcugaacucccagcaucugacacggaauacccuucgccuacagcugccaccucccaggccaggccuccagcccacccuccauacugaugcuagcucuggucacugccacuccccuacggaauccccugcagugcccugcuggcccaggaccaggccagacccugacucauggacacacccucccccaucuggcauucguuuuggcagagcuaucuggaagagccuuuacuacccuguguccauguggcaagccccauuuauccuuuacuauccucagcuaucaugacugcaaaagcuuuccaccucagcccugcaagauggucuccaccagcuucgaugcaaauucccuaucuuguacauucauucauuuaauaaguauuacgcaccuaauagaugucaggcauugggcccaaggaaacaggaagagcgauacugacaagauccauaugccacacuaugcuuaucacacugaacuguaaugauuucugggcuaucuuuaagaccaaagucacauucuacuuauuucaguaucgguagcacuuagcccaaugccuggcacauaguagguacccaaugggcauuuuugugauuguaaaaaagaagguuccaacaagcugcuaauuagcuuuuacaaguaacuuaauaaugacaaaaauagcaggcacuaacauuuauugagcauuuacuauauuaucagguacuguccugacccaauuacauguauuauuuaauuuccagaacauccuaugaacaagauguuacauagcccccacuuuacagagaagaaaucugagguucugacaggccaaacaucuaagaacggguacaugugggcuauaaagcgcuccacagugcugggaaugccuacgcaucugcuguucaauacaguagccaguggccacacguggcuguucaguguuugagacguggcuggugcaaccgagaaaaggaauuuugaauuguuuauucuauuuuauuuuauuuuagagacggagucuuacucuuucaccuaggcuggagugcaguggugcaaucucagcuuacugcaaccuccgccucccggguucaagugauucuccugccucagccucccgaguagcugggauuacaggugugugacaccacacccagcuaauuuuuguauuuuuaguagagaugggguuucaccauguuagccaggauggucucgaucuccugaccucgugauccacccgccucggccucccaaagugcugggauuacaggugugagccacggcgcccggcccccacaauuacuuuccuguggucucagcuauaaaauuaccaacauggauguguuccauagcacuucuugggaccuaccuguaugccaagaaccacacuggacacugcaggaacuaucaaagaaagccaucacagagcuccuggagaagaggggagcccaagaagcgguccuagcuucaaaggcagaaaagacauuucugugugcacuaucaacauaagcaagaaaagagggucugagcauaaagugaccacagguuagaggaacuccaggucacugggacaauaugaugcaguuuauggaaggccacuuuuagccacuuuuuuuuuuuuuuuuugaaacaggaucucgcuugugcaguggcgugaccucgguucauuaaagccucgaccucccaggcucaagcaacccucccaccucagccacccaaguaguugagacuacaggcaugcaccgccacaccuggcuaauuuuuguauuuuuuguagagaugggguuuugccauguugcuuaggcugaccuuaaacuccugggcucaagcuaucugccugccuuggccucccagagugcugggauuacaggugugagccauggcaccaggcccaagcuaacuuucaagaauguagcuacugcauuaaguagagggauccugcagaaggaaauaaauccauuuacuuaacuagcagucacuacaugaucugaaucauguagcacaguauaugaaaaguagagacuccaugaauauaccaaacaauagcgacuuguacucuuuaaguggauaaauuguaugguauaugaauuauaguauuuuugaaaaagcuagugaaaauuaguaacaaaauauucagccaauccgaaauccacuuuuuucuucuuuccaccccccuacccccggcaucaccagucagcaucuguuaacaaucugaaaucuuuuuauucuuuuuuuuguuugacacagagucucacucuuucgcccaagcuggagcgcaguagugcaaucguggcucacugcagacgugaccuccugggcucaagcaauccucccacgucagccacacaaguggcuggacuacaggcauaagccaucacaccuagccaucaacauaaagccuuuuuuuuuuuuuuuuuuuuugagacagaguuucauucugucacccaggcuggagugcaauggcacgaucuuggcuuacugcaaccuccaccucccggguucaagcaauucuccugccucagucuccugaguagucgggauuacaggcaugagcaaucacucuaauuuuuguauuuuugguagagacaggguuuuaccauguuggccaggcuggucucgaacuccugaccucaggugauccuccugccuuggccucccaaagugcugggaucacaggugugagcccccgcacccggccuaacaaucuaaaaucuuaaugagaaaagaaguacucagaaaaaccccucgaaucuucuguggaaugauugcaaacacauaucuuagaacugaugaaauaaaggcugaggagugaaaggcaggccuacuugggagcuacccauagugauuucaauacugaauuacaauauucaauaauugaauuacauacagaacuacacugugagguagguucacauauaguguaguucaggcccagagaccgauggcugaaauaauaauauguugaaaacauaccucuucuaggcugaguugcaaauacucaaagauccuauauggauuucuucugcauauuaaccuguuucuuugcaccaacuaaagagaaagaaauacaauauauacagaacaaauggaagcacuacaugucauagagaauguauuuuaaaaugaacauuuuucuuauaaauucccaggauucacauucuauuguguuaauauuauaaagaaugauuaaaacacaauuuuuuugagacggacucuugcucuauugcccaggcuggagugcaguggugugaucauagcucacugaggccucaaauuccuagacucaagcaauucuucugccucagccuucccaguagcugggacuacaggcgugugccaccaugccuggcuaauuuuuuguacagacagaguugcccaggcuggucuugaacuccuggccucaagcaacccucccgcuucagccucccaaaguguugauuacaggugugaggcaccacgcuuggccaagaagugcuuuuuuauuacuuguguggaaaaggaaguuuuaacuuuuucacuaugaagauucucauuuauuuccuuuuuccccugugaauuuuuccugcaguuguaaucauuuuguuggugaauuuuauuuuacguguugcuuuuuucacccaauuguaccuaauaagcaugugccuauguuuuuguuuuuuugagacagugucucacuguugcccagccuugaucucccaggcucaagaaauccucccaccuuagccucuugaguagcugggacuacuggcauguaccaccacacccagcaauuuauuuuuguuuuuaguagaaaugaggucuugcuauauugcccuggcuggucuugagcuccuggccucaagugauccuccugccucguccucccaaagugcugggauuacaggugugagccacugcaccuggcuccuauguucuuaauaugacuucauaaaccucauucuaagucuacaugauauuucuuugaauggguaucucauaucccauuuagcaauuagauuguuucuaauuuuuagcaauuccagacagcucuaggguaacucugacagcaagucccuucaugacguagcucuuaccuggccucccuaggcuuuucucaagauggcugacuuccacacgugagcccuucuugcucagcuguacucaagaucagguguaauuaucaccgcauuuuguuuucucccaaauaaaggagagaauaccacuggccuugucuuaauuuuauaaauuuuuuuaaaaguuauucaccaacucugggguuuuaguugaaauggcccucacagcugcuguggcccaaagccugcugcuucccuuggacccuacaacaggccagcuaccagcugcaggcaaaagacaucccuauuagccaacaucuccaggaacggauggcuuuggaggaagcgauuuauuuucuucuacuuacuuccucauuuggggcagccucccucucgcucauggcacacuccgcuuccucgaccagcacguacucauggucaggcccucuguccccaggaugcaggaggccgaugugcuggcugccgucuucaugaugaaggccacgcuggaggaugagagcaucuuguuugcagcaacagacauggggcagaggugaggcauccucucgcacgcuuuucucaaagcucucuguuguuggguggcagccagagcccuccugcaggcagccuaauggcucacggggaucacccacaccaccugacuuuccagaguccccguuuaccacagaaggucucucucccccugcugugccuuccauguuggaaaccauuccagaguuaagcuugucaugcacuugagccucuucauuccuuuucacaggaggaugcucaagcgguuucguguaauccuugaggauucugcgcacuguacucucauccugccccugucuacgcaucagcucugcugcccacucaacacuaugcugauaccugcaagacagaaauacuguuagaaacagcacucgaauuucaaaauugaaaaaacaacaaagcacauaaaacagacuggaaggugacacaccaaaauguuuacagcaguauuauugaauggugcauuauagauaaauauuuuucuucuuuauacuuuucugcauuuucuuuucuuucuuuuuuuauuuuuuugagauggagucuugcucuguugccaggcuggagugcaguggugugaucuugguucacugcaaccuccaccuccuggguucaagcaauucuugugccucagccuccaaguagcugggacuauaggcaucugcuaacacaccuggcuaauuuuuguauuuuuaguagagaugggguuucacuauauuggccaggauggucucgaucuccugaccucacgauccgcccgccuuggccucccaaagugcugggauuacaggugugagccaccgcguguggccucugcauuuucuaaguguucugcaacaagcauauguuacuucuuguuucuuugcuuuuacaauauaguuucauuuuauuugcuuuauuugaaaaaaaaaaaacaaaaaaaaaaacaaaaaaaacuaacccccaguuuaacaaacuaugaaaauuuaucuaauuuaaaacugauagauuaagugauuuagguaaauaaacaagaaaauggccauccuuuaucaagauuuuuuuuuuguauuauuguuguuauuuuuugagauggagucuugcucugucacccaggcuggagugcaguggcacgauuucggcucacuguaaccucugccucccggguucaagcgauucuucugccucagccucccgaguagcuaggaugacaggcuugcgucaccacccccagcuaauuuuuuguauuuuugaacacaaauuuuuggccaggcuggucuugaacuccugaccucaagagauccgaccgccuuggccucccaaagugcugggauuacagguguaagccaccgcucucagcuuguuuuguauuauuuucaauuuuggaucucauaauguuuucagauagauaugccauucauaauacaaauaacuuguuuagcauuggaaagcaaaaugagaauuucaauaaauauucaucacagugccuacuaacccuuucacaggauaaggagagaaaugauuuggcuuauguagauucauccacauauucuaacagaaauggcccuuuuccucacaauacuuugcagaguagauuuuauugauaaaauucuuguuaaguuucuaaaacuugaagcuaacacccaaguuacaaaacacuucccaaguuacaaaaaauuauaggcaaaacaauagggcaaagcauucaugccuaggcuguugggauguguucaugugaugugagaacuaccagauguuggaaaucugaucagaaggucaaagacauugugaaacucaagugcuuuuugccucgaccuucagugauuagucugaaaggcauccaagacaacacguggcuugugagaaggcagauguaacuuuacuuuucaccuucuuuuaccugguuaagaagacugaacagugcucgaugcggcagcacauauacuuagaauggccccugugcaaagaugacacgcaaauuugugaaauguuccaaaagaaaaaaaaaaagacugaauaugucauaguuuacaaacugcuauaucucacacaguucaacaaggacauuggcuucugcuguaccuaaaaagagacuagugguugcuuaacccugauuccuaagaaucccaaagcugucuauacccuguucaccccacaugaggaugaacaucagggaugccucccuauauacugggaauuguauccuaaagauuaacaccugguaaggcuacccuaauaccugagagucaguacggcaccgugacuuugguauggcacauuuuguguccagcccuguuacuuauaacuguguggcaaugcaaauuacuuaacuucuccgugcuucaauuuucccaccuauaaaauguggagaugaguacuaccaccucaaagggaucuuguuauguauuacuuuuaaaaccagcaaaaagaacauagcugugccacaaccugcagggugucuucucaccuggaacauggccaccuaugcauacguuuaaaagaacuuucaugugaggggucuaaaaagaaucuuagcucuucauaucaacauaagcauuggcucuacagggucuauaaauuuccuuuauuugaacacaaauuuuugugacaauauauuuuucuggggaagggacccaaaacuuuugccaaauuccgugacucaaaacacgugacagaaccacugauuuaaagggucaauaguuccuccuuugaccagaagaucuggagugaagugagcacacagagggcacugcucugcucuuugcagcagagcagucaaagcagacguggguuccaauccuugcuccaucacguucucauaccagcuauaugaccccaccucucuaaggcucagugaccaucuacaaaccagggauaacugcaccuaccuccugggguugcagcaagaauuaaauaagacacguaaagugcauagcccauaagaaguguucaaucaauacuacuauaucauuguggaguuuuuaggaguggcuugaaaaauaaaucagacucaauauaugguaucuugaaaaagauguuaaugaauggaaaugucuuaauuugcuguugagagcagaggcagcagugcagggaugaacgcagccucuggaggucuagguccuggaguuggcucuuccguguggcucugagcuaagccacuuagcacuucuaccucugugccuucugucacauaccagaaccaggccauaccuguguucccuuuucagggucucagaggaucgcuaugaaaagucaaaggagacugaggcucgaagagcauguagaagaaagccuccaagucagauaugaugaaaagagccacacaaacaaaugacuaagacaacgacacaugggucagagcugaaggcguccucuagcuggcuggcaacaccuuaaaaagccaaguccuguugccaucaaucccagaugcuggagcaguugcaggaagagaaaugagaaguaaaaugcagaaaguguuaagggggagcguggcagaaggaugaggcagcagccacgacuggaagcagugacaggacuggggaaagcagcaccauccaggaccgcaaggacacaggacgugcccaucagaacacgccaaggcuucucauguuucugcacccuugaacacacaccucucccauuugcacagggcaccguucccuauuguuguacugaugaaugccccuuuaucacuggaagugcacagcagagugguuuagagugguuagcgcacauagguucuggggccacagugccuaaguccacauacugacccugagcaaggagcuucacuucccuguguucaguucuuccaauuguggaagauggauaagaacaggacccaccucauggcagugaugugaggaccugagaugacacacaggcccaucacuggcacgauacuuagcacuggaaggugcucagggagugcuggugugcacacccauaucaaugucucccaggcucuggcgcugagcccacguaaucuugggcaagcuacugaagccuccccugaguccccaucuacgaaacagaaacaucucuaguaccuacccucgaagguuucuugagaagaugaaaggagguaaugcaggcaagcucagagacugggaauggcacugccagagcagucagcaccuguuggcuauaauggugaugguaucucuaucacaacaccgacuacuacaggacagcacaacuguucacuucucuuccucucucacuagacuguaaauccuucaagaacagggacuaggucuuuuccucgcucuuggguccccagcaccuacccaaugccugacacauagugaauucuggcugaauaaaggacaacggggugggcaaccagcacgaccaucagggcugguccuucagggacauaccccuacuugugucaguuccccaaaggcaucacagaaggguccugacacuuaccuucagaaagaguuacgcagaaggugcguaacuuuauccaaggacgacuauuauuggaaaaaggccaauuugagugaaucgacuugaaauaaaaaucagaauuucagaggcaucagaaaagaaacaauuauggccaggugcaguggcucacaccuguaauccuggugcuuugggaggcugaggugggaggaucacuugagcccaggagcccaagaccagccugggcaagagcgacacccugucucuacaaaaaauacgaacaacuauuaugacaaguauuuaaguugaaaaauuaaucuaaaaauaugaacaugcaucaauuuuucuuauauuuagcaaaauuuagauugugauuccaaguguugugaacaaauaauaaaucaaguauugguuuugguugggggacguauguagcuugcugauagaacugugcugguaacaucuuuaaacauccuuagguucacacggggaaaugagcuguaaucugaaaauuucuuauaaaaaauuaauccccacaagcauacccccuucaagcaacauuccugcacugucacuaugugucguuuaugucacuuuguccuuuguuauguuaauguaaauucaaugcaaauugacggcaaauugaacauuuaaaucuugcaaaaaagaugcaggauucaugaagucuaugaaagugaucaaaguauggcaaagggauuaaaaaaugagaaucuggcaguuagacuagaggagaauugaaggaaaaaaucaacuaaggugauaacacaauaaaguauaucaagagcgcugaggaaggaagagagauauaucugaaugcagauugaguucaugccaggccugcuuauuagugaauaguuuaucgcuuucacuucucagugcaacucuguaacugcggggccuugacuaaggaauaguaggacaacauacaccucccagauuacgcaccccaguaccugcgaauaugacuuuaucuggaaacagggucuuugcagauggaaucaauuugaucuaaggacauagugacugguguccuuaaaagaggcaaaauaucacauguacccauaccccgaaaauacauacaucuauuauguaucaauuuuuuuaaugcaaaaaaaaaaaagaggaaaauuuggacaaagacacacagaaacacacaagggagaaugccacaugaccacagaggcagagauuagagugaugcaucugcaagccaaggaaugccaaggggugccaggagccagcagugaaggcaggcaaggaaggaugcucccccagagccuuccgagggacuguggcccugcugacaccuugaguuuggaauucugguguccaaaaccaugacaauaaauuucuguuguuuuaagccauugagucugugguacuuuguuauggcagcccuaggaaaugaauacaagggucaaugaaacuucuugggauacuguagugcuccuaaagagaugcucuucagggagguagcccucucccugugcagaaccucuacgcuggcaggcuggcuugaccuuaugucauguuguggccagccuagccaggaugcaguucugaugggcgagcugcugcuauuucugaucccuagguuucugcuguggcaaccugucugcacuauagcuccuccaaggcugagggcucugacagguucuuagcaggucccucccacacaccagaaucccacuccugaccccaaccugagguuacagcuggaacagccauugagaucucccuggugccaccacuccuugccaccccgcuggcuaugggguugccaagcauguaaccaaaaaggagcugccagauuuugcacguauaugccagaagcaagaugaacaaaaucacuggggaccugagaaguuuuauaagguuucauggaagagcuguacuguaucacagggacagggaggucugggauggauggagacagucaacaaucucaccaagggaccacaaaguguggcacugcagagaggagaagggccugaucucugcucuccaagcaccgacagucuaaacccacguaugacacaugaggaaagugcugcacgccgaagagggcugugggggccagaggagcagcagccaagacagaggaggggacggugguaaggaaagaaacccaggagaggucaggcaugagcaggauugagcacaugcaggaaucagccaggccauauguguguguuuggggagucagggagaaacguuccgggaaugucuaggauuaaaugaggaagggccucugugaaagccucuuucucugacccuacaguguagcuggaggaagggggacaggaccaucugugcccaccgggcagaaggcugguucaaaaucuaggcccaagaauaugaggacuuaauaacauagcuauuacaggauaguuauucauaauuuggaaagaauucaacuggcaaaacaguauuuaaacaaaccauaaacucacguaaggcauugcaaaaaugauuugauccacauuaaauuccaacauaauuuucaaggauacaucuacuaccaaaaacagaaagaaaaaaagguguggacuggacugcuacaugggacaagacuaccuaaaaacaucugacuuaaaccaucauuuugacagaagccaaaguucauuaugacuuaccucuuugaugugaugauaggcauguuugucuucauaucuggaacaaagaaguucuauuaguuucaggcaaauuucccauaaggggaacaaacacuaaaaaucuaggaaagacugagaauuuuaagauucacaaaaucacacaccuagaaaguuuacuguccagucaguaauggcaaaaauaugcuuucuaugccguccuucccugaacccauacccuuggcaggugcugcccaucaaucacaucggucuugcugggcuuagaggggaccucagaauucuucucaacucagggcuccagcuaagcagcaacagcacaggaggaaaccucucugccauggcugaaugcucauuccaacuuccaaaugagaaugcugaggcccuagagguaugcacuucaucuccauucuucccucuucacugaaagcgccuuccauguguauaucaaaagugcuggaaaagugaacuugauugcaguguugguuuuggauguggauuugggaguucagggauccagcucuagcucccugugcagaaucucaaacuggcuugaccucaaguuauuuugaagaccagccugaugagggcgcaguucugacaggcgggcuccugcuguuucugaaucccuagguuuugguuguaguuaacuugccuguaccccaggcauaagcagggcaucaggugggaggagucuuuccaaccgaaauguuuaucaggucacccaguggucuggguuuucguccuggucuuuuccuaacucugccuuugggcuaauuacuucucuuuucccaaacucagccucgucugcaugcauuaaaugcuuggaagagaugauguucagcuuuaaccccacaggaaagugagcacacccagccaagauugcacaccuagugacuacuaugguugcugcuuaaaaccaauaccuuucgggaugguuuacuaagcagcauuauugugacaagaaguaacugaugcaaagucuauccgauuagguugaacaaucaaaucacuauaaaguuacucaaauggccaggcucacuggcucauuccuguaaucccagcacuuuucagaagcugagacggguggauugucugagcucaggaguucaagaccagccuggguaacauggugaaacccugucucuacaaaaaacacaaaaauuagcuagcugcgauggcaugugccuguaguuccagcuacucgggaggcugagguaggaggacggcauaagcccaggagguggagguugcagugagcugagauugcaccacugcacuccaggcccuaucuccaaaaaaaccaaaaguuacucaaaauaauuucucacucugugguuauacaaccaacuugauauaagcuucaguuacuucauuucuauguuuaaaaaaaucucuuguaaaaauuuaacuuuuuuuuuuuuuuuuuuuuuuggagacggaguugcauuaugucacccaggcugaaaugcaguggcgcgauuuuggcucacugcaaccuccgccuccaggguucaagcgauucuccugccucagccucccaaguagcugggauuacaagugccugccaccaugcccagcucauuuuuguauuuuugguagagacaggauuucgccauguuggccaggcuggucuugaacuccugaccucaggugaucugccugccucagccucccaaagugcugggauuacaggugugagccaccaugcccagccaaacuuuuuuuauaauuauguaauacauuuauaugguuacaaagucaaaucuauaaagucucaccucucucugcauccuguuucaucccuuccuacuggaauuuuuaaaaaacuaugcuuuauccuuccauuuaaaaaaaauuggucaggcguaguggcucaugccuguaaucccagcacuuugggaggccaaggcaggcagaucacuugaggucaggaguuugagaccagccugcucaacauggcgaaacucugucucuacuaaaaauacaaaaauuagccgggcauggugggauacaccuguaaucccagcuacucacccaggaggcugaggcaggagaaucgcuugaacccaggaaguggaggaugcagugagcugagaucggagauugcacaacuguacuccagccuggaugacagagugagugagacucuugucucaaaaaauauaauaaaauaucuauuuuauauuuccaucuuuuuagauaaaccacagcacagcauguacuuuccuuuauacugugcugucuucgcuuaccagcauauccuagcgaucucccauuccugucucagcuccacgguccuucauuauauggauuaauuauauaaauauggauuauuccacagguccucuccugaugaacauguaaguuguucccagucuuuggauauuacaguguugcaugaauagcccugugcuauuucuuuucauauuuuugucagcguauuguuaagauaaauuccuagaagugagauugcuggaucaaaaguaaacgcauauacugggacaacuggauauccacaggcaaaacaaugaagcuggacccuuacuuuacacaguauacgaaaauuaacacaaaauggaccaaagaccuaaacuuaagaguucaaacuauaaaccucuuaaaagaaaacaccagggaaaucugcaugauuuggacuuggcaacgguuucuuaaauagauaccaaaagcacaggcaauaguagaaaaaauagauaaauuggacuucauuaaaaugaaaaacuuuuaccauuuaauacucauuaggaugacuauuuuauuuuauuuauuuauuuagaaauggagucuugcucuguuauuuauuuauuuauuuagaaacggagucuugcucugucgcccaggcuggagugcaguggugcaaucucggcucacugcaaccucugccucucggguucaagugauucuccugccucagccuccugaguagcugggauuacaggugcacagcaccaugcccggcuaauuuuuguauuuuuaguagagaugggguuucaccaucuuggucaggcuagucucgaacuccugaccucaugaucugcccgccucggccucccaaagugcugggauuacaggcgugagcuaccgcgccuggccgacuauuauuuuuuuaaacaaguguuggcaaggauguagagaaauuggaaccuuuggugcauugcuggugggaauguacaaugaugcggucaauguggaaaauaguuuagcuaguucuuaaaauguuaaacagacaauuaucauaugacccauuaauucuacuccuggguauauauccaaaacaacuaaaaauagacucagauacguguaugcaaauauucacaacaguauuauucagaaaagccaaaauacagaaacaaucuaaguguccaucagcagaugagcuaaaggcacuauguccaaacaauggaauauuauuccacuauaaaacggaaugaaguucugauagacacuauggcagggacaaaccucgaaaauaugcuaagugaaagcaacagacacaaaagggcaaauauuguaugauuguuauuuauauaugaaauaucuauaauagguaaauucauagacagaaaacauauaaagguuaccagggacugaggaaagagaggaaugggggaaaagaaaacaaaguaaaugcauagguaauuuugcuagacauugccaaauucaccuccaugagggugguaccacaagcaccccaccagcaaugcaagagaaggucuguuucugaaguccucaccaaugcaguauauugucagacuuuuggauuucugccugauuguugacauguuaucucagugcaguuuuaaucuguauauuuucuuacaauaaaaccuuuaaaagauccuuucuaauuauguuuuaacaugcugguauugguucuuaaguaauuaccaugagaauuccuuagauaaauauucuaaaacauuuauaaauuaaagagaaucagcaagggagaaccacacacauacaugucauggcuauuacaaauucuaauucuggaaacaaaauuuuaaaaauuuugcauagugccacaggugagcagguacuuaacuaccaguaccugccauaggcauaguacucugcuaagcaaacacuuaacaacagaaaagcccaauuaacacuugauaauucuagaaauuaaacacacugucacccaaucauaacccuuuugcuuugauuagaauuauucuagcuaacuuuggcaguaaaacugccaguguacauguuacuucucuagaauuuuacuauauagccugagauauaagaucaaaaacaaaggaaaaugauuaauuugucaaaagaacugaaugauacaacaacuuuaccuuuccauuuagcaaccaguuuaggaucugaaauugugaagcuuggacggcuucuugaaagaauaccuuuuccaaaauaacccuuccaggaagagagaaaaugaaguuaguucaugcuuaguuaccaguuuuuuagcugagguagaauauacaguaaucccucaguauccacagggggcugguuccaggaccucugguggauaccaaaaucggcagauggucgagucccugauauaaaauggugcaguauuuauauauagucuacguaggcccucccauauacuuuaagucaucucuaggcuacuuauaauaccuaaugcaaugcaaaugcuauguaaauaguuguuauauuguuuaauauaagaaaauaaaguccccguuugguacacaugcaauuuuucucccaaaauaucuucaauccaagguugggugaauccacggaaguggaacccaugauauggagggccgacuguacccaucugaguuaacaagagguucgccccacuuuucaugucuuuacauuuucccucugauuaucuaaugaugacuaaggauguucuuagcguaacaccuuucuaaucgcuucaagaguacuaguaaguuuuuagcacaccucauuuaucccauaacuaaugcuuucagucuaggucugauaagccgagggcaggcagaggcagaguuucuucucuacauaugguucgggaacacagugugccugaaggcaggagccaugcugcccacuagguccaaaaaaaccucuuggauucuuuuguacuccagaauugaaguauuccucucauuccugcugauuccaaaaacaacauguauuuuuccccuuuucauuacaaaauauuuaaacacacagaaaauugaaagaauaaaacaaacaccccuuucuccauuuagauuaacaaucagaauaaagaggccagguaugguggcucacaccuguaaucccggcacuuugggaggccgaggugggcagaucacuugaggucagggguucaagaccagccuggccaacauggugaaacccugucucuaccaaaaaauacaaaaauuagccaggcaugguggcaugcgccuguagucccaacuacucgggaggcugaggugguagaaucacuugaaccugggagguagagguugcagugagcugagaucaugccacugcacccuagucugggugacaggguaagacucugucacaaaaaacaaacaaaaaaaacacccagcaacaacaaaaaccaagaauaaauaaugcauacagcacuuuauaaagccucuugcuuaauguuauauacuguaaaugaaggccucccuggugagcugcccuuggccuacugagacuccugccucaccauggccagugccacccacucuucuaucaagugucuagagaaggcacauuuauggagacaagacgccauuccguggcugccuugggccgggagugggagcagggauuaagugugaugggcacaagggaacucuguggugaugggaauguucuaaaacuggacuguggugagaguugugcaacucuauaaauuuaugacaaucacugaauuguauacuuacaaugggaggacuuuauaguuguaaauuauaacucaauaaagcuguuuuuuaaaaaugcccacagcaaugaacagauuauggaaaauuuuuuuuaaagaacuaccagucuucauucaacuugaucaaugcuggaaaacaguaaaaacuagaacuuguccucaucugagaagagguccccaaccaggaggcagcagauaaggagcuccaugccaaagccccaucugauccgugccugaguagggacacuaugccacgcuguggcuaccucugggaacgggaugggagugaguggggaauuuucacuuuuuuacccauuacauuucuguaaauuacuuuuuuuguuccuuuaacaaacaugcauugcuuuuacaacuaaagacaaaaaaaauagucaauccauugaaccuacuucaucacugaaauaaagguuugugggcaggggugcuccaucugucauucuauuacccuaacauauggcuuuugggcacuaauucaaauuguacuuuuccuacaacuggaccaaaccgcaaggaaagaauacacauuguucaugguugguguggggguauggcugggauggggagaaggaaaggacugcuugcucaggguugucugaaaguaaucuuaccaaggcugccugcacuuacuuucccauagagcugcucaauguccuccgcauuccucacaaucacauuguuguuaaucauuucagcacggaauaucuugaauucuuucagaggaccaugguccugaccaaaagggauuggcaauggagacucguaagucucauacacucuucuuuuccucuuuggggcauggaaaacugcuucugccauuuuucagaggagguauucuuuaaagaguagacaacaaacagaaagaaacagacaaucaauaacuaccuugauccaaaaugugaguacaucuguaccuaggcucagaaaacuuaguggucugugggaagaaauagaguauuuauaaagcaauaaacuaaaagcaguaagaacaguuugugugagcaauguaaaucauauugaccuagaauacugcaauuaauccccacaauaaaccccaggaaaugagugguaaucuuucuacuccagcugacaacgcugagaccuagugacaugcccaaagcugcaauguuaggucuccugagagcaagcacaacaggauuucugucuaccaggagugcuuccauuucacucacccaacagacauuuacuaccaggaauuccuaauaaucauaggugcuggggagacaaagacaaaacugagacccuguccucaacaaauuaaaucuugcaggcacuucauuuuccaagaggaucuuacaauacacacuaaacauugggucaaucagcucccaauuuuuaaaguacauuaauaaauaauaaugacagcagcaguuauuuaagggucgauuauauacuaccaaaugcuacuggcuucaagcagggacucuaaagccagacuaucagcaucagaaucaacuuuaccacuuccuagcagugugauuuugggcaaaagucacugacucucucugugauuuaguuuccucaccugcaaaaucaagauaagaacgacucuaucuuacaguuaagauccauaaagugcuuagaacaguaccuggcacauagcguguaccauucauguaucagcuauaauuaguauuacagggugagcaguagcaacaccauuuuacaaauaggaaacagauucagguuagagagauuuguagacgaccccgagugugguggcaucgggugacccaggucuguugaacucccaagcccaugcccucucucuagauucugcugaaagcacaggcagggucuaucuacuuuugucugaugacucuuucucaaaaucagacggugaaggguuauugagcaguaacggaauuacccacugugcacccagcaccaugagggagaacagaaagccaaagccaguacgugucccucuggggccauacauuggauccaaggagacaaaacaaguauauaacauagcuggaagcacagaaagcagguuggagcuaacggaacuggcuguuauccacuaaugucuaaaggagggaaguaaaugugaacauauugugugaugcagacacagagauacaguagaugcacuuaaccuaggaaaacguaaccauauacaugggaaaacaauguaaauggugcaagacauuccacucgaggagcagcuguccuggaaugagaugggaaacuugaaucugcugcucccccaguacuaggucuagacuugauuucaacugagagcuuaccuggugcuugaagauacagugcggccaaaucauacacacguuuaaccuacaugacuccgaauccucacaagggaaaaaauaagacuaauuacuuagguggcuccugcacucaguacuugcaucccauuggcaagggaugccaucaagccugaaacagucaagaagguggccaaaacugagggaggggaaggugaguggcuuuaagagugucaugaccauuaagaaaaggcuuauccaacgugugaugauaucaguauccaacuucucaaggaagaagcugaggaauuauaugaggacacagaaaaacacagacuaaagaggaguuagaggaaaugauacaucaauuacaaagauaaccaugaaaaagaagaaucgggaaguuggaaccuuccuagaauugccauuguucuaagcagcaacaugcuagauuaauuucuaaauaagguuccuugaaggaauuacauacugagcauuacuuuguacauuuuauauuuaugcaugcaucuugcuguauaguguuuauaacaaaaccacgucuacugcaugcucacaggaaaccuaagagauuuucuuaagagcauauuuagacuaggcuuuaccuugcuugcugacuuaucccucagcccaaguacuaaauuaucacauuuaguacucaauuggagagacaauaauuuauucuaaaacugaaaauaaacacugcuuuuugggggcaggauguuggucucuaguaaggcacuuuuugaaagacuuccaggaaugguuuggacuuuuaugggauuuuucacuuuuauaaccucugcucagcagcugacuuauauacauuacauucggaauuuuaaaaaaaugaaaaaagauuuaauggccaccuucaagaaguucuaauaaauucucucaacaaauaagaguuguauuuuagucugccucauuuguucagcguuuuucccucucagacugcugucacaucuaaaaaaggcaagauuuagcugugacacuugaucgaaagaacucuguacuccaacccaggugugugggauggaagggucccugcgacaaaacaccccucauaauccaaguucuuguguuacucuugcucauguggcugcacaccccucaggaauuuggcucgcaguaggccuuccagacaugcaaagccgccauuauuauugugugaccuugcacaacccacuuucucuaagcccaguuucaucuucaaaucgaacaggacuggaggagucuggcaguuccucaaaaugucaaacacauaguuacgacaugauccagcaacuccaccccuagguauagaccuaagagaaaugaaaacauauguucauggaaaaauuuguaugugaauguucacaacaguauuauucauaauagcaucaaaguggaagccauccaaauguccaucaauaguugaccagaucaacaaaauguggucuauccauauaaucaaauacuuagccauagaaaaggaaugaaguucggauacauucuucaacaccugaaagcauuaugcuaaaagaagucagacacaaaagaccacgagacaauuaagauaaaguuuccggaauagacaaauccauagagacagauuaccaguugccagagacagggaaaagugggaaaugggggggcgacugcuaauaagacaggagguuuauuuuggagggugacgaaaauguuuuaaaauuagauuguagugaugguaaugguuacauaacuccgcgaauacgaagaccacugacucguacauuucagaagggugacuuuuacagaauuauaugguaucucaauaaagcuauuuuaaaaaauucagaaguaaagacauuccccaggccauguccugcaagaaugacuucacagauaccagcgugaagcuucuagaaaagauagaaagaaacccucagggaagguagagcucacuuccccagggggaaaaauucaagaggacaaaucagaugaucucuaguuucauggaagaguccuccugugcugaacucgaaaggcaaagcagaggagaaaagacugcauuuaccauuccccauaucugcaauggauauucaagaagguucuuuagugucgcggcagaacagcaugcuguaagaggugggaugugaguaaaauaagaagaggaaacugucauagguagguaccagaugccagaggcacucacugcaugugcugcacauguggguacuauagucaucccuugguauccacagaaggacugguuccaggacucacccccuaccaaaauccgcagcucaagucccuuaaauaaaauguaguauuugcauguaacuuaugcccauccucccaucuacuuuaagucuucucuagauuacuuagaauaccuaauacaauguaaauacuaaauaauuguuauauauauauauuuuuaaauuucuuuuuccaaauauuuuugaugcaacauugguugaauccacagauucggaaccugauagcgagagcugacuguacuauccucauuccacagauaugaaagaagagcggugccugaggugcacaaaaacauauaggaaagacugggucaguugucaagagguuugggaugcaaagguugguuuggaauuggagucacugcagguuauuuagaaugaugauugaaaaaugcagauuaagaaaauuaaaccugggagugguacaucacacaguggcccucaagcuuaccuacccuuaacuccucaugcccaggccucaccugcaaucaauuacaucagaauuuccuggguggacccagcugauuuuaacauauagcuaaccacugguaacagcaaggucuauucaaauucacuuaaucccaguagcccccggagguaaagacuauuuuuauuuccauuguacagauguggaaagugacucggaggggccgggcgcaccccugagaaaucuuuacuucuuauuuccccaaccugcgcaaccugacuccagagcugcauauucuuacuuucuauuaaaagcagagucuguuucuuauucuucccucgagcacacaggcuaacaccucuuaggugaugguaaaugucuauuagaaaaacaaaaaagggagagguggcuccauuuaauuuuccaaccuuccuggacuaggugccaaacaaaccugguuaaaaaaccuccuacccagcaaaucucaccuucucccaaccaaaacacgcuucaagcuccaucugcgcaccuccugggcuuagggaggcaaggaugaaaggcacaagguaaacaauccugccucuggggagcuuucaaguuagaaccugagaauaagccauauaaacagaugaccagccuuugaaaguuguugucaggauuaaaugcauaauuuugcagaaggcguuucguucggggccuaccacguggaaagcgcucaccagacgacagcugcaaauaaaauaaacugcgcaccccaacagcguuaggggccccgccaauuccuaacucccugucuuaccccuuugcuucuuuccuugacuacccccacacccgaccgaacuccaccagaggcugcggcuccucucgggcauugucagcugcaccuugcgccccagccccaccagcccugaacaaggcgccggcguuuccaagaaccaagggcugcaggcgcacgaggaaagcgcggaggagucagugaccgggcgcacucggaagccuggcuccccgucccggcacugucucggccggcugugcgaccccagcacaguaccuaggcccuuuccucucucgcccuggaggacuuucggaagagcgagauuuccuuucgcugcaaaacaccaaacucggaaagggccgcgcuuuccucgcccagggcccuuaccuuucuu

SEQ ID NO: 191675 - RNA, 80601 nt, Homo sapiens
agaaucggagagccgguggcgucgcaggucgggaggacgagcaccgagucgagggcucgcucgucugggccgcccgagagucuuaaucgcgggcgcuugggccgccaucuuagauggcgggaguaagaggaaaacgauugugaggcgggaacggcuuucugcugccuuuuuugggccccgaaaagggucagcuggccgggcuuuggggcgcgugcccugaggcgcggagcgcguuugcuacgaugcgggggcugcucggggcuccguccccugggcuggggacgcgccgaaugugaccgccucccgcucccucacccgccgcggggaggaggagcgggcgagaagcugccgccgaacgacaggacguuggggcggccuggcucccucagguagguggcaggaccgggucguggaugccgggggagccgggcggcggggcugagggaucggcuuccagggcgaccgggccuggguggcgcugauggagcggccccgcggcugccgggcagagggcuugggccaggccguugucacccugggguagcguugggcgggggccccggaguccggugucauggccggcgagccgaguucccacaucccacucaaauuuccuuguguuuggcggaaacgugccaacgccacccuuaugccaugcgcauuccucauauuuggcagugggaaaauccgcccagagcugccccauaucuguugucacuuggaugggccaauuccuuuucucuugggccgccgaaugugggacccgggcuugcacccuuucucaggguacuucagucaagugacacccuuuuagagacgacgugaggaaucggguaagagaggaggaaacuggccagugcccuaccacaaaggcacaggggccucuucuuggguaucaggacuagccuuggguaucaggacucuggguuauuaaugaaagguuugggauacuuauagaggauuggccucaggacgcuuuggaaugaagagccagggcugucuuuugugugacgcgagagccgccgggacgcuucagcucugcagcugcugaggcucugcgagcgagucgaugcccaagagagagggguuuggacgucgugagaggcgaggcggccguguucauucauuguucucguucuagggcucugggugugccccugguauucauucuguggugggaagaaggaauggaacuuaguguauccuugagaugugaacggguucuagggggucacuuaaucuaaguggaaaaugaauucaaggcacguucauugagcguuucugcuugccugguccucugugggcugaguggagagacucugcccucccugcgcuccuaaggcgugaaaacaaugcagugugauaagaauuggcuuaucaaguguuauggggauuuagaacaguuaguuuugcuuggggaggaguugaggaagcuucuacacucgaggagacuucugagucgaguuuugaaacaccugugaguaagugcucaucgggugaggaggagcucagggaacagcugguacaaaggcuuagagccaugugggaguugggaugaguuuggggagcagcaaauugccuggggugcaggaaggaaauggugagagaugagaguaaaauaaaaguugcuagaauugugagggggcugucuuuguuguagauagugaacuaguugaauuuggauuauuguacauggguugccgagucuucauucuugcugauaauuuucucccuuuguugauguugaagcugauagugauugaacauauuuaguuuaacuuaguuaaugacuuuuaaauuuuuuuuuauuuuuucagaacaaugcaaacuuuuuuuuuuuuuuuuuuuuuuuuuuuuuuuuuuaaaggaacaggaucucacucugucgcccaggcuagagugcaguggcaugaucauagcucgguugcagccucuaacuccugggcuuaagcaguucuccugccuuugccuccugaguagcugggacuacagacaggugccaccacacauggcuaauuaaaaaaaaaauaguagagauggagucuggcaguguugccuaggcuggucucaaacuccugggcucaggcgauccuccugcuuccaccucucccucccaacgugcuugcugggauuacaggggugagccacuggccaggcagaacuuuuuuuuuuuuuaaauaauagagagggggucacacuauguuggccaggcuggucuugaacucuugggcucaagugauccuccagcuucagccucuuaaagugcugaaauuacaggugugauccacugugccuggcuagcagaacauuuuugauaaguguuuuauaucaaauguuuugacuuacacaguggugaaugaauugaacucauauauuccuggggauucuugcaaaaaauucucuuaaaguuauacuugcucacaaaaauguuaacuuuauaaauguagaacacucuccuacuaauuuuuauuuuauuauucuauuguuuuuuauuuuuuugcgacggagucucacucuguugcccaggcuggcgugcaaugaugcgaucucggcucacugcaaccucugccuccuugguucaagcaguucuccugccucacccuccugaguagcuggguaggcacacuccaccacgcccggcugauuuuuguauuuuuaguagagaugggguuuugucguguuggccaggcuggucucgaacuccugaccgcaagagaucugcccaccucggccucccacggccucgcugggauuacaggcaugagccacugugccuggccuaaauuuuaaauauaaguaauguacuccccagucuuacagaaauuggacgacuauagaaaacaaacaucaaaaaaaguguagaaugugaguauuuuuaguuuaauaaguguauuuuauaaacuauuuauuuguauugacuucucggauaacaaccuguuauaaaaucuuuauccccauaaacauaauuuuccuaaaauagcuauaauauugugauuaauguuuaugcuaaagugacuauuauggaauuaacagacuucaguugcaguuucuaaaucuugcuuugguugugaugauuauauaccacugaagaacauucaggauuauuuuggcuuguuuuuacccuuaucacucaagggcuaagcuguuuaaaaugcaacauaaacauuugacccaguugaaugcugggauacuuggaaaaauaaaccuguuacuguuucuguacuaaaggcuuaucuuuuaaagauaugugguguuuuuuuagcgcaguggugcgaucuuggcucacugcgaccucugccuccuggguuuaagcauucuccugccucagccuccugaguagcugggacuacaggcgccugccaccacgccuagccaacuuuuauguuuuuaguagagacgggauuucaccauauuagccaggcuggucuugaacuccugaccuugugaucuacccgccuuggccuugcaaagugcugggauuacaggcgugagccacugugccuggcugauaugugguguuuugugauuauaaauuguaguggaguuccuuaguuuuguuaaagucuugucaguaguuguaaaaacaucagccaguugugguggcucaggccuguaagcccagcacuuugggaggccgaggcuggugaauugcuagagcucaggaguuugagaccagccugggcaacauggugaaaaccugucccuacaaaaaauacacacacacaaaaagaaaaaaaucagcaggguaugguguaguaugccuguagucccagcugcuugggaggcugaggugaaaggcucaccugagcccagggagauugaggcugcagugagccauguucaugccacuguacuccaguguuggugauggagugagacccugucucaaaaaaaaaaagugugccuucaauagaaggcuugaacguauuuuaugggauuugguuuagcugaaaaaaacagugagaagcagauuaagcugguaauuucugacaaaaaguaucuaaaagaugaagugaagaauguuaaacaucaaguauuauauuacaguugcucuuagacuaguagcuuuuaguuuauaacaugucauuuguuugcucugaagauuaagcaaguucauacuucuuggaaguuaaauuugacuuuuccagaagcacuggauuauuuacgaaauaaaaaauauaauugauaacuuuaaacuacuauuucagguagucuauuacuaguaaauguaugauucuacauuuaaauuucagguaaaucuuuguuaguaaccuacugccuaaaaaaauguuacaugagggaguacuuuuguuugcauguuaggaucauaauaggccauacauaauaaucuugagcuugggaggagcuuguuagccaaacagcaugccuuaauguugacuugcagaagacaauuuuaaauauugccuuugaaaggcaguggauaaugugacagugaggggguuuaugaaaccauaaaauugagcuuuuugacuuaguuuuuguuuuuaaguuguucagaucuugggagucauuucuucaaaacaaaugacuaugagguggaaaauuacuuaccuugaauaaauuaauuggaaaaucagagaacacuggguuuauuuaggaugagguuguuugguauguguaugggaggguagaauuccuaauugcucaucugacuggguucaaaauguaauacuagauauuuguguugcaauucaguugguacuuuugguauagggcuaacuuaucuugcguguaauuuuuuuuuuuuuuuuuugagaugaaaucuggugcuguugcccaggcuggagugcaguggugugaucuuggcucacuacaaccuccgucucccagguucaagggauucucaugccucagccucccgaguagcugggauuacaggcgccggccaccuugccuggcuaauuuuuguauuuuuaguagagacgagguuucaccauguuggccaggcuggucuugaacuccugaccucaagugauccaccugccucggcuucccaaagugcuggcauuacaggcucgcucaggcaucuugccuuguaauucucaugauaguaauggcuauuuuuuucuugccuuagaguuguaaguaaaaauuccuuaauuacacauuaagguuugaucuuuaauuuuacaauguuugagucauuuuguuacuucuuuucucccagaaugacuugcguagcucuaaaugauuuuaguuaauuucacaucuguuugccuuucuucuaaaaugaccccuagaaucucagcuuaacuaaggaaaaugucaaguggguguuguuucuuuguuagugguuuuggccuagacuaucuaaaguuuggcaaauuacucacaaaguauguuaauuggcaucacauuccaaucaguguacauagcauuuuuugaggaacacuugacacacgguuuuauuuuuagaccagauucuaagggguuuuacuggguggggcuuaacaauccuaaagcuaguuuacgguuuuaaaaucuuuaugauuuagagguuguuuacauuuuuuguuaauaaaugggaagcagcaggcaguggcagucaauuuuguuuguuucuuuuuuuguuuuuuuugagacggaguuucguucuuguugcccaggcuggagugcaguggcaugaucuuuccucaccacagccucugccuccuggguucaagcgauucuccugccucagccuccugaguagcugggauuacaggcaugcgccaccacaccuggcuaauuuuguauuuuuaguagagacaggguuucacuguguuggucaugcuggucuugaacucccuaacucaggugaucugccugccucagccucccaaagugcugggauuacaggcgugagccaccacgcccagcccucacauaacuuuuaugauauuauguucuuauaauuguuccauuauuaauuauaauuaaucucucacugugccuaauuuauauguuaaacuugaucauggguauguauguacaggaaaaaacauaguguauacaguauaguauacuguucuugcuuucaggcauucauugguagucuuggaacauauuccaaguggauauggaagcacuacuaugugauggaauguuacucaguaauaaaaagaaaggauguacugguguauacuacaacauuggaaacauauuaaguaaaagaaaccaugcaggaaagaccacauauugaauuauuccauuuauauguaauguccagaauaggaaaauccuuagugacagaaaguagaucaggggcugagggauguagggaauggucagugacugugauaggguuuuuuuuuguuuuguuuuguuuuguuuuguuuuuuuuuugggugauaaaaguguucuacaauuauggagauggauccacaacugugaauauaauaaaagccauuuuauuguguacuuuuuuuuuuuugagauguuuugcucuuguugcccaggcuggagugcaguggugcacaaucucagcucaccgcaaccucugccuuggguucaagcgauucuccugccucagccuccugaguagcugggguuacaggcaugcaccaccaugcccgacuaauuuuguauuuuuaguagagaugggguuucuccaugauagugagacuggucucgaacucccgaccucagguaaucugcccaccucggccucccaaagugcugggauuuacaggugugagccacugcgccuggccccugccuggaaauucuuaagaauuaaauauuauuuucuuugaguaaguaauaaugucagaugucacaaaauuuaaaggauauagaaaguuauguugugcauaguuauucuacguucuccuuuguucucuagcuacccagcuuccuuucacagagggaaaugugaauucuuauguauccuauuuugugacgacacaaaaauauuuaaggguagaugugcuggccuuacuuucuugcucaaaucuuccaggcucucccuggcuaccagacuaaguauauacaauucuugcuucugugucuugcucacauggcuuucucauaguaauaguauguuuaguggaaaucaaaagccaguauuuuuaggccccuguaggugcaggccagugcacuuggugcagcauaaggcaaguuccuaccuucaaggaccuuaucuaauugagagaggcugacauuuccuuacuuuuaucuauuccucuuuuuuuuuuuuuuccccgagauggaguuucacucuuaucacaaaggcuggcguacaguggcgugauguugguucacugcaaccucugucucccggguucaagugauucuccugucucagcuucccaaguagcagggauuacaggcaucugccaccacgcccggcuaaauuuuguauuuuuaguagagaugggguuucaugauguuggccagacuggucuugaacuccugacugcagaugauccaccugucucagccucccagaaugcugggauuacaggugugagccaccgcaguggccaaguugaauuucuuguauagaugucuuaugucucaguuuaaaaaugaggcaugucuuacucuugccuauauauuuccaguggggcaugucuuauccuuuuuuauauaucuccaguucucaaaaccuugucuuacacagcaaacauuaaucagagguuaaucacuuauggauuuaguuucacucuacugccaucucuccaaaaugcuuacaguaaagaggcuacacuuacuaaauucaaacuuagaacuuuguaacuuaggaccugucuguuggaggagguaaguugcuuaagcuucucccucuauugggcauuauauguagagugcucuagguucugccugcuagcuccuugaugacauuugccugcuuuagcaggacacugacucuucagcucaagcagcuguuaccaugcuggcuauuuccuuuugcauucauagguuuuagauauggaagaaaguuauacccagagagaauggggggauaaaugauaaucuucuaccauuuuugaccuuagucugguccagcauuauagugugauuuugagaggagagauugugauuucccuggcuaguauuaucuaguauugccugacaaugcaaaauggaccccuaggcugucuuauguaaguuggaagggggcggauugggggugggguguguguguguguaucuacaauccagugacauuuaacaacauucacaaugucuuaaaaccaucgccacuacucguuuccagaaccuuuuuguuaccucaaacagaaacaguacucauuaagcaagaacuccucauuccucccuaugcccaguuccucguaaccccuauucuacuuucucucuaugaauuugccuauuccagguaccucauguaaggggagucauacacuaucuggccuuuuuugucuggcuuauuuuacuuagcacauuuuugagguuuauccauguggugguggcauguaucuguauuuuauuccuuuuuauggcugaauaauauuucauuguaugaauauaucauuuuguuuaucuccucaucagugauggacacuuggauuauuuccaccuuuugguuguuguaaauaaugcugcagugaacauugguguacaaauaucuguuggagccccugcuuucagugccuuaggguaaugcacaggaguagaauuacuggaucauaugguaauucuguguuuacuuuuugaggaacugccaaacuguuuugcacagugacugcaccauuuuacauuucccaccagcaaagcacaaggguuccaguuuugccacaucuuuuccaacacuuguuauuuuuucuuuuuuaauuuuuaaaguaacaaucuugggcugggcacgguggcucaugccuguaaucccagcacuuugggaggccgaggcgggcggaucaccugaggucaggaguucgagaccagccuggccaacauggugaaaccccgucucuacuaaaaguacaaaaaaaauucgcugggcuuguuggcgcaugccuguaaucccagcuacuugggagguugaggcaggagaaucgcuugaacucgggaggcagagguugcagugagcugagauugcgccauugcacuccacaagagugagacuucgucucaaaaaauaaauaaauaaaauaacaacccuaaugacugugaagugguuguaggcuuuuugcauuuuaaaaaauuauuauuuuuacuauuuuagagauggcggggggggggucucacuauguuuaccagguuggucucgaacuccuggccuccauugauccucccauuuuagccuccuaaaguacugggauuacaggcuugagccacugcgcccagcccuccuuuucuucuuauugcuacuuagauguaaugggcaaaccagaaccuuugaauuuggcuauauuuggaucugauggguuuuuuccucccucuuaaacuuguguauaauguuguucaaagggauacauuauguacacaauuaaugacaucuuuuuaaaaagaacacuuucuuucauccuugugagguguaagaagaaaaauaagcaaaaaaaaaaaugaauaaaguuuuucuauaaguugauacacacaguuguaguuacuuuauacucauacccuuuuuuuguguugugagugacacagucucacuccauugcccaggcuggagugcaguggugcgaucuccacucaccguagccuugaccucccaggcacaagccaucuucccuccugaaccugcugaguagcugggacuacaggugugugccaccacacucagcuaauuuuuguauuuuuuguagagaugggguuuugccauguugcccaggcugaugucgaagugcugagcucaagugauucucccgccuuggccucccaaaaugcugggauuauaggcaugagccacugugccuggccucucauacuuuuuuauucuauaauguauuuagggccagccucuguggcucaugccuauaaucccagcacuuugggaggccaaggagggaggauugcuugaggccaggaguucaaaaccagccugggcaucauagugagaccccaucucuaaaaccaaaaaaacuagucaggcaugugguaugcgccuguagucccagcuacuugguaggcugaggagagaggauuguuugaguccaggaauuggaggcugcaauaagcuaugauugugccauggugcucuagccugggcaacagaacaagaugcugucucuugaaaaaaaaaaaaaagaaaaagaaaagaugaauagucugucugaaauggccggcagucgcagcugcugaccugaccugcaucuacuguauaagucaaguaguucaacuuuuuauuauaaugucauggcuuuucuuugcuucuugggagcgcuuccagcaucacuagugguacuucauaugggacccaugcuguuauucaaaguuuaugguauuguacuguacaugaugaaaaauacagaagacccaugagagaugacuuuuuuuuuuuugagacauagucuugcucugucgcccaggcuggagugcaauggcaugaucucagcucuccucugccuccuggguucaagugauucuccugccucagccucccuaguagcugggauugcaggcacucgcuaccacaaccggcuaauguuuauauuuuuaguagagacaggguuucaucauguuggccaggcuggucucgaacuccugaccucaaguaauccaccagcucggccucccaaagugcuaagaugacaggaaugagccaaugugcccagccaagagauaucacuuuuuacugcaauaggaaauguacuggagagaccaacugcucagagggacacaaggccuuuuaaguggacacaugcaacuuguaacacuugaguucacugcaauagaaagaagagguggcuaugaaauuacuguaguaauauaguuuguacaacagguuuguuuucuuuugaggcaaagucucacucugucacccaggcuggagugcaguagcaagaucucagcucacugcaaccucugccucucagguucaagcgauucuccugccucagucucccaaguagcuaggauuacaggccugugccacuaugcccagcuaauuuuuguauuuuuaguagagaugggguuucacccuguugcccaggguggucucaaacuccuggccucaagcgaucuacccgcaucauccucccaaagugcugggcuuauaggcaugagcuaccgcacccagccaacaucauuuaauuuuaugcaguuauuuauuuauuuaauuaaaaaaauuuuuuuuuuuugagauggagucucacugucuugcccaggcuggagugcaguggcuuaaucuuggcucacuguacucacugcaaccucugucucccagguucaagugauucuccugccucagucuccugaguagcuguauaacaccuggcuaauuuuuuguauuuuuaguagagacaggguuucaccauguuggacaggcuggucucaaccuccugaccucaagugauccacccgccucugccuccccaagugcugggauuacagaugugagccacugcaccuggcuucaguuauuuaauaugcugcaguuauuuaauauacugcaucuuaacauuuguuuacauuucucucaagugugaaugugugucugugcaaaugguguuauguauggucuguaaguauaugcauaaguuuugauuuuuuuuuucuuugagaccgagucuagcuuugucgcccaggcuggagugcaguggugcgaacuuggcucacugcagccccugccuccuggguucaagugauucucuugccucagccucccgaguagcugggauuacaggcaccggccaccaugcccaguuaauuuuuguauuuuuaguagagacggggcuucacuguguuggccaggcuggucucaaacuccugaccuuaugauccgcccaucucggccucccaaaguucugggauuacaggugugagucacuacgccuggccuauuuuuauuuauuauuguuuuuuugagauggagucuugcucugucucccagguuggagugcaguggcaugauguuggcuuacugcagacucugccuccuggguucaagcgauucuccugccucagccucccgaguagcugggauuacagguacucaucacccugcccagcuaauuuuuuauaucauuuauuuauuuauuuauuuauuuauuuauuuauuuauuuauuuuagagauggaguuucgcucuuguugcccaggcuagagugcaguggcgcgaucucggcucaccacaaccuccaccuccuggguucaagcaguucuccugacucagccucccgaguagcugagaccacaggcaugcgccaccacaccuggcuaauuuuguauuuuuaguagagacggguuuucaccauguuggccaggcuggucucaaccuccugaccucaagugauuugcccgccuuggccucccaaaaugcugagauuacaggcaugagccaucgugcccagcucauauuuuuaauuuguuucccucccucuuugaacauguauucugugaucaauucguguaucuuuuuuuuuuuuugagaccaagucucgcucuauugcccaggcuagggugcaguggugcgaucucggcucacggcaaccgaucucagcucacugcaacccccgccucccggguuccagcgauucucgugccucagccucccgaguagcugggacuaugggcaugagccaccacgccuggcuaauuuuuuuuguauuaguagagacaguguuucaccauguuggccaggcuggucucgaacucuggaccucaggugauccacccuccucggccucccaaagugcugggauuacuggcaugagccaccacacccagcccaauuuguguaucuuaaaaaauuauugggaaaagaaauuauugcaaaaaaucuauauauauugguaugagauuauaagcauguagggaaacacugaagaauaauugguuauugggagaaggaaaggaaagauaaaacaaagaagggguuaaaagauccccucuaauacauguaauguuuaagugcuauagaaaaaaagcaggguaaacauuuuagaaguaaaaaggcuugcuauuuauaaugagugccuuuguaaagacauuaauugugaauauuuaaaauaaaaggaaacaaaguuauguaauaagaaaggcuguauccuucaucaggcucauuucuuuaccugcuugucugugcuuauucccugggcacacuuuagcuuuuguuuuaccucugcguuagucuguugaaauauugccccuuuaagcucaaauacacaaugaaauauccuugucuaccucuucuuccacucaagcuagaagugaccuuaccacauuucagauucuuauaguauguuucuuaagaauccucccuaccuuuaauuucauauuuuguuguaggccuacuugucuuccugaaagcucuuagcccagugccuagcacauauucaauuuuuguuaaacgguggugguuuuuacuucuacuuuaagggguucugaaaugcaaggaccaugucucccugaacuuuauauuccucaaagcagcuaacaguugaaaguagauucuuagaaauuguugaaugaauggugcucuuuauucuuuuuuuccuuucauuccaugcuggguuacagucuauagagaggcauucugguucuuuagauuuaugugauagugauucgguauucaugaaaaaggguuaggaaaauauuguaauuguuaacuuuucuccauugauauucagcagauauuugaguaccuaauuuugugcaauguccuauacuggaugauggauuauaacaagauuauaggaaauacauguaguucuucaaugcuuugguauauaauuauguagguuauauuuucuuuuuugagaugggguuucauuuugucacccaggcuagagugcagugaugcagucacggcucacuccagccucgaccuccugggcucagacaauccuucuaucuuagccuccugaguagcugggacuguaggcaugacuaccaugccugauuaaauuuuuuuuuuuuuuuuuuuuuuuuuuuuugagauggagucucgcacugucucccgggcuggagugcaauggcgugaucuuggcucaaugcgaccuccgccuccuggguucaugcaguucuccugccucagccucccgaguagcugggauuacaggcgcccaucaccacaccuggcuaauuuuuuguauuuuuaguagagaugggguuucacuauguuggccagacuggucgcgaacuccugaccuggugaucugccugccucggccucccaaagugcugggauuacaggcaugagccacugugccuggcugcccagcuaauuaaaaacaauuuuuuuguagaguugauguucccccucaguugcccaggcugaucuggaauuccugggcucaagcacuccucccaccucggccucccaaaguguugagauuacaggugugagccugacccuagguuauauuuuuguguuucauuuacuauuuuauccucuggcaaaauagcaggguauaauuuagagcuuuaaugaauuaaugguguaacuaacagugaaaacugugugugugugugugugugugugugugugugacagucucuggcccccaugcuggagugcaguggcacgaucauagcucacugcagccucaaacuccugugcucaagugauccucccgccucagccuccuuaguagcugagacuagaggcaugugucaccaugcccagcuaauuuuguuuuauuuuuauaaagaugaggugucacucuguugaccaggguggucuugaacuccuuggcucaagccauucuacugcuuugauuucccaaauuacugagauuacaggcaugaaccaccaugccuggccagggaaaaauuuuaaacaugucuuucuuuugagaaaauuauuauugaaaaguugguuaaaaguaauuucugaagaacaaaugauauuaucaguuuuacaggugucuuacuguaacucuuagaaguuguuaaaguuuacuauugagcgcaccacuaaagacuagggaauuuuucuuuuucuuuucuuucuuucuuuuuuucugagacugaguuuugcucuuguuacccaggcuggagugcaauggcgugaucuuggcucacugcaaccucugccuccuguguuccagcaauucuccugccucagccucccaaguagcuggcauuacaggcaugugccaccacgccuggguaauuuuguauuuuuaguagagacuggguuucuccauguuggucaggcuggucuugaacucccgaccucaggugauccgcccacgucggccuccuaaagugcugggauuacaggcgugagccaccgcauccggccgaugggaauuuuucuauuugaaagccauugacuccagaaggaaguguaggggagcuggcugaaucagaugguuacuuuuuuuuuuuugaagcagaaucucacucugucacucaggcuggaggacaguggugcgaucucggcucacagccaccucugcuuccuggguucacaugauucucgugccucagccaucugaguagggaauacaggugugcaccaccacauccggcuaauauagaugguuacuucuugaaacugcuuugguaagauguaaacuugggggaauaccucuucucuugaggacacaucuccucugccaaaugagugaugccaguguguagaaugaaugauucacuuauauucuguguccuuaucuuugaggagggcuaauuuuuuuuaaccacuuguugaauaugcaagauuuacugugaaaauuaaugccuuuaguaugaaagagaaauuaguguggaaauuguuaguguuuccaggugauuuuuuucccccuuccuuccuacuucauuauguagcuuuuuuuuuuuuuuuuuuaacuucgcuguuacuuggcuaucugaauaaucauuccuaaaccauauuuuauuuguacauuguguguuuugguacuuguguuaaugguguacuuugaauacacaucuguuuauuuuaaaaaucagcaguugcugacuagaugaagaaaacaaugacugauuugaaggugaaaagaaaaacucggguuaaaaaagaguccagacaaugugauuuaaaaugaaaauaauuuaagcuuauuuguggugagaguuaaaaauaaaguuggcuccagguaucauuuguggaacugauuuguuuuagcauaauuguuuuugaacuagcucguuuuuaacuuguauuuuuaaaguuacacuuuuaaaauguaggagucuguuuuguaaacuuguacagccccugcuaacuuuuagaagaguagaguggcuuauuucuucauguguguuuauucugggcugucaucugaugaaguuaccaguuuguggucagaaauugagaaagaggagugaggaaacgaaaaauauugacacguacacaucaccuugcagugcaugagagugcccuuuuggacugguuaggaaacuaacauuugagcauauuugcucagcagaaacuuuuuaugugugaaaguuauuuuuuuuccaguguugugaccacuuaaaauuuauuuauuuguuuuguuuguuuguuuguuuguuugagacagggucucacucuguugcccaggcuggaaugcaguggcacaaucauggcucacugcaaccuggaccucccugggcucaggugauccucccacuucagccucuugaauagcugggacuacacaugugcuacaccgugcauggcugauuuuuuguagagaugggguuucuccauguuguccaggcuggucucaagcuucuaggcucaagcagucugcuugccucaaccucucaaagugcugagauuacaggggugagccaccaugccuggccugaauuucuuuuuuuuuuuuuuugagauggagucucgcucugucgcccaggcuggagugcaguggcgcgaucucagcucacugcagccuucgccuccuggguucccgccauucuccugccucagccuuccgaguagcugggacugcaggugcccgccaccacaccaggcuaauuuuuuguauuuuuaguagagacgggguuucaccauguuagccaggauggucucgaucuccugaccucgugaucugcccgccucggccucccaaagugcugggauuacaggcgugagccaccacgccuggccgguaaugaagauuuuaauaaugacuuuaaaaaccaggcacaguggcucacuccuguaauccuagcacuuugggaggccaagguggguggaucauuugaggucaggaguuugagaccagccuggccaacacauugaaacccuuucucuacuaaaaucacaaaaauuaggcugggcgugguggcucacaccuguaaucccagcguuuugggaggcugaggcagguggcuccugaggucaggaguuugagacaagucuggccaacauaguaaaacccgucucuacuaaauauacaaaaaauuagccgggugugguggugugugccuauaaucccagcuacucgggaggcugaggcaggagaaucaugugaacccgggagguggagguugcaaugagccgauauugugccauugcacuccggccuggcaauagugugagacucugucucaaaaaaaaaaaaaagacaaauacaaaaauuagcagggcguugguggugcgcaccuguagucccagccacucaggaggaugagguaggagaauuacuugaaccuggaggcagagguugcagugagcugagaucgugccacugcacuccagcgugggugacagaggaagacuccaccucaaaaaaaagacuuaaaagaaaccgguaauaucguuauuauauuucugccugucuuaauucuuuauccauuugcuguagauuauaauguuagcugcaugaaugaaagauuauauuuuuccagcuacucaggaggcugaggugggaggauugcuugagcccaggaguuugaggcuacagugagcuaugaugaagcuacugcacuuccagccuaggugacaaagggagacuccgucucuaaaaaacaaagauuagauuuuugauacaccaucuauuaguauauuauuuaaugaguaaaaagaaaggauaaguuauaaaaaagcauuaagaauaugacugcucuaaugaauuuaagcuaaauccuuuguuguuuagaagugaaguaaaaaucucuuaaauaugaagaaaaauuuuaauugcuugugauauauaagacaugguauauacagucuuuuucuuuccuccacacagaggucugaugcauuauuuacaaacaauauuuauuuaaaaguaauguaauaagccaggcacaguggcucaugccuuguaaucccagcucuuugggaggcugagcugagacgcugcuugaggccaggaguucgagacuagccugggcaacauagugagacaccccccucaccccaccccaccucuacaaaaaaaagauuaaauaaauacaguacaguacaauaauuaggaacucuucuagauagcucuuaaacuuccagccuggguuuuucugaguucagugccuaaaacucuuaaccacuacauuacuguauuccaaaaauuaaguccuagguuucaaaguacagaucaacugugaaaaacaaacaaaaauuuuaaagguaauaguaacaucauuaaacaauaaaaauuucaaaucccauuguaccauucaaaucaguguauuauaauggaaagagauguaaagucugaguaucugaauuuuuaauuuugcuucucuuaaauugucacuaaaccuuuugaauuuuacuuuuuuucuucaucaaaaaaagggauaguaugaauaauaccugcuuuagccugcuuaauucuaacaguucugugagauaauggaaagaugagcugaauaaauuguaaagcuguguuaaauucugaguucucuugacuaaguaaacuuuuuugagucggaacuacacaaaaagcauugcuggguucucagaaguuagguuuuagguagaucuaagaaucucuuaaaaccuuaauaccaaaaggcuggcuaccuuagauauuuuuguccugccaccuuauuuuuuuuuuuuuuuuuuuuuuuugagacugagucucgcucugucaccaggcuggagugcagugaugcgcucuuggcucacugcaaccuccaacucucugguucaagcaguucuucugccucagccucccgaguagcugggauuacaggcacgugccaccaugcccagcuaauauuuuguaucuuuaguagagacgagguuucaucauguuggccaggauggucuggcucucuugaccuugugauccacccaucucugccucccaaagugcugggauuauagccaugagccaccacgccuggccgccuuaauauuuuugagugaaauauaguauuugaggaaaaacucaaaaaugagguuuuucaaagugccugauuauaaugauugauuugcuaaggcguuuuugaagaaaacuuaaaaauguccaugccugaaguauuuacauuguuuauugcauguggguguuucccuacucagaaagggcaauaggaagauuugacugcuagcccuugcuaagcaaaaggauagagccaagggauagggcaaaacaaagucauccuuaacccuaaguuuguccagcugcuucuugacucucuuuuggacagaaguuuuaggacuuguaguucuuguacacuuaacuccugagaagcuugcugcauuagucagaauugugauaauucuuaccacuguccaaaggaaucuaaucucauuuuuugggagaguaguuggcggcaguacaauccaugagaaaacuuaaguggguguucuaguuuggcuuacuucucuagacguugauaaaauaacauuuucacugaaacauuuaugccucagauuuagcuuuaaugugacagauguaccuuaaaauauuaggauucaaaucacuuaaaaugauacccuaaguacagguaguaaguuuuuaauaauuguagucucuccagauuugacuugucccgaagcuacuucauuguacuuuguaugugugcugcucccuaauaaucuugcaccuugaacauaguugugcuuucuuauuuuuuacaggauaugauaaacugaaaaaaaccagcaaaaccuuuccaggguuuuugaaaguuuguugucuaauuuauaguuuauuaaucugguacuacuuaacuuauuuuuagaaauucucugaaugcaacaauucaccgaaguuauuucuagagguggaccacagggugagaaggcugaaaugacuguugaguugaaaaugccuuuaucacaacccuauauucuucuggauuaugagcaucagaauaaauuauacaagauuccuauguaagaucacuucucagcaauuuauuaggaauugcacaaggagguaaacuggauuucuuuuuuguuuuuauuuuuauuuuuuuuuuuuugagacagaguuuugcucuuguugcccaggcuggagugcaguggugcgauuuuggcucacugcaaccucugccuuccggguucaagcgauucuccugccucagcaucccuaguagcugggauuacaggcgccugccaccacgccuaauuuuguauuuuuaguagagaugggguuucacuauguuggccaggcugguuuugaacuacugaccucaggugauccacccaccccagccucucaaagugcugggauuacaggugugagccacugcacccggcuucuuuuuaauuuuuaaacaagucacuuuuuggcaaauauaguauggccccuauaguuacucuuuucuuacuuugauccuuaacauguuugcauacccaagaguguugugccugcuauauaaucuguuucuuagccugauggugcuuuguguagauugagauaugaggauuaugggauuagugcucagaacucugcaagcucucuggaaauacaguacaccuuuuugccuuagccagcagaauguuugugaguucugugcugaagccuggggguugagugguagauauugugcuuuuaucugacauuugauuuguugccugaggacagagaugcaguguuaugggugggaguugugucuugccuuaccaguguuuagacuuuuuaaaagauaauggaucuuacuucuugaaagaauaggagaugaaaaccaauguccuccugcuucuguucuucucuuucuucauagcuuuccacuuggcauauagcagaaaacucuuuggcuauauuuggugcauuuuguugguggaauuccucaagaaugcauucuugacuuuuuucuuuuuuuuuuuucugagacagagucuugcuguaucacccaggcuggaguacagugacgugaucauggcucucugcagccucaaccucccuguuaaggcauccucuccccucagccucccacccccuggcccugccccaauagcugggacuacaggcccaugccaccauacgcagcuauuuuguguguguguguguguguguguguguguguguguguguguguguguguagagauggugucucccuguguugucuggacugucuauaaaacuugacauucaacagucucuuguuuuuauucauugagaaacuggcuucauccuuuuacugaaaugggagaaguguuauuuaucuuacuguuuuuuuaauuaauuaauuuuuuuuuuccugagauggagucucgcucuguugcccaggcuggagugcuguggcgcgaucucagcucacugcaagcucugccuccuggguucacuccauucuccuccugccucagccucccgacuagcugggauuacaagcgccugccacuacgccuggcuaguuguuguguuuuuuugguuuguuuguuuguuuuuguuuuuuuguuuuuugggguuuuuuuuuuuuguauuuuuaguagaaaugggguuucaccguguuagccaggauggucucgaucucuugaccucaugauccacccgcuucagccucucaaagugcugggauuuacaggcaugagccacugcgcccagccuaaauuaauugauuuuuuugagacagaguuuugcucuuguugcccaggcuggagugcaauggcacgaucugggcucacugcaaccacugccuccuggguucaagcaauucuucugccucagcgucccgagaagcugaaauuacaggugccugccacuaugcccagcuaauuuuuuuguguuuuuaguagagacaggguuucaccauguuggcccagcuggucucgaacuccugaccucagaugauccaccugccucaggcugggauuacaggcgugagccaccacacuggguuccuaugggacuauuuuaaguuaacauccaggaaucuaaacuacaacuagcauuacguaguuacacuuaagaaagcauuuuuggggccggguacggugguucacauguguaaucccagcacuuugggaggccaaagcagguagcucacuugagcucaggaguucaagaccaacuugugcaacauggugaaacccugucucuaugaaaaaagcaaaaauuagccggauaugguggcacaugccuguggucccaacugcuugggaggcugaggugggaggaucccuugaaccugggaggcagagguuguaaugagcugagaucgcggcacuacacuuuagccugggugacagagcgagacccuguuucaaaaaaaaaaaaaaaaaaaccaaaaaacauuuuuuuuugggggggacauguccaccaaauauuuggaaauuguuauauuuccuguaaguggaacuauuuuuucuccauaucugaaaucuuucuguacauucuuuuuuuuuuaauacuuuaaguucuagaguacaugugcacaaugugcagguuuguuacauauguauacaugugccauguuggugugcugcaccaguuaacuaguuaacucauuguucacuuuagguguaucuccuaaugcuaucccuccucccuccccccaccccaugacaggccccggugugugauguuccccacccuguguccaaguguucucauuguucaauucccaccuaugugugagaauaugcggcguuugguuuucuguccuugcaauaguuugcucagaaugaugguuuccagguuuauccaugucccuacaaaggacacgaacucauccuuuuuuauggcugcauaguauuccgugguguauaugugccacauuuucuuaauccagucugucauugauggacauuuggguugguuccaggucuuugcuauugugaauaguaccacaauaaacauaugugugcaugugucuuuauagcagcaugauuuauaagccuuuggauauaugcccaguaaugagauggcugggucaaaugguauuucuaguucuagauccuugaggaaucgccacacugacuuccacaaugguugaacuaguuuacagucccaccaacaguguaaaaguguucuauuucuccacauccucuccagcaccuguuguuuccugacuuuuuaaugaucgucauucuaacuggugugagaugguaugucauugugguuuugauuugcauuucucugauggccagugaugagcauuuuuucaugugucuguugucugcaugaaugucuuuugagaagugucuguucauauccuuugcccacuuuuugaugggguuguuugauuuuuuucuuguaaauuuguuuaaguucuuuguagaugcuagauauuagcccuuugucagauggguagauugcaaaaauuuucucccauucuguagguugcguguucacugugaugguaguuucuuuugcugugcagaagcucuuuaguuuaauuagaucccauuugucaauuugggcuuuuguugcccuugcuuucgguguuuuagucaugaaguccuugcccaugccuauguccugaaugguauugccuagguuuucuuguaggguuuuuaugguuuuaggucuaacauuuaagucuuuaauccaucuuaaauuaauuuuuguauaagauguaaggaagggauccaguuucaguuucuacauauggcuagccaguuuucccagcaccauuuauuaaauagggaauccuuuccccauuucuuguuuuucucagguuugucaaagaucagauaguuguagaugugugguauuauuucuggcggcucuguucuguuccauuggucucuaucucuguuuugguaccaguaccaugcuguuuugguuacuguagccuuguaguauaguuugaagucagguagcaugaugccuccagcuuuguucuuuuugcuuaggauugucuuggcaaugcaggcucuuuuuugguuccauaugaacuuuaaaguaguuuuuuccaauucugugaagaaagucauugguagcuugauggggauggcacugaaucuauaaauuaccuugggcaguauggccauuuucacgauauugauucuuccuacccaugagcauggaauguucuuccauuuguguccucuuuuauuuuguugagcagugguuuguaguucuccuugaagagguccuucacaucccuuguaagucggauuccuagguauuuuauucucuuugaagcaauugugaaugagaguucacucaugauuuggcucucuguuugucuguuauugguguauaggaaugcuugggauuuuugcacauugauuuuguauccugagacuuugcugaaguugccugucagcuuaaggagauuuugggcugagacgaugagguuuucuaaauauacaaucaugucaucugcaaacagggacaauuugacuuccucuuuuccuaauugaauacccuuuauuucuuucucuugccugauugcucuggccagaacuuccgacacuauguuaaauaggaguggugagagagggcaucccuaucuggugccaguuuucaaagggaaugcuuccaguuuuugcccauucaguaugauauuggcuguggguuugucauaaauagcucuuauuauuuugagauacgucccaucaauaccugguuuauugagaguuuuuagcaugaagggcuguugaauuuuguugaaggccuuuucugcaucuauugagauaaucacguaguuuugauuuugguucuguuuauaugauggauuauguauguugaaccagccuugcaucccaggaugaaggcagcuugauccagcagcacaucaaaagcuuauccaccgugaucaaguuggcuucaucccugggaugcaaggcugguucaacauaugcaaaucaauaaacguaauccaucauguuccuguacauucuuuugcauucuacaugaccuuauguauguuuaaaaacacauuuuuacauuucuuuuuuuguauuuuuaggccguguuggccagguuggucucgaacuccugacuucaggugauccgcccaucucagccucccaaaguguugggauuacaggcaugagccaccaugcccauuuuuacauuucuugagcaggagcccuguaguuuaaaaguccccuuuauuuucagcaguguacauuuaagacaaaucggaugugugaguagguagaaaauauuuaccguuuacugugacagaacagaugaacaagaauguauuugguuuuauuuguaauauaaaacaacugugaagggaaugccaaacaauaguagugaaucaaacuuuggaaauaccucugacguagaauucuauaguagcuuuaauuggguauuauuaucagcuggucuguuugggacuuguuugaugaacuguuagaugacugacugccagccaaucauuauccuggcugcuccuuagcugacugccagucaacaauuacuccaugcugauucuacaguuuuuccacaguugucaguguucuaguucugaguauagucucuuggcauaaugugguucauaaacgacugcacugauaacuuuuguuagaacucaccacuugccagauagcccagaugccauauguuacucauucaguaaauaacucuuaagagccugccaaaugcuagauacuuaaaggcaguggguuauaagggugaacugaacuuagcuucuuagagcauacuaccuagugguauaggcagucaauaaucauugaguaggcaaauaccuaauauuauuucaaauggugauaaauuauuaugaaaaccaaaaagcugaguaaagagaagaaugauggggaaggguaggauacacuugaaccaggguggucaggggagguccuguuugauggguaacgggccaggccaucaugaaaggucuuguaggucacaguuaaagaauucgagugcuaauuugagugaaauaaauaauagauaaaggguauuuaauaauauguccaaauuuguguuuuuuguuuuguuuugagacagucuugcucuaucgcccaggcuggaguggaguagugcaauuucggcucacugcaaccucugccucucggguucaagcgcuuuuccugccucagccuuccgaguagcugggauuucaggugugugccacuacaccuggcugauuuuuguaucuuuaguagagacaggguuucaccacauuggccaggcuggucucgaacucccugaccucagguaauccauccaccucagccuccugcgagccacugugcccggccuccauuuguguuuuaagaacacaaugacugugcuccauagaggacagauugcuuucaaauguuaauagagauggaggcggguggaucaccugaggucaggaguuccagaacagccuggucaacgugucgaaacccugucucuacugaaaauacaaaaauuagccaggugugguggcaugugcuguaguccccgcuacuggggaggcugggcaaaagagcgaaacuccgucucaaaaaaaaaauguuaauagaagcaagaccuacaaagauguacauaugcauauauacaauacucuguauucaguuucuggaaguucgugaauucacugaaguucucagaaguugaaagauugaaguuaacccgauacccuaguuccuaggugauaaucuaguucccagguuuacuagugaguauaauacacuuaaaaauugagcgaguucagcuuuucacuugaagaauuuguuuuacuagcggagguacacaauuuuugcuaacuuagaauguuuuuuauaugccggacucuaaauuagguacuuuauauacacuaucuuauucauucuucacugcaauucagugaaguuuguaccauuauuaucuuuacccuagauccauggaguugcccaaguagugaagcuggauuucaaacucaguaccuguucuuuuaucuacuaaaccaaaaguguucaguauagucuccaggguauguaguauguaaugaaacuguuguugccgcugcuguucauugauguagcaaauauuuuuucuuucuuucuuuuuuuuuugagacaaggucuugcucuguuacccaggcuggagugcaguggcaugaucuuagcucacagcagccuccaccucccaggcucaagugauucuccccucucagccgcccagguagcugggacuacaggugcaagccaccaugccuggcuaauuuuuguauuuuuuguagagaagggguuucgccauguugcccaggcuggucuugaacuucuggacccaaguagucuuccucaucucagccuuccaaagugcugggauuacaggcaugagccaccacaccuagccaguguagcaaaugucccuuuuuuuuuuugagcaaccaugcuuacugcauuuuaauguaaucaaucaguuuuuuuuuuuuuaaagauauacagucuuguuauguugcccaggcuggucuugaacuacugggcuuaagcgauucuuccaccauggccucaagugauucucauuucucagccucccaaguagcuuggugguauguaccaccaaacccagcuguuuuuuuuuuuguuuuuuugaaauggagucucgcucugucacccaggcuggagugcagugucgcagucucagcucacugcaaccucugccucccggguucaagggauucuccugccucagcuucccaaguagcugggauuacaggugcccaccacaaugcccagcuaauuuuuguauuuuugguagagacgggguuucaccacacuggccaggcuggucuggaaccccugaccucaagugauccacucaccucggccucccaaagugcugggauugcagacaugagccaccacgccuggccuaaaaacaacauuauuaauguuuuuuuuuuugagguggagucucgcacuuucgcccaggcuggagugcaguggcgcgaucucggcucacugcaagcucuaccucauggguucacgccauucuccugccucagccuccugaguagcugggacuacaggugccugccaccacgccuggcuaauuuuuuguauuuuuaguagagaugggguuucaccguguuagccaggauggucucaaucuccugaccuugugauccgcccaccuuggccucccaaagugcugggauuacaggcgugagccaccgcgcccagccuaauaaauuuauaaaguaaucucucucucucuuuuuuuuuuuuuuuuuuuuuuuggagcuggaguuucacucuuuuugcccaggcuggagugcaauggcacgaucucggcucacugcaaccucugcuucccagauucaagggauucuccugucucagccucccaaguagcugggauuacagauguguuccaccacaccgggcuaauuuuguauuuuuaguagaggugggguuucaccauguuggcuaggcuggucucgaacuccugaccuuacaugauccgcccaccucggccuccugaaguguugggauugcaggugugagccauggccccuggccuuuuuuuuuuuuuuuuuuuuuuuuuuuuuuuuuuuugagacagggucucccucugucacccaggcuggaguacaguggcaagaucccgguuuacugcaaccuccgccucccgguuucaagcaauucuccugcgucagccuccugaguagcugggauuacaggugcacagcccagcuaauuuuuguauuuuuaacagagacaggauuucaucauauugcccaggcuggucuugaacucaugagcucaugcaauucacccaccuuggcuucccauagugcugggauuacaagugugagccaucguggcugcccuaguagaaagucuuaaagaaguauuaaacauauacuagcaccuaacugagacuuuuuccuuauaucaguuuuaguuuauaucuuguauacauaucucuuauaaucauuuuguaaaccaugaauaguauauauccccugcuuugggaaacacuguggugcuauacuauuuuauuaauguuguucagcuaccuggaguaucugaagaccuagcacagguuuuaccauucaccuccuccaaaggggagaggauauacuuaaaggggcuaacuuugaaaauaugggcuauuuccuucccuucucuguuacuccuucccucucucugcucuuccuccaaccacuuuccucccuuccucccucccuggcacucucaagaaaaaaaggccauuauguagaugauaguuggaaauugcuagaaggggucacauaauuguggauucuuguauccggugcacaguugucacccagggauuucccuccauuggccuucuggagauuuccuucgcuucuuuccuaugcuggaugucccguuuccuauauccuaagucuuucucuugcuauauuccuguaacaaaucccuugagaaaggaauuacgggccaggcgcgguggcucaagcccguaaucccagcauuuugggaggccgaggcggguggaucaccugagaucaggaguuugagaccagccuggccaacauggcgaaacgccaucucuacuaaaaaaaaaaaaaaaaauuagccaggcgugguagugugugcuuguagucccagcuacucgggaggcugaggcaggagaaucgcuugaaccugggaggcggaggcugcagugagcaaggucaugccacugcacuccagcaugggugauagagcaagacucaucucaaaaaaaaaaaaagagagaaaggaaucauggagguucaaauuuuuguaaucaugaaugucagaaaauaucucucuaguucugucccucacugauaguuuugcugauuauuguaaauuggagauaguuuuccuucagaaucuaggaggcuuugcuccauuaugucuucuaguguuguugaagaguuugaagucauucggauuccugauuuuuuuuguuuuuuuuuuuuuuuuugagagaguuuuuacucuuguugcccuggcuggagugcaauggcacaaucuuggcucacugcaaucucugccuccuggguucaagggauucuccugccucagccucccaaguagcugagauuacaggugcgcaccaccacacccagcuaauuuuuguauuuuuuaguagagacaggguuucaccauguuggccaggcuggucuugaacucuugaccucaugauccgcccgccucggcuucccaaagugcugggauuacaggcgugagccacugcgcugggccuguauuuuuuuuuuuuuuuuaacuguaaaaguuuauagaaucugguccuccauuauugugauauuuaacguguuaggcauucgauaggcuauuuuaaucugauaguucaaguucuuucauuguggauuuuuuucuuuuuucuuuuccuuucuuuuuuuuuuuuuuaauuuccagacagggucucccucuguugcccaagcuggagugugguggcacaacacaaucacagcucuuggcagccucgaccuccugagcucaagugauccucccaccucagccuauaccugggaguacaggcguucgccacuguguuggaauaauuuuuauaauuuuuuguagagaugagggucuuacuguguuguccaggcuggucuugaacuccuggguucaagugauccuccugccucacccucccaaagugcuggauuacaggccauuguggguuuuuuucucuguguguuuuggucuuuaucauccauauucgaggguuuccuaaaaagccugauauuccuuugcaaccucuuuauuuuuuuaaaagauaagauuaaaaacaaauuggaaucuuugggugcauggaugagauuuguugucuuugagcuuuauuguaagguaagggaaacuaaagauuuuaguuucuuugaguuugguugccccacuggggaaaagggguuucugcagucaaggauucaguaaguguaguuugcagaacaguauucauacucucaacugggucuggaauccuccagucaagagauccucuaauuuaccuucuccaggaauauaagccugggacuacuuuuuuuuguuuuuuccucuucacgucagauggguaauguguccaugucauuacaagguuugaagaaggcacaucucacacaugagugugaaaacucaaucaugcuuauaaacuacaaaaggaucagccugggacugaguuuuagagaguuucaagaauuucagaagaguuucagagagcucuucgggaacuagguuguugaauucuacuuuuugucaaagggguauaaaaaauagaaaauagucucuuucuuuuaaguugcugauggaaagcugacuaauguggaauucuuagaaagauuauacccacuguuguugguugccuuuaucaaucuguaucuuuaccuucucuaaacuuuuagaaggcuuugucacuuaagaaagaugaaguaguagcacaacccuccuuuuccagguuaaaccuacuucucccugccccaaaagaucagaaaaaaacagacagugauccauugcuucagaaaauaaguuuauuuugacaauucacccaagccuacucuuuuuuuuuuuuuuuuugagacggaguuuugcccuuguugcccaggcuggagugcaacggugcaaucucggcucacugcaaccucugccucccggguucaaacaauucaccugccucagccucccgaguagcugggacuacaggcaugcgccacuguguccagcuaauuucuguauuuuuaguagagacaggguuucaccaugggccaggcuggucucgaacuacugaccucaugaucccccugccuuggccucccaaacugcugagauuacaggcgugagccacugugcccugccaaaauuaaauaauuuauuaucaaacauuuaaaauuaaauuugaaggagaauauugugauacaguauuuggauugagaguguaauuguguaaaaguacauggguauguggaaaaggauuagggccacagccccaaagucaccauuacuaaauagaaaaaggucaauuuugaacagauguaccucugcagagauguagcucagcuagcaggaaaacuucuacaugugaauuagaaggauccccauccuucaugcuuaugcugucuguauacuagacacauggccuagcaagugaagcaugagcugaauuuccacccucucucaucuccugugguggguguucuucugugggauagaagcuauaacaguaucguuuacucuguguuaggugcaaugcuaagugcuuuacaaacacuacugaacaauuguguuuuguuuuguuuuguuuuugagauggagucucacugugucgccuaggcuggagugcaguggcgcgaucucggcucacugcaagcuccgccucccggguucaugccauucuccugcuucagccuuccgagaagcuggggcuacaggcgcccgccaccacgcccggcuaauuuuuucguauuuuuaguagagacaggguuucaccauguuagccaggauggucuugaucuccugaccucuugauccgccugccuuggucucccaaagugcugggauuacaggcgugagccacugcgccuggccacuauugaaccauuuaguaacaacucaauuagauaaauaauaucuuuauuuuacaguucuucugcccagacaucuucugaacuucauaauucuauaucuaacugccuaugucauuuauuuuuaauauagugagccaccacgccuggccaguuuuuaaauuuuuuuguagagacugaguuuugccauguugcucagacuggucucgaacucuugggcucauccgcccaccuugaccucucaaagugcugggguuagaggcaugaguuagugagccuggaacaauccuuuuaagauuuaagccuggccaacacagugaaaccccaucucuaccaaaaaaauacaaaaauuagucaggcgugguggcacgugccuguagucccagcuacucaggaggcugaggugggagaaucgcuugaacccaggaagcagagguugcagugagcagagaucgugccacugcacucccucugggugacaaagugagacccugucuccaaaagaaaaaaucuaagguagauugugccuuuugugccuuuccucugcucaagaccuuucaguggcuucccacuucacucaguaaaaggcaaaaaguccuuuuaauaaccuacaaggcauuauguuacccacauugucccugcuccccuacauuguacucaagucuaugaucuuuuuaccauuccuuguacaaaggauuuucacuggcuguucuuucugccuggaauguuguucucucaguuaucugcaagucagacucacugauuuccaggucucagcaguuaccucuucguugagaccuacugugaccucacuauguaauugcagucugccucccuuuccccagcacuuaucacccacuaucauggaauuuacugugaaugccuccagcagaagauaggcuucucuuaugaucauggauccuuguguuuuguucccugagguagcccaagcaucuugaacagugccugguacauaguaggcacucaguaauguuuauugcaugaauaagugacgaaaauugguauaugggaaagguaagcaauuuggugaaaggccaggccauacagcuaauaaaagguggagguagauuuugaacugauaguuauuuauugugccucuaauauuagaagaugauacccaaaaaaauguguuaggauuaguaaaauugugaguaacuuccccuuuauccuccuucccaaauuuaguuuuuguuuuauuguaaguaaaaauauaauuaggccagguguaguggcuuacgccuauaauccuagcacuuuggggaggcugaggugggagggucacuugaggccaggaguucaacaccagccugggcaagauagugagacuucgucucuacagaaaauaaaaaauuagcuggacucaguggugugcaccuguagucccagcuaaucaggaagcugaggcaggaggauugcuugaacguggcucaaggcugcagugagccaugaucaugccacugcacuccaaccugggcaacagacccagaccggucaugccuuagaaaaauaaacaaauaaaaguauaauuagaaacagauuaucagaguagaggaaagagccagauaccaggaagccagaguaggcugccacaagguugaaaucugucaccucaucuuaggaaccgccucucccaugaaugcacggaucuuaacauaugugauggugugaugaaacccuggugagauuugugaauauucugaauaccauguaaccuuggacauuuuuacuuaaccuuuaugguccauagauuccucacucuaaaaugauaauuucucuuauaggggguuguugggaggauuaaaagggauauuguauguaaagaacugauacauaauaagcauucuguauuagcuaauacauuagcuaauaucauuauuguugcugcugcuuaguugguacagaguuuuaagaaauuuauuuuuugguggauauaucuuguugccuagugaguuuuagcgaguaccaaaauagagagcaaacacuuauuguuuuuguucagauagccaaacaagcuuugucaaguguuuguguuuuuucauggacacuugcuugugguucuaauuuuauauuacaucuuaaacaauagccaacuuuuuguaauuauuuacauaaauuuuaauauuuaacauguggauucuacaacuaccauuguuucguugguuuugcauuuuugguugacuucuaugggucaguugauuuaaaaugauccauaggaauuaugauacaacugucaugauauuuaaaaauuagugaacuggcugggugugguagcucaugccuauaaucccagcugaagacaagcuggugaaucacuugaggucaggaguuugagaccagccuggccaacaugguaaaacccuaucucuacuaaauauacaaaaauuagccagcaugguggcucacaccugcaguccuagcuaccuaggaggcugaagggggaggaucacuugaaugugggaaacagagguugcagucagccaagauugcaccacugcccucuagccuggccaacagagugagaccaugugccccgccaccccccccccccaaaaauagucucagguucaucauacuuauaugaauagaaguuacugccaguguauccauuaaaguaucuucuacuuuaaaguagaaauuugaaugauaaauaaggucacaaaauaacuuacagugccugagaaaagaaugauaguauaauauacugagauuuuuuucuuauuaacacgauaaugaaauacaugaaaacuaguagaguugaguuacaugaaguaggaaaaaugacuuuuuaaaaacuuuuuuuuguagaguaggugucuaacuguguuguccaggcugguauugaauuccugggaucaagugaucuuccagcuucagccucccaaguaguuggggcuacaggugcaugccaccacacccggcuaguuuuuagauuuuguagagaugaggucucacuauugccaaggcuggucucaaacuccugggcuuaagugaucuuccuaccuuggucucccaaagugcagggauuagcccaggcuggucucaaacuccugggccuaagugaucuucguaccucggucucccgaagugcagggauuacaggcaugaacuaccgcaccuggccaggcuguaagcccauuuuauaacuugaauguagaaauaguuuuacacucuaacauuuuaauuuuugagacggaguuucacucuuguugcccaggcugaaugaagugcaguagcucacuacaaccucugccucccagguucaagcgauuauccugccucagccucccgaguagcugggauuacaggcacaugccaucacacccggcuaauuuuuguauuuuuaguagagacgggauuuugccaugugggccaggcgggucucaaccuccugaccucagguuauccaccugcuucggccucccauagugcuaggauuacaggcgugagccagugugccuggccacacucuaacuuucuaaaagaaauauucacauagggaauaaaugcaguugagagauuauagaaagauacggcuuugaagaauuuacaccauaacagucaugaauugcuugauuuuaaagcaaauauauccucaaaguccagguggcagaaugaugcaugaagcuaauaaaaggcaauuuuuuuuuggugaaccuagggaaccuaccacccucagaaauaaugucgaccagaaaaaauaguuguagagaaguuuauauaaauucaugauugauagauauagaguaggugacuacagaaagcuaagauaacuggcaauuaugagucaucccuuuuuuucuauccuaaaacguccccugguaucuuucagagacugauuuugggguuaggcccauguaguaauuuuuuaacggaauaguagccaaaguagaggaaggcaaaacagaguagaaucuaggccuuuugauuuuugaagcauucugugaugauugguaggggugaccaggggaagucaggaauccagagagaaguagcuuggaaccagguaaaccuaauuucuguacuagacuagaauaauuuguauuaaguaaauuguaggcuucugaaauaauuuguaugguuuagauaucaugauaaauuaugaauacacuaugucuucucuggcaugugaaagguaaauguuugccuauagaauacaaguucccagacugucuuaccaaauaaauguuuaaagccugggaacuuucgugguaauaaaaguuuuuacuacuauuuuguauauaugaagaguuuuuucuuuucuuuuuuuuuuuuuuuuuugagacagagucucgcugucacccaggcuggagugcaauggcacaguuuuggcugacuauaaccucugccuccuggguucaagcgauucuccugccucagccuccugaguagcugggacuacaggcgugcagcaccaacccuggcuaauuuuugcauuuuuaguagggaugggguuucaccauguuggucaggcugaucucgaacuccugaccucagguaauucaccugccucagccucccaaagugcugggauuacaggcgugagccaccccgccuggcgaaguuaucuuuaaaaaacaacaacaaaaaaaacuuuaucauugagcagaaaugugauuuuacaauuaguuuccauauaaacuuuuuguuaccaaaguaucaucaaauuacauacuuaacaauauucuuuuuuuaaaugccuuuuuuuuuuuuagacaaggucucggucugucgcuuuggcuggagugcaguugugugaucguggcacacugcagcuucgaccuccuuugcucaagugauccucccaccucagucucccaaguagcugggucuacaggugcaugccaugacacucagcuaauuuuugaaauuuuuuuguacagacggggucuugguauguuucccagagcugguguuaaacuccugggcucaaguaguccucccaucucagccuuccagaguccugggauuugcaggugagagccacggugcccagcccaugaacaauuaaaaaaaauuuuuuuuuuaauguuugguuuacuuuuuuuuuuuuuuuuugagacagaguuuugcucauguugcucaagcuggagugcaauggcgcuaucuuggcucacugcaaccuccaccucuugaguagcugggauugcugggauuacaggcgcgcaccaccacgcuuggcuaauuuuuuguauuuuuaguagaaauaggguuucacuauguuagccaggcuggucucaaacuccugaccucaggugaucugccugucucagccucccaaagugcugggauuacaggcgugagccacugcgcccggccuacuuuuuuuuuuaaugcuuaucuauuuccugcaguaugguuuacuuucgauauuauacuacgcauauaguacuuggaaguauuaaauuguauugguauuggugacaggugacacugaccuuauucuuaaauuauggaaaaugacucgugugugugugaagugaucucacuguguugcccagguggacuucaguggcucuucacaggugcagucaugcacuacagccucgaacuccuggccucaggaaauccugaguagccucuuaaguagcuggggguaaauauucuuucacuuagaccuucagcuaauguacugggggcaguauucuuuccugggaggucuuguuuuuaaaccaguccugccuuaaauuguuccaauuuuaguucuguggcuuugagucugagguaauuuucaguuuauugguauuagaaacauuccuguguuuguguagugcugggugugaaaugugaaguuaaaucuuuaaacaguuaauagauacuauuagauugcuguacuucugugguuuauacucuucacugugagaguagaauacuucaaaugcuugugcuagauguuuugccuuuuuaauuuuacaaaucugucugggcacaguagcucauggcuguaaucccagcacuuugggaggcugagguggguggaucaccugagguugggaguucaagaccagccugggcaacaugauuaaaccccaucuccacuaaaaacacaaaauuagccagacauaguggcgcaugccugugaucccagcuacuugggagacugagacaggagaaucacuugaacccagaagguggaggcugcaaugagcagagauugcgccacugcacuccagccugggcaacagagugagauuccgccucaaaaaaauaaauaaaaauaaaauaaauuuuacaaauugauaaaaaauaguuuuuauauuuguguuucccuacuuuauauauaaacauauauguuuguuggccuuuguauugcuuuucugugaauuuaauuuccuguuuuuuuugcaauggcauuguucaucuuuuacuaauuuuuaggagcuccuuguuuuuguuuuuguuuuuuuuuuuuuuuuugaguuggagucuugcuuuguugcucaggcuggagugcaguggcgcaaucucggcucacugcagccuccaccuccuggguucaagcaauucuccugaccucaggugauccauccaccuuggucucccaaagugcugggauuacaggggugauccacugugcccggccaacaugucucucuuuuuaaaugauugaucuuuuccaacaugacaaauuucuccauucauaagagacugcauuugauuuuagaacuuaucuguggaacuuuaaaagaccuuucacaugcagaagcugauuuucacuuuggcuuaucuaguuuuagugugugucuaggauguguguguaugugugucuguauauacauuuuuuaacauggggccuuuagucagagaaauuacaguauuaaaagcuagaucuaugcuuauauuugaagguaguaucaacaggguuucugauuaucuccauuuaagauugaaguauguugcugcuguaugauuuuuuuagaagaugcuuuuuccuccuuguuuucagaugucugcccugauuuuucagauguuugcguugauaaaggaauaccuuaguagaauuuucugugauuaacagguuagaguuguaccucucuucccugagacaacuuguagggcccuugaagcagcauugucugcguauuucagcauguucugcaaauaugaccuaucguuuguaugaguaugugccaugaaaaugguuaggaaggccgggugcaguggcucacaccuguaaucccaacacuugggaggcugaggcggguggaucaccugaggucaggaguucaauaccagccuggcaaacauggagaaacccugucucuacuaaaaauacaaaaauuagccagguguggugguacaugccuguaaucccagcuacuuggaaggcugcagcgggagaauuucuugaaccugggaggcagagguugcagugagccaagaucgcgccacugcauuccagccugggcaacagagcaagacugucucaaaaaaaaaaaaagaaaaaagaaaaggguuaggaaacauuaacuuagccugccucuuuuuuuuuuuuuuuuuuuuuugagacagagucucgcucugucgcccaggcugguuggagugcaguggcaugaucucggcucacugcaagcuccgccucccagguucaugccauucuccugccucagccuccugaguagcugggacuacaggugcccaccaccacgcccggcuaauuuuuuguauuuuuaguagagggguuucacccuguuagccaggauggucuccaucuccugaccucgugauccaucugccucggccucccuaagugcugggauuacaggcgugagcccccgcacccaacccuuagccugccucuuaagcuguaaguggucuugauauggagauagaaaauaaaauacuaugaaugacaaauaaucuaaaacuugaauuaaauaaaguagguguauuuuuauuuugucacuuuuuauuaaaaguuauugcaguauauucucuacugaguaccagcacuauauuuugagugccugcaagacuuagaauucauuguaaaauuacuguucuuggacugagguuacauuuuagucuuaucaguggauucuucaccaaucgauuggaaucagucaauuccaauacagucuucccccacaguugaauauagaauaaaaucuauugcaagcugggugcaggggcacaaguguggcaggagugcuugagccuaggaguucaagaccagccugggcaacauagugagaccucaucucaauugaaaauauauaucuauauaaaaaauaaaauuuauuacaguucaucuugcuggaaaacaaaauacuguuuuuguaauuaaaauuuuuuuuuuaaauuuagaaauggggucuugcuguguugaccaggcuggucuugaacucuuggccucaagcuguccucccaucugggccucccaaagugcugggauuacaggugugaacaacugcgcccggcugacaaaguauuuuuuaaagauguaccacuaaauggagauuugauucacauuugauaguuuuugacaggucuuuucuauuuaaaaacauuacuguuuuuguagcauuauucuggcuuuucccuuaauuuaguaaauauuugagugccuuuguauuccagauacugagcaagauuggcaggguucugcccuuauggagcagaaggaagguagggggacugacuaaaacuugaaaacugucuaacauaaguaccaugcagaaaaugaaacaguauuaauuggcagaaggagagcaggcuauuuuggcuagugugguuagggaaagccucucuaaagagaugucucuuggguggagacaagaugugaaaaaaccagcuugccuguuuuugggguuucagccuugcaggugaagagaaacacgaaguucagaagucuugaggcacaaagucuggcauguuacgaaagaaggccuuuagacgccuugucagggaguuuagauuuuauucugaguuuuaaaacgggagugacacaaugaguugcauuuuaagccuguucaggcuguuacauggauuauuaggagcuguaucauuucaggcuagugagaugcucagaugagucugccuucugucucuuccgucaucuauuucucucuuaucuggucuuaagcuccuccaucuuuuccuuuuuaguuggaaaaaaacucaaagaucuagaaaaaagaggagcuguauguacuccuaaaaagggaccucauaguaaccuggggauagaguuauguaggagugagucagggcucagguugaggcuuuagaggcaggaggcagcgagaucuuguucugucauccccucuuacagaaauaaaauaugccgauaaaaguuuauaguguaauaguaaaauauaaaaacaaaaaguaaguaauguagaaaauaaaaacccuucacaguccugcugaaaugauuacuguuaacacuuuaauucuagaguuccccauccauuuauuuauuucuagauuucccucuuuguagauuaauauuaaaggguucagacuuguucauuuuuuguugucuuggauaucuuuucccaccucuguauauauggaucuacuuuauuuaucacguggauauuaacaugguuuauuuaauucccuauuguuagguauuuggucuuuaccacaguuuuucaaggguaugaauagugcugcaaggaauaugcuuacacauguuuuuauacacuugucuuaggcuucuguaggacaaauuucuggaguagaauacuaggucauucuuuaagaacauuucaaacuuuuaauagauauuaccguauucuuucccaaaaagaauguacaaagacuguaugagaauaacuccauguugugaucuuaaguugucucuaaaccucuuugguuuucuuagcugucaucuaagaauacuaaguaucuaaccucccucuugauuugggcaugugaugugauuuagcauauaguggauauucaguuagaaacuuuugguugaaaacaagguuuggauucuguggucuuuaauucuaggccauuucagcucugacuaaaaugauuugaguguuaguguuauauaugggaagguaagggcuauggagucagugcagcccaguucagaaucccaguuugccacuuacaagcugugugugugagaauuuucucaacuguaaaauggggacauaauuccuaccuagaguaauacuguaaguauuaagguggauaaugauuggaauguaugcuguguauccugccucauaauaguaagcuuuuaguaaaugguagcuacuguuaauaauaaaacaaguuucugaaggaggaaggcuugaaaagaugggauuccuuaucaaccucaaaguuuucuaaaggaggaaacccuaccccccuuacuucugcaugguuucugaccaugaacugaacucugaacucugaaugaacugaacucugaacucugaaugaacugaacucugaacucugaauguuaugguagaaaauucauggacuuuaaauuuaaacagauaaagaaucugguuauuuuacccacugcugggguguucuugggcaaguagcaugacuucuguguccaaaaaagaaaggguuugcagugacugaaccuguaaucccaguacuuugggaggcuaaggagaguggauugccugagcucaggaguucaagaccagccugggcaacauagugagagccuuucucaacaaaaaaaacuguucuuaaaaauuagcugggcauggugaugcacgucuguggucccagcuaugugggaagcugagguaggagaaucauuugagccuggaaaauugaagcugcagugagcugugaucaugucacugcaccccagccugggcaacagagcaagacccugucucagaaaauaaauuaauuaaaaagaaaguguggauggaggaagggauuaaaaaucuggcugggcacgguggcucaugccuguaaucccaggcgugauuugggaggccgaggcggacagaucacgaggucaagagauugagaccauccuggccaacauggccaaccccaucucuacuaaaaauacaaaaaucagucgggcgugguggugcaugccuguaaucccggcuacucgggaggcugaggcaggagaaucgcuugaaccugggagguucagugagccaagaucgcgccacuacacuccagccuggcaauagagugagacucugucucaaaagaaaagaaaagaaaagaaaaucuuugggguucuuacacaaauuaaaugagauaauuuauuauuauuauuuuuuuugagauggagucuugcucugucccccaggcuggagugcaguggugcgaucucagcucaccgcaagcucugccucccggguucacgccauuccccugccucagccuccugaguagcugggacuacaggcgcccgccaccaugccuggcuaauuuuuuguauuuuuaguagagacaggguaucccuguguuagcuaggauggucucgaucuccugaccuugugauccgcccaucucggccucccaaagugcugggauuacagguaugagccaccaugcccggcuugagauaauuuauaaagugccuaaaauacauccuagaaauauuaguuuuucuuccuugaagucauaaauuauggcuuacacuuuuuuucagguauuucucauaguacuaauguguugcucacacucaaggguaguaguugcuuaggaagaagagaaauguaguugaaaaaguaauagacuagaagucuugagaccugggcucauguuccaaguuggcuuuuuuuuuuuuuuuugggagauggagucucgcucuugucccccagccuggagugcaaugacacgauaucgacucacugcaaccuccaccuccuggguucaagugauuucuccugccucagccucccuaguagcugggaugacagacacccaccaccaugccuggcuaauuuuuguauuuuaaguagugacagcauuuuaccauguuagccaggcuggucuugaacuccuggccucaagugaugcgcuggccucggccucccaaagugcugggauuacaggcaugagccacugugccuggucccuugcuaaauguuuuguuuuguuuuguuuuguuuuugagguggagucuugcucugucacccaggcuggagugcgguggcaugaucuccgcucacugcaagcuccgccucccagguucccgccauucuccugccucagccucccgaguagcugggacuacaggcgcccgccaccacgcccggcuaauuuuuuguauuuuuaguagagaugggguuucaccguguuagccaggauggucuccaucuccugaccucgugaugcacccaccucggccucccaaagugcugggauuacaggcgugagccaccgugccccgcaguugcuugcuaaaucuuuuaacugcuggucccauuuuccucaucuaugaaauauuuaauggaaguguacuauuaaagaaacuuuucuuugcugaugaaugcaggagguaucauuaaaaacccacauagugcuauuuucauaauuacucuuuauguauuguguucuuggguugaauacuuuuguucuagaguuacaauuauuuguguuucuuaccagguuuaagaauuguuuaagcugcaucaauggagcacauacagggagcuuggaagacgaucagcaaugguuuuggauucaaagaugccguguuugauggcuccagcugcaucucuccuacaauaguucagcaguuuggcuaucagcgccgggcaucagaugauggcaaacucacagauccuucuaagacaagcaacacuauccguguuuucuugccgaacaagcaaagaacagugguaugugaacauucuacuuaggaaauuuagcuauuuaucugccuguggagcacauuaaggaucauguucaacuuaaagacaggcaaaauauucauugucauuuagggucuuuauuuuuuuuuuucuaacugcagauuuauuuuuuuauauugcuguuccuuccacacccccuauuuuuuccuaccucuuggccuuccuucuguuacucuugccuggaaugucuuccuuugugccacuucauccaaacaaauaguacauucuuauggguauauuucaaagacuuuucuuugagaagucucuaggccuuuccaacuacuuauuuuagaagacauuuuauuucuucuauuaaaauauucaccuaaagcuuuuugacuauuacaaucaaguauaaagaagaaaguaaaguuacauagaaaagauuauuuuuguauauuucauaggcccaggaccagucuggaggcagcuuagaaaucauagaaucuucuuuuucagggcacugacaccagccacuuaguucugcguaguuuauuuuuucagugccagugacagguucauauuggcaucauggcaggacacugccacuagguuuucugauagaaaauuucuuuuucuuuuucuuuucuuuuuuuuuuuuuugagacggauucucacucugucacccaggcuggagugcagcucacugcaaccucugccuccuggguugaagugauucuccugccucagccucccaaauagcugggacuacaggcacacaccgccacgccuggcugauuuuuguuuuuuguauuuuuaguagagacgggguuucaccauguuaaccaggcuggucucaaacuccugaccucagguaauccaccugccucggccucccaaacugcugggauuaccaacaugagacaccacgcccagccugauaacaaaacuucaauuuuucuaagaauuuagcucucaaaaaguuuucuggcuggguguggugauuuauaccuguaaucccagcacuuugggagaccgaggugggcagauugcuugagcucaggaguucgagaccagucgggcaacguggcaaaccccaucucuacaaaaaaaaauucaaaaaaguaggccuggugcaguggcuuacgccuguaauccuagcacuuugggaggcugaggccagcucauuacuugaggucaggaguucgagacaagccuggccaacauggugaaaccccaucucuacuaaaauugcaaaaauuacagccaggcaugguguugcacguuuguaaucccagcuacuugggaggcugaggcaggagaaucacucgaacccgggaggcagagguugcagugggccaggauugcgccacugcacuccagccugggcgaaagggugagacuauauuaaaaaaagaaauaacaacaaaaauguagccgggcgugguggcacacgucuguagucccagcuacucgguacucgggaggcugaggugggaggauggcuugagcccaggaggcaaagguugcagugagcugagauugcaccacuucaccccagccugggugacagagagccagaccccuucucaaagaaaagaaaaacaaaaaaaguuuucuacuauuauggauaaaacaaacaaaaccaaccaccuggccaaaacagaaaagugaaauugcauugguuuugcuugguggaacuuuugagaaaacuuggguucaaaacuuccaugccucuuccuuucccauccucuguucuuuguguaaaaucaaugcauuguguuuauuccauauagucaggugaagcaagguucugagguggggaaccccaguccagaguuuucuguuugcuucuaacaguuccacucuucccaauuuguuaauaaauuguuuauacuuuuuuugugaaccuaaggagccucccaaguguaguguugaauacuuaggugcauuuugaacugaaggcaaaacucaaaagucuaacuuuaauuaaaguuugaguaaguuuaucuuugucucucuuccuaaaaaugaaaauuuuauggcuggcaaaauaagcaguaauaauccccuauaucugaacaauggucuuccauuugcaaaguaauuuugccuacuguuucucauuaauuuucuuugugaccuuaaauugagaagucagauaggaaguguguguuaugagaagcugaagaccauuuggugcuucuucaaaguguuauugagacuaucuucuccauccccaucugcuaccaguuugcccagaaggcugggaaacuuaauuuggcauagugauuaaguguaugaaccuuuaaaacaagaaaaucccaauuuaaauccucauugccuuuuauuagcuguaucauuuagacaaguucuguacuuuuuugauccucuuuccugaccuuuaugaaaugaggcuuguacuuagcacaguggcugauucauaagugaagugguagcuauuauuauuauuauuauauguauuuuuuuuagauggaggcucucacugucacccaggcuggagugcaguggcccaaucucggcucacugcaaccucuaccucccagguucaagcgauucuccuugccucagccucccaaguagcugggauugcaggcacccgccaccacgccuggcuaauuuguuuguauuuuuaguagagacaggguuuaccauguuggcaaggcuggucucaaacuccugaccuucugauccgccugccucgucuucccaaagugcugggauuacagacaugagccacugcacccggcugcuaugauuauuucuuagcuuuuuauacaucuauguaguccuugauccccuccauuugagcacagcuggugguuggaagccaagcuugacuucuccuacagcuuaugagaagguuguagccuagguuaguuuugccuguuucuuuggguaaagaugaacuaacuguggaagaacuagcugcuuucaccaggcacgcagcuugaggaaagcgguagaagagggaagaguugcuuagcuaggccagcaccaucagucagcucuuuuuacuccuccccagguugcuuuacuuccugaacccagaaugacucucauaaucacucaguggguucuagaaauuauuuaacugauuucagcauguauccauggagggcuguaaagaggagaaugagacagaggacgcguaucugauuuaaauaauuuuagaugugauaauuagguuuuugaauguuucuuggaauuuuuauuuucuaaaugugugccucuuugacuuccuccugcugcuguugcugcuauugcugcugcugcuacugcuucuaauuauuauuagauaagugauugacuggagccgaggaccacuacuauuagagucagcugaccagcagguuaaaauacagauucauucuguaugaaugggcuuuauuccauacuaacugaaucagaauccuuggauguguuggacagguagauggaaucuauauuuucucaagcuucucugaggauucuaaugccagcuacauuugggaaucugacuggauuagaugauauuuaaagaacuguccagcuugcaguaugauuuagugaagacugauaauguaacagauaucacuuuauagcuuagaaaacauugcuauacaguauuugaugcaggucaugauuccguuagguauguuuauuacucuuuguuuuccucauucuuagugucuuaguaguucacaucaguauagcuuacuuguuuuguuucugaaaagcuggaaguugguggguaucacugcgucaagaaacuuuuaaaauaaacuuauuuuggaacauuaaaaaauauauacaggcugggugcagaggcucuucccuguaaucccagcacuuugggaggcugagguggaaggauugcuugagcccaggaguuugagaccagccugggcaauauagugagaucuugucucuacaaaaaaaaaaaacauuagcuagaaguggugcugcccaccuguggucccagccgaggcugaggcagggggaucacuuaaacuggggugguaaaggguacaugugucaugaucaugccauuguauuccagccuagaugacagagcaagauucugucucaguauauauaauauagauuuuacacacacacacacacgcacgcacguagagaaaauaacaaaucugauguaccccuuacccacuuucaacacuuagcuaaccauggcaggccugcuuaaucuguuuucauccacuccuuucccaguguuuugacacaaaucccagguaucauuugucugaacuauuuugguauguacaagaaacuuuuaaagaaugcuaauuuuauuuauuuuuaaauagguaaagcauucauaugagccaaaagucuugggugaccccugccccuguauccccauuucuuuuccucagagguuucuuaugaucaaucuuuaucuauucgaagaaucaguugguuuccccuuacccuguuguucacgaccuuuccuuucuuccacaucucugaaggagaggaaaaaccaucgguagcuaaggaggcuaucacaaacuccaaaggaacuuuuuucguuuggagaaucuuuuccuucucccagaugauugauccuccuggagaauauuccuuccccacucccaucaccuucucgacuaaucuguuacaaguucaaauucuucuauacuguacucucaauguggaguccaucuuugggcuucaaagaaugauuacugggcagauaaguccccuucagucccuggugauagcaaaauaaagccuugugaaaaacuucuuacguugccccucucugauguuuucaaauuccuuaugcuuacaugcauucccuucuuuccuagauuguuuucucugcuuugcauccacauacuaugcccuaguuuggagccugguaacuagaagggcccagauaacuauguccucuuucuuaagacuuuuuucuguuguaaaccagcuagagaagguuggcuggauuggcauugagguggcuggaguaagagccaagauuaagaacacuuugggccuuuugcagcccugcuuuacuuccuucccccuccccguguacccacauagguagauauaugcauacacucaccaccuucugggggcgggguguggggggggauggcggggugggggagcgguuggcuggcugcugucagcuguuagcacuuucaaucagaggaggaaccugguaggcaguucacaagcacugcaaaucucuguuuugcccuccuugcuggccauacugacucuaguuaccuuacuuuugauuaauucuuggcuuugaaguuaaacauggagggcuuuuaucaaaacucugaaauuuucauucaaauuuuuuuacagcugccauuaauugugaguauccugggcacucacacuucccaguaggguucugaguaccugccuagcuuuuugaggauugaguacaggggaauauagagaaguaugugccacuaaggcugcuugguauggugugcacauauauuuaaacuaagauugguguuugucccuacagcagggcuggaguucuauaucuuccacuuccugcuuugccuucacuaguguuaaguacuugugagauggaauuuuuguuagaaucaucagucauuuuuguugaaagagguugaaguacaaauuuugaucauaaaaacucguuuguuuauagaucagauuggcuuauuuccucucuaaugaaucuagugaacauauauguguauacauucuaaucacacaaaauuagagacguauaaaggaaaaguuuaucauuuuaucuuucuuaaccacuuucuaaccacuuucuuaacugucucuugaugugaacagcuagguguaaaucuuuccacuuguauaacauauacagauuucuucacuuuuuuuuuuuuuuuuuuugagacggagucucguucuugucacccaggcuggagugcaauggugcgaucucagcucacugcaaccucucccuccuggguuccagcaauucuccuaccucagccucccaaguagcugagauuacaggcguccaccaccaugcccggcuaauuuuuguauuuuuaguagagacgggguuucaccauguuggccaggcuggucucguacuccugaccucaggugauccacccgccucggcuucccaaagugcugagauuacaggcgugagccaccgugccuggccucuucaccuuuaaaauaaucuuacucuauuauucugaaggauauuuucccccaauuaauauaucauggacuccucuccauccaggucauuauaaguaauauaauagcugcauaaugugacauaauacagaugucucacacuccauucaaguacuuuccuauugcuggacauucagguuguuucguauaugugugugugcgugggccaucacaagcaauacagacuggugcauuuauuucugugcccaccuuuccaaggggugcugcagccuguguugguccuaaaggugguccuuuguuuguaggucaaugugcgaaauggaaugagcuugcaugacugccuuaugaaagcacucaaggugaggggccugcaaccagagugcugugcaguguucagacuucuccacgaacacaaaggguaagagcucaaaagucaauugacuucuucagacuaguaaggaucuucuagcuucaaauagcuauguuuguauuaaauuguacuagcuuccuauagaauauuguauauuucuauaccuuucuuuauaaagagauaauucagaaaaauagguauuaagaaauugaaauuauugcuuggacauucucuugaaaaguuaaauacacguuaagcugggccugaugaccaauaccuguaauuuuuuuuucuuuuugagguggagucuugcucugucgcccaggcuggagugcaguggcgcgaucucggcucaccgcaagcuccgccucccggguucacgccauuuuccugccucagccuccggaguagcugggacuacaggcgcccaccaccgcgcccggcuaauuuuuuguauuuuuaguagagacgggguuucaccguguuagccaggaugguaauacccguaauuuuaacacugggaaacugaggcaagaggguugcuugaggccaagaguucaagaccagccugggcacauagcgaaggcccaucucuacaaaagauuuuuaaaaauuagccaggcaugguggugcggcccuguaguccuagcuguucgaaaggcugacgugagaauauugcaugaccccaggggcuugaggcugcagugagucaugauugugcuacuggacuccagccugggcuggagcaagauccugucuauuaaaaaaagccaaaaaacaaaaaaacaaaaacaaacacauguuagguauugauaauguuuccauggauggaaacagugauguuagaugcuguguuuuuuugagacaaagauuuuucuuuguguuuacucuaaugcauuauauagacugggcacucagaaagugcauuauuuuauauaaagaaugcuauccucgggagauugacuuuucucauucacuaauuuuuuuuuuuauucaguuaaauguguacuaaucccugcuguuugauagauuguuuaaagaugcagaagcauuucugcuucagggaagauucaugguuuauccuauuccuaauggugguggcaagauagaggcauccccucaaaggcuaggaguaauaccucaaagcagcagagcuguccauaauuauccauuauccauuauucccuccaccccgaaaauauagggaaaccuuuaaaggguucuuuuuuacccucuucuuggaaagcgucacuuauguuauucaucguuagcuuacauuuuuucauguuucaaagaguucugcaguuugggagaauagcccagggaaugaaucuacucgaaggggugaguguaauucucaauuuaggaggcguuuguugaagugcaaaucuuugaagcagacguuaacuuuugcugaagguagcccagguugggucccuaagccaauccauaguguuccuuaaggacuagagagauucugagacagggagggcuuggucuacucucauccaaggcugcacugguuuggagcuacucuggagucucuaggacagacagcagauugucacuaggaucagucugcagauugaugagaaaauaaggcuuguccuccuucucuucauaagggcaaaauaguccuuuggaguuauaggaaguuuuccaggugcuguauagguaauuauauuaaggaauguauuguuuacuguuggauagugagaaaaauggcuugacuaggcuucugguagauaauggagaggcuugaauggugcuauacauguuauuuucucuuuaccugagaauauucuuccuuuggaaaaugggccagauuaacuggauaaaacauaagaaaggaauugggcauuacuuuuuacuuauguaucuauuuuuugucuuauuuauacuguaggcacagaaagugugguuucagaguagauuuuaagacaguuaaguuucucauugacuuauagacccuacaacuacagauuugagucuguuauuaauuaauagaaaaguacauuuuucauuugugguuccuuucuauuuaucuagauugaaauaggcuacugaagacuaaauuuuguacugcagcaauauuuauaauccauuuuacaggauuuggggauuuuuguaagauuuuaguguuacaaauuccaauuuaacguauauugacuuuauugugagauuuuauauaucauuguuuaaagaaaacuuuauucuggccagacauggugguucacaccuguaaucccagcacuuugggaggcugaggcaggaggaccgcuugaggccagggauucaagaccagccugggcaacacagcaagacucucucucuaccaaaaaacauuuuuuuaaguaaauaaagagaaaacuuuauucugagaacaugggcuuuggaguucaacagaccuagauuccaacauaggcccuuaaacuugcuguguggccuugagcaaauuaccuucuuagagucccaguuuucuuauuuuucagauagaaauaauaccuacuucauagguuuguuguaugaauuaaauaaauuauuguuguauggauuaaauaaaguuguguuuauauggcaugugauaaaugguagcuguuguuauuucuauugaacuuugaucuuguuuaaacauuucauguuuuuuuuaaauccuuucuaguaaaaaagcacgcuuagauuggaauacugaugcugcgucuuugauuggagaagaacuucaaguagauuuccuggaucauguuccccucacaacacacaacuuuguaaguugcagaucucuucucuuucuggcauguugagggcuuugccaggcauaacagagauuucucagguaauaugcguauguauauauauauauaguuggauuguuuaaaguucuuuaugcuguuguuuacaguaaggcaauuuagauuucauuagucagagauauacucuaauuugugauuaugaauucuguacaugcuggaaguaugauucauuuuguaaaaacuuuuuuggaggccaagaaaugaaguugucuuuugucaucuuuuauuuauucagcauaauuuacaccuguguucuuguuguaggcucggaagacguuccugaagcuugccuucugugacaucugucagaaauuccugcucaauggauuucgaugucagacuuguggcuacaaauuucaugagcacuguagcaccaaaguaccuacuauguguguggacuggaguaacaucagacaacucuuguaaggcauuguucuuuuauccaaggaagauagggaugaggaguauacauacuuuaaaggguauuuguuguagauuuugacugacaggucuggauucuagacucauuuaaugaauugugauccagaaacuacuuuagaaacagugauaauucugaaacuagcuagguuugguggcauucauacuccagaaugagcagguaggaguaggacuuguuaucugucaaauugagauugacauacugugacugugauucaguaaggaaaggagcaaaaggauaugaaaacaagaagauuuuuugcuuuucgcucuuaauaguauuaucuacugggguugcuaguagacacugcucuguauuuuguugaauaugcugaaugagccuuugacauugagaaggagcagaaagcaccguugaugcuauuuucuucacuucaaacuggagaaaacuuaguuguuuggacuuaaaauuguuugaauauaaaaucuugaaagauucuuguuucuuucaggagacaauauauuucauauagauaaaauguuauuaaagaauuuaaaguuuacauuaaaaguacaugguccaaacugccuuuuaaaaacuguaacuagguauaugaaaaguuuaaaaguuuuguccuuuuuugacaguacuagagaaaccaagggaguguuauuauuagaccaugaugaaaauguuuuugcuuucauggucacuuacguauugauuuugugaugagagcuugaguagcacaaauggcacaagcuuuuaaaauuuaucuuauuuuugucccccacccuuuuuuuuuuuuuuuuuuuuuuuuggagacaagucucuuucugucauuaggcuggaguacaguggcaugaucucggcucacugcaaccucugccucccagguucaagugauucuccugccucagccucccgaguagcucagacuacaggcacacaccaccacgcccagcuaauuuuuguaguuuuaguagagaugagguuucaccaucuuggccaggauggucucgaucucuugaccucaugaucugcccaccucggccucccaaagugcugggauuacaggcaugagccaccacgcccagccuuuuuuuuuauuauuauuuuuuaaagacagggucucgcucugucucccacaguggagugcaguggcaugaucacagcucacuguagccucgaccucucggguucaaguaauccuccuaccucagccuccugaguagcugggacuacaaguguaugccaucaugccuagcuaauuuuuguauuuuuucuagagacgggguuucagcauguugcccaggcuggucucgaacuccugagcucaagcaaucuguccgccuuggccuuccaaaguguugugguuacaggugugagccaccgcauccggcggcacaagcuuuugagucuaacagacauaugucaaaaucucaguguugucauuaaccauaaccacaucugaguuuucguucaugcaucugaauaaaggggauauuaccuuccuugcauuguucuuaugaggcuugcugacauaaccugugaaauuacuaagcacaagugcccaccucauggaaaaaaggugccuaauuacucacuuuucugugauuuauuccuucuauuuuagucuuuuaucuaugcauuuucaagauggaauguuuccagagaagcugugugugacauaguuugugaaauguuauacuguaguuugaaaaauauuauuuugauauagcuagacacaggaccaguauuuccuagaaaugcacacugggccgggcgcgguggcucacgccuguaaucccagcacuuugggaggccaaggcaggugaaucaccugaggucaggaguucgagaccagccuggccaacauagugaaaccccgucucugcuaaaaauacaaaaauugggggaagggauagcauuaggagagacaccuaauguuaaaugacaaguuacugggugcagcacaccaacauggcacauguauaccuauguaacaaaccugcauguugugcacauguacccuaaaacuuaaaguauaauuaaaaaaaaaauacgaaaauuagcugggcaugguggugugugccuguaaucccagcuacuugggaggcugaggcaggagaacccgggagguggagguugcagugagccgccauuacaccucugcacuccagccugggcaacagagugagacuccaucuuaaaaaaaaagaaaaagaaaaagcacacaggagccuguauguuuauuggcaggucaguauuauucacauucaauaaucauucaaauccaguuauuuggaauauuguucccuuuauucuagguaauguaaaacaguugaggaaaaugugacugggaaaaguucaguuuuaguagcucugaguuugcaaaagcaaggcaugcugauugucucuguaagauuacugcaagccuaaaaaccagucuuucccugcuuuuguuuagauuguuuccaaauuccacuauuggugauaguggagucccagcacuaccuucuuugacuaugcgucguaugcgagagucuguuuccaggaugccuguuagguaauuuuuuaccuauagcuuuucuuuuagaaaguuauuugggguggugggguuggaagcuugaagacaaaaaauaagaguuucuucgcauucccuccucucuacguggaaaccccuugcugcuucuguggaacuugauacuggugguacagaaaagguagaaauuucuguuuauggaccuguaggucuuacauucuggaaagugacuuugacuguagcuucuucuguuaucauagcauauuucuuaauaugucauuacauuuuaaagagcuugagauucugcuuuccucaguauguacugaguucaaccucaauggaaaggguccuaaaacuuaauacagugauuugauaaaaauaaaacccuuaacuuugaaaugcauguuguggccgaugcauuugcuaaaaccauguauuuaaauagacuagugucuuuaaaaacauuuaauuagauuuucagcauaaauauuguuucucaugugucucugaguuugcauauaacuugucuuucuuuacucuguuuuccagcuuuauaaucaguuuuguugcguuuaucuacugcucaguguuaacacacaugaauuugaaaccuaaaguaaaaucuacauccaaaauaucuuacuuuaggccaggcacgguagcucacaccuguaaucccagcacuuugggaggccgaggcagauggaccacuugaggucaggaguuccagacuagccuggccaacauggugaaaccccaucucuacuaaaaauacaaaaaacuggguggguguggugauaugugccuuuuggcccagguacuugggaggcugaagcaggagaaucuugaacgugguaggcagugagcugagauggcaccacugcacuccagccuuggugacagagcaagacucugucuccaaaaaaaaauauauuauguauacacacacacacacacacacacacacacacacauaauguguaaucagauaauguuuaaugugaaaauacuauggaaauauuaaacgcagcauaucuuagaauaaggaauuugcauauaucuggauauauauuucuguauggcuuuuauuuuucuugauaauuugaaaagcaaaucugaccaagaauuuguaguuaccucugaagauuagaagaaaccaggccucugaagccauaaaacagaggauuaugugggaaggcauuuuuuucaagacaauagaacaauuucccuuagaaaagcuggccuuuuucccuuuaauucauacauggguguuaccugaaucugaacaaaccucgaacgaaucuuuagagcaaauaaugaaaauguuauaccucuuaaugcauguucccaguuugguugguggggguugguggugacuggaagaggccagugguuaauuucacauuuagguauuuccaucuaaaaacugaauucccauuuauuuacuuuguuugcugguuguagcagguaaggacaaacagaggguaaaauccuggccuuuuuacagacaugcucagcacgucuacuuaucuguuuaaauaaauucucaaauuuagucucuaaacugggcguguuccaacuagcuuaauaggugguagcgugguugucaaauguuaaucuguucuuuccuggagauguuguaaaaauuuggaguagaguggugcuuuauuuaaaaaaagaaaacuuauaaugcacucuccuuuucauugaauucccaauacauauauuauuuccuguuccaaauuuuguaugcaaaagcaccuagacuuaagauaauuuuuagaugucacacauuugaaagaaucaaacauuuugucaaagguuguacagguagaguuugcccuuaagcaucuuacuuagucaaauauguacuugaaagacuucaccaguaugaaagccuaagugccaaucauggaauuuucuuucuccuccuaguucucagcacagauauucuacaccucacgccuucaccuuuaacaccuccagucccucaucugaagguucccucucccagaggcagaggucgacauccacaccuaauguccacauggucagcaccacccugccuguggacagcaggaugauugagguaauagggcaccuugggggugguaaugucagucaauuaauggggugagguugauacuuauuucagaguuuuggguuucaaaucugaucaaggaauguugcaacacuuucucaggucucuggacuuuuacaguuuauuuuauauccauaauaucuucagacuggcugaauagucugguuaguauaucauucaacuggagaacuaaaacuuccugaaaaaauguuaacauuugaacucuucccauuaucagauuugaauaggcuauuaaugaacaagugucuaagauauuuaaagagcaguuuaguuuuggugugggacagaaauuaacagugauggagaacuacagauucucuggaagacuuuugugauuuuauuuagaaauaaaaggguggaguccuaggacuuuaauaagcagguguuuggggagaugucaaagugcccaaagcuaguguuuuugaacugcuuuuucuucucuuggcuuuuugguuauguccuauugguuuaauuugcuuucugcuucaucuuuaauaacaacugaauacacuuaaauacuuccuuuguucuuuauucuucuuuauuucucauugcuuuggacuagaauaacaaccugagugcuucucccagggcgugguccagacgauuuuguuugaggggaagaguagguauuuuucuucaugccuuugcuuucuuguaauuaacaggauugcuaaaacugucagacagcagacuaccaaaaaugaaauaguugcuaaguuaaauuuauauuucuugucacuuguuuccauguuuucuuuuucuuucuuucuuuuuaaaauuuuuuuuggcaguagaguauauagaaguaaaaaaaauguuguaugugguauugaugauaggugaaaugaauuucugaaguuaggccaggcaugacgguguaugucuguugucccagcuacuccagaggcuaaggcaggaggaucacuggagcccagaaguucuaggcuguagggagcuacaauugugccugugaauagccauugcacuccaacuggggcaacauaauaagaauccaccuuaaaaacaaacaaaaaauguuaaguuagauuuugaggccaagggcauuaaaaaguuuuuuuuuuaaaucaauuccaaccaaaggcuaauguuagacuuacuuaguuggugcucacagcauugguauucuguuuauacauuaguaaccaaauguguuuuugguugauaaacccuagaauaaauauucuuuauugaaagcuuaucagagacaacuaugcucucucucaucauguagacaccugcugccuuaggcacaguuuaucucauucagaccucaaaucacuuucaacauaauuguccugccacuauugugaggagaucauguauaagcuauaaauuuuauuauuuugacuuuaucauuaugauuaguccugauaauacaauaauauaccaguuacugcuacuucuauuaaaugguuuguuccuguaugaacacuguaauacuuacagggaacaguaaaggucagaauuggcugggugggaagaucacuugcgaccaggaguucaagaccuaccugggcuauauguagcaaaaccccaccucuacaaaaaaaaauguaaaaauuagcugggcuugguggugugcaccugcaguccuaguuacucaggaggcuugggcaggaggauuacuugagcccaggaguuugagguuguagugagcuguguaugauugugucaaguaagaauuuuugaguuuuuauuauaaaagaauuagcacaauuguugugccuaaucauuuuuuacuuuagaagcaggguaaauuuugauuccuguuaauuuaaucacauauaagucagcauuuuuaaaguagacuaauuguugcuuuauucaaauuauuugugggucucaaauuauucauaguucucuugaguauuuagacuccaggaacaauaggaaaauucuuucuagaauaaauugauccaacuauagaaauuagcacagaauaaaauaugggauauuuaauugauacagggaagaaaauuaccauaacauuaaggaaaauauucugcuacauaggaauauaauugugguuaauaaaaauaaauugugcuuugcuuuaaaaacaaagaacagcuuaguuggauaaugaaauuacagcugccgauuucuauugaaauccacauuauuuuuugccaguguuuugcccaccuggcaguuauccugcuguacuuaaaaacacacauuccuggacuucucacauuccccuccaaaacaugcucagucaaucgugggucggggauuagggguggaucuucauucuucuuuccagagucagaaucacucuccagguaauucugaagacuagcuaguuuugggaaccagaacuaggcuuucuuguuaaauuccgaauuauguuuugggagcaggggaacagcuugguuugauucuuuuuaucuaauuauauaauuagauauauaauuuuaucuuuuuauauaauugagugggagcauucuaguaauaguuguguggaacaaguaucuugucuauacuguaguuacacaaagagaauauaguaggacuuccccccaaaaaauguccuuuuuuaggauaugggggccaagugguuuuauauuauucuauuauacuguucuauuccaagcgaugaauuuuagauugggguuuaggucucauagagcccucugcaauuuaaacuauuuuccaaacaguuucuaauaaauucuaaagauagccuuugcuuucucccaugaggagaauguaaccgauuuccaaauuuacccauaaggcaguguuuuguggugaaagagcugagggcugagauccauauaugaugguuucugguucuauuucugccaccuacugguucugccaagugacccugccaagucucucuaccuguucagauguguuuucuuauauguaaaauguagguuuugaacuuggauuuguggucuuuccagcuuucugugauuuuaggcuuggauaaaguauauaggcugcuuaccuuuuucaaauccaacuucuagucaauuuagccuaacuccuuguggaguaagagugagcuucccccagaauccaccuccccacccuggcuuuuuaaaaaaaguuuugagccucaguggaacaagaaucccaaucuuuggaagggucucagcugagaguaacuuugcuagcuucccuugaaagaguauguuuguuguguacauugcuuucuuuugagaaaaagaaugugguuuucauuauauaugaaaaacuaauaccaggcuuggcacgguggcucacgccuguaaucccagcacuuugggaggccgaggcgagaggaucaccucaggucaggaguucaagacgagccuggccaacauggcgaagcccugucucuacuaaaaaugcaaaaauuagccgggcgugcuggugcacaccuguaaucccagcuacucgggagacugaggcaggagaauugcuugaaccugggagguggaauauuaaauccuucuaauauuuaaugaaaaaucagccuuggagauacuggccacugauauuugcugaauuuaaucaaggaacguugauuagaguauguuuaggauuucuaugguuuuuagagguuuuuauaaucuauuuuguucuugcacauccuccuccucuuuuuucccucccccagagaaaaucuuuuguguguaggaguugaccagcuuuccuuuucuguuucaggaugcaauucgaagucacagcgaaucagguacuuuuccauagucauuuagccaacaauaaugggcuuuuuuucuuuaugcgguguaucuucuguuggcuuauccuuguguggcuucuguuugucuugucuauuaagccucaccuucagcccuguccaguagccccaacaaucugagcccaacaggcuggucacagccgaaaacccccgugccagcacaaagagagcgggcaccaguaucugggacccaggagaaaaacaaaauugugaguauagacaacaguaccuccugccaauuaggguucaguaagaaaaaccucguuggaaauuagaauacuuaaacuuauuuugggagaagauucuaauaaaauacauucaaugaaggagauuauaaauguuacugucauuuuuggcacacuugcaucagacaguuugccagugcuauaacuaaaaugguauuucucaaaagacaaaaauuggaaguaugguuaauauguuuaucuuuaaaagauauggaaacagaugacauggguugauccuuugaugcccucauuaucaaaagauuauuaccauugcauggaguauaauaaugaucucuacuuguuucagaggccucguggacagagagauucaagcuauuauugggaaauagaagccagugaagugaugcuguccacucggauugggucaggcucuuuuggaacuguuuauaaggguaaauggcacgguaagcuuggggcccucccuuuacuaacugcagggcuuuggugugaagucaaguuucagcccagggggccaggaggaggagaggacugagugcuccugggcuuauagcaguacucucccuuacauacuugauuauaccugaagauugaacuuaauucuuuuuagacuaaguucuuauaaagcucccaggauaauuagaaauuagugaauaagacuugagcccuauaaucaaaugucaggaguacuucuccuuuaaacugauuaaauacagucugcacaugggucaugcuuggaagcuccuuaagugagcaagagucugcugcuauggagggagcauggguucuagaaacuuuaagcuggaaaggaccuuagagauugaaauggggacugauuugcccauggucaugcaguuaggcauaggaaagcuggaaaucuccugaaguaacuucucuuuguccugcccuaggauuagcugugggugucccuaucaaacagggaaggcauugacuuaauucuugaaucuauguggaauauuaauguucugauuuuaauggaaacacuuugucacuuggaagaaagguacuauuuaacuuauguaguuacagcuuguguauuuuggcaacacugaacauuuuggcaacauacuuagcauuucucuguuagguuuuuaaugccucuggcuuuaggacuuugggaaauaauagguauuuccuugaaaaugcugcauguucccaaaaagucaucucuucuaaauucagauuacaauaaagcaaaaaucacagagucccuuggugccuauacuacuuuggaugacacuggaauuaucuuuagagauaaaugugcaaagauugagagaaguuaaaagcaucaaaugaauggaguauuaaaauucaagguacugaaaauaucaaacaccuccaguuuugaguacuuggugguuuuuuuuuuuuuuuuuuuuuuuuuuuugagauagauucuugcucuguugcccaggcuggaguacaguggcacaaucacagcucacugcagccuccaacucuugggcucaaacaguccuccugccuaagccucccaaguagcugggaccacaggugaaugcccagcuaauuuguuuuaccuuuuguagagacaaggucucacuauguugcccaggcuggucuccaacuccuggacucaagcaguccucuugggucucucaaaaugcugggauuacaggcaugagccacugugcccagccuuaccaugugcucguuaaugcaugguuuuuaccacuuguaauuaaucaucugaccaauuucuaguuccuuaagaggauuggcacccgacugaacauuuguaaaguacauguggaaugauuccuuuuccuuugaaaauugcaucuggcugggcaggguggcucacgccugucaucccagcacuuugggaggcugaggcaggcagaacacuugagccuaggaguucaagaacagcuugggcaacaucgugaaaccccaucucuaccaaaaauuagguagaugugauggcacucgccuguagucccagcuacuuggaaggcugaggcaggaagauugcuugagcucaggaggcgaauguuguagugagcucaauacagugaguacacacuacuguacuccagccugggugaaagggcaagacccugucucagaaaaaaaaaaaaaaaggaaaagaaaauugcaucuaguauguacuacugggcugucuccugggucccagagaaaugauacuguuguagaauauuuauuuauauguauuuagagacaagaucuggcucuguugcccaggcuggaguaguggcacaaucuuggcuuacugcagucucugccuccugggcucaagcuagccauccuccugccucagccucccaaguagcuaggacuacaggcacaugccaccacacccggcuaauuuuuguauuuuuuguagagaugggguuucgccauguuuccuagacuggucucgaaaucaugagcucaagcgauccgccugccucggccucccaaaguacugggauugcaggugugagccacugugcucagccaguugcagaauauuuuagauggcauaaauaucuccaggauuccuuaggaaagaacacaagcacuuugugggauagagcacuugugucugagauaacaaggcugcuaguaguuguaggaggcagagcaauggauauugcauuuauugcuucuguuagcauuagaacauuuuuauaucacauuuuaaaagccccagcuaaaagccagcggaugaaguuuuaaguuguacccaaguuuaauuuuccucugguugcgcacuuucauuuggggauucauaauuuuucaaggcauugguacgugguacugcuucugagcuuugucuucucucaauagagugagcuuucaaacugugauaaagauuauuuguuacaguguuacuuccauaaagacugcuauuagaauggagauaacuuguuuuuaagauucuagguuuuuuaggccaggugcgguggcucacgccuguaaucccagcacuuugggaggccgagguggguggaucacgaggucaguagauugagaccauccuggcuaacacggugaaaccccgucucuacuaaaaauacaacaaauuagccgggcgugggggugggcgccuguagucccagcuacuuuggaggcugaggcaggagaauggcgugaacccgggaggcagagcuuacagugagccgagaucgugccacuccacuucagccugggugacagagcgagacuccgucucaaaaaaaaaaaaagauucuagguuuuuuaagucagaaagucucaaaagucagaggagugaggagcaguggacuuuuaugccaugcuuucagaaagcaagcucuggucuaugaaugaagaagaaaaaugagugguccaggaaacauaacuucuagauuguuuugugcaauacuuuuuuccgccauauucugguuccuguauacaguauaucuguucaguaucuuaaaaauuacaacuguuuucaugauuuugauugaagauuuuuuuaacucagcccacccacuuauggaaguaaagcagaaagggucucaaagcaacucagaagccucaggugcaugauuuaaaacucaacauauuuauuuaaagcagcaucugucaggcccaaagcucacaaccuccuuuugggcauuaaauuuggcaucaaggcugggugcgguggcucaugccuguaaucccagcacuuugggaggccaaggcagggagaucauuugaggucaggaguucaagaccagccugaccgacauggugaaacccugucuccacuaaaaauaaaaaaauuagccgggugugauggcaugcgccuguaaucccagcuacuuaggaggcuaaggcaggagaauugcuugaacccaggaggcgagguugcagugagccaagaucauaccacagcacuccagccugggcgacagaacgagacucuaucucaaaaaaaaaaaaaaaaaagaaagaaaaauucuuucuauaggccagguguggugguucacaccuguaaucccuagcacuuugggaggcugaguugggaggaucacuuuagcccaggagaucgagaccagccuggacaacauagugagacccugucucuacuuaaaacacaauuagcugaccauggugcugugugucuguuguccccgcuacucgagaaacugaggcaggaggaucacuugagccugggagauagaggcugcagugagccgugauaacaccacugcacuccagccugggcaacagaacaagacccuguguccaaaaaaaaaaaaagaaacuuaaggaguuuauauucuaguggagacaguaaacaggaaaaguagaauauauaguaugcuguaauugcuaaggagaaaaauggaggaaaggagauauggaguggcagucccaguucaauguuuuuaauagguuggucagggaggaaucugccaagaaaguggcauuugcauggagggcgaggguggguggugcagauaucuagggaagcaguaacaucaagugcaaaguggaccacucaccuggccugcuccgagaacucaaggagaucuuauggcuucauuuagagugagugagagguauacuaauaggagugagguccagugguaggguguuuuaggguccuguaaagacuaucauuuggguuaaaugggaucugggguuguacgagaccuuuaggagguuuggcaagccuuuguuugaaaaugagugugaugagagagcucauuaucugucugagagcccauucuaacuccagguaguuccuacuaguagaaaauaguuugauugggugcaguggcccacaucuauaaccccaacacuuuaggaggcugaggugggagaaucacuugaagucaggaauuugagaccagccugggcaacaugagacccuugucucuacaaaaaauuuuaaaaauuaggugggcguggugaugcacaccuguauuguagucccaguuacuugggaggcugaggugggaggaucccuugagcccaggaguuugaggcugcagugagccgugauggugcugcugcacuccagccucggugacagagcaagagccagaguggggcgaggggagggcauggaauaguucuuuauuagaguugaaauccguuuuccuauaauguuugcucauugauccuagcagacugaaugaaucccuuucauggcaguccuuggguuauuuauauguaaaugaggggaaugcugcaguauagaacauuccuucuggauuucauaagaaauugcaaauaaucuguuaccauaacuguguuaacgagagcuggcuggcagauggaucccugcaaguaccaugggcacugucuuugguugacccuguucagucuucccaucagugacuuaaucagaggugugauauguauuugcauaguagugaggauuuagaaaagcgagaagaguucaacuggcuaggaugauggaaaaaagaaaagaucaccuuuuaacagagauaagucauauucauuguuccaaaaaguagaacuggagggggaagauguggcuuaaugauaacguguguggaaacugccaaggaaguucagccgacugcaaggucagaguaagucacugcgugggcuuggcucugaauucugagguuauauuacugauuagggccagaacaggugacaccaaaggguggguucagugacaacuagagcaugcccagaggagagcuauaagaaagggaauggacuacaaaacgagguccaugaaauaggaagguccuuagaagcaguucccccugagcgaucauccagcaucucccaagccacaugccugaaccccuagcccuguccuguccccucccguuaaaggcucugcccuuuucuggguccuggagccugggucauagcguuggccauuuucccagcacuuccacucaguugacugccucauugggucaguuuaccuucacaggauuucuuaccuucaucccuucuuucugaguccccacagucaaccauucuucuuguaccuuuccugagcuauugcagcagauuccucucuggucucccucuuucucuccuacagguguccaaauccuacccuagaguuuacuaaacacagcucagguuucucucaucccccucaccucaccuuuauuucugaugugcccagucugaaacauucucuguccuauuuacuaaaauccuucccuugguuuauagcccauuuccuucagaaaaccuuucuguauucucuuugaaaagagauuuacuuaggcaccuguagucccagcugcuuggaaggcugagguuggaagauugcuugagcccaggaguuugaggccagccugggcaacauagugaggccccaucucuaaaaaagaaaaaaaaaaaaaaaaaaaggauuuacucccccaucuuggggaacuccccuucuguuccagcacuccugucuuggcuccaacuguaccagaauggacacuuaugcaaaugauuguuguccuccuacucagggcugguuauacacguuucccauauggugucccauauggauccauuuuucuagauagaagguagcuccaaacauaguguggaucucucccauccagucaacagcaccuucaccggcagcccauggcaaacacaugugcagguuaacuggaugagagccacuuuggaggcugcuguuaaaacauggggacucguugaaacuuuagaugauaaaaccagagaucacagggagacaguuugggccuaucgugaggaccaucucucuaccaauuuucuucccaaaaaugaaauggggagggcugggugggguggcuuacgcuuguaaucccagcacuccaggaggccgaggcaggcagaucauuugaggucaggaguuugagaccagccugggcaacauggugaaaccccaucuccacccaaaaauacaaaaauuaguugggcaugguggagcaugccuguaaucccagcuacucgggaggcugaggcaggagaaucgcuugcggagguugcagugagccaagauugugccacugcauuccagccuagguaacagagcgagucuccaucucaaaaaaaaaaaaaggaaggaggaaggcuccaacagagaggcuccagaaacacuuuugaaaguggcuuuuggccaggcacgguggcucauaccuguaaucccagcacuuugggaggccgaggugggaggccucacaaggucaggagaucgagaccauccuggcuaacauggugaaaccccgucucuacuaaaaacacacacaaaaaauuagccagacgugguggcgggugccuguagucccagcuacucgggaggcugaggcaggagaauggcgugaaccugggagguggagcuugcagugagcccagaucacaccacugcacuccagccugggugacugagcgagacucugucucaaaaaaaaaaaaaaaaaaaaaaguggcuuuuaaauuuauagcacucuaaaguggaauggaucccuggaugugucuaaaguuauaucaagaggcugguuuuacagugcuugacaaucaguugucaguguuauagguagaauagcaauuggagucagacugggguuuugauccuggcugcagcguucuuuguuuuuuggcuguaugaccuugggcaagugacuaaacuucucagcuuguugucugugaagauaaauuauuuacgucagagggcagcugugaggauuaacagagauaaaaguauacacagugccaggauucaguauuauuagaauuacuuuuuaaugguauugaaggcagagaagcuuaauuucaauauauaucucugaauuuuuacuagggaccaucuuaggucucacugaaauguggauucagaguucagccucaauaguugcuaaauggccugcuuccuuacaccagcaaccagccccagucauucuguauuugccaggccauucauauguaugcacugauuucauccccacaggacaagguuuugaccugucacacaugaccucaccucuguggcuugccaggguuggugugaauaguuuaaccaaggcuaucgaaggccuaacuguagcgauagcaguuaaccuauguaacuuuuuugagucauuugaauuauguagagauuggaccuauaaucccagcacuuugggaggccaaggugggaggauugcuuaagcccuggaggucaaggcugcaaugugccacugcacucuagccuagacaacagagugagacccugucucaaaaaaaaaaaaaaaauuggaaauuugccguaucuguguagguaugugauucuuuggauaaaugauucacuguaucuuccucaaaacuagguuauuugaaagacugagaucauucaacugauugcacugacugccaacuaauuuugcaggagauguugcaguaaagauccuaaagguugucgacccaaccccagagcaauuccaggccuucaggaaugagguggcuguucugcggugaguagaaagcuggcgguccagucccucuggagugcuggaguggggaguacaaggacuguagaguuaguggacugugccgcagguugggacgggcaggcaguuaggacucacuguggaguuucugugguuggaugcuccucccuugagagcaaagggauguuuccuuuaguuuaugugguugucaagccuuucgaagagccccuuuuuaggagaauacccuccucugggcacaguaaacucaauagcccaauuucugucucuggguuuugguuugaggugggcagaaauaggcccuauuuuuaccuuuauuucccagaacccuuuuuuuuauagcugaguugccuuauuuuagacuucagaacagucagcuuuccaaucuuucagucacuauuuagacuuguaggaauaagucauauaauggagacuucuacaaggaguccuugugaccuccacaggagggucauggaguguacauugaugaaagagaauguccucucuguaagcaaggcuggcacugaacugauggcccagugaacuaauggugggcuucucuuugcucagaaugccacccggguuaucagccgugccauguguuuguuuuugggacugggggugguguugggacuggggguggugucgacagcacagaacccacuguccacgggaaagcacaguagaccucccugagcacuuuccuccucccucuccucucuuccccuccccuccccagcaaaacacggcaugugaacauucugcuuuucaugggguacaugacaaaggacaaccuggcaauugugacccaguggugcgagggcagcagccucuacaaacaccugcauguccaggagaccaaguuucagauguuccagcuaauugacauugcccggcagacggcucagggaauggagugaguagauggucugaugccucucugggacccaggcaucaaauuugucccuaaauuggaaccaggaucaggaaaagccuucuaguccauuaagcgauucugugauaucuuugcacaagccucuggccugggcuggaggggccaauuaucaggaaugaguuguucagguuccagcugggugggguggcucacaccuguaaucccagcacuuugggaggccaaggccaguggaucacuugaggccaguaguuuugagaccagccuugccaauauggcaaaacccuguuucuacugaaaauacaagaaugaaccaagucugguggcacaugccuauaaucccagcuacucaagaacugggacagggagaaucgcuugaacauuggaaagcagagguugcggggagcuuagaucacguuacugcacuccaaccuuggcugcagaagcgagacucugucucaaaaaaaaaaaaagagaaguucagguuccuccuugggacugaacuucccccuuggggcucagcuuugggcucugccugcuacccuggcuuuaucagaaaccugagaauauaguggggugcauguaccuucugcuuggacagcuguggcaaugccuucugcucagcugucugaggcauggcugucccacaugaggguuuaagcagauguuguuuuugggauaauuuuuuuuuuuuaauuaaaaacuuuuuccuggccaggcacgguggcucaugcccauaaucccagcacuuugggaggcugaggcggguggaugacgaggccaggaguucgaaaccagccuggccaauguggugaaaucucaucucuacuaaaaauacaaaaauuagcugguugugguggcaggcgcuuguaaucccagcuacucgggaggcugaggcagaagaaucacuucaacccgggaggcggagguugcagugaguggagauugugccauugcacucuagccugggugacagagccagacuccaucugaaaaaaaaaaaaaaacccaaaaaaaccacacuuuuuuccuuagagacacagguucucacucugucaccuaugcuagagugcagcggcgcaaucauagcucacugcauccuugaacuccugggcuccagcuauccucuuggcucagucucauagguugcugggacugcaggcacaugcuaccgugcccagcuaauuuucguguauuuuguagagucggaggucucacuauguugcccaggcuggucucaaacuggacucaagugauccucccaccuuuccuggcuagccuaggguagugcuucucaaacuucuccucugaaguagaggagcuccucguaccccuagacaucugggaguuacuaagcuauagcugugcuugcaaguccuacauaaauucucacacugucuuuaaaauucauauggaaguugccuucuguguauuuuaagaaauggaaugacuuuucagaaaaauugagauauaauucauacaucauaaaauucccccuuuuaaaauguacaccuaccucaguguuuuucugguauugaguugugcagccaccaccacuaucuaauuuuagaacauuuucauuaucccggaaagaaacacaugcccauuguauuagucuguuuggguugcucuaaaggaagaccuaaggguggguaauuuauaaagaaaagagguuuauuugacucgggguucugcagacuguacaaaaagcaugacaccagcaucugugucuggugaggcccucaggaagcuuucacucauggcagaaggcaaggggagccacgugugauguggugagagaaaggagcaagagagagagcauggagggaggucccagacucuuuaauaaccagguuucaugugagcuaauagugugugaacucacucguuacugcagggaggccaccgagccguuugugaggaauccauccccaugacccaaacaccugccacuuaggucccaccuccaacacuggggaucacauuucaacuugagauuuggaguggacagauauccaaacaauauacccauuagagguuacccaauaccucccacccacuugcagucuacuuucuguuucuauggauuuugccuacuuuauaguucaauauaaauggaaucauguaagauauaauauagucagguaacauauaaugauguuucggucaaugaccacauauaggaagguggucccacaagauuauaauacuguauuuuuacugugccuuuucuauguuuggcuauguuuagagacacaaauacucaccauguuacaaccagcuacaguauucaguacacugagggccauacaguuuuguagccuaagugcaacacguuauaccauuuagccaggguguguagaaggcuguaccuucuugguuugugugaauacacuuuaugaugugugcaugaugacaaguuggcuaacaacacauuucucagaagguaucccugccguuaagugaugcuuggcuguauauaauacauaagauaugguauugugugccugggcucuuagaccuagcauaguauuuucaagguuaauguguagcaugagucacuacuucauuccuuucugugucugaguaacauuccauuguauggauaugccacauuauucauucaucauuuauggacauuggguuaucagaauuacuuuagaguaaaacugaugcuugaagaagugucagcaauggucaggcgccaggggcccaugccuguaauccaagcauuuuggaggccaacaugggaggaucacuugagcccaggagucaagaccagcuugggcaacagugcaagacccuguaucuacccaaaaaaaaaaaaaaaaaaaaaaaggcggcaugguggcacaugccuguggucccggcuacugggaggugggaggaucacuugagcccaggagguuaaggcugcaguaagcuauugacugcacuccagucuccaaaaaaaaaaaaaaaaagguguaagcauguuugugcuguggccucaccuucagguaagcagugaugugaaccaggcugaacagcacagggucuaucccuguguguaacacuccuuggagccaggccuucaguggcuuuacuucuuagcuguaguuuaaaacugcuuucuacucaugccccucaaacuuauuuuuaauaauuucuuuucccuucacagcuauuugcaugcaaagaacaucauccauagagacaugaaauccaacaguauccuuugguuguugaguucauuugacugcucgguucuaaauuuagggaaacagaagggaggcuuucuaucacaaguggcucucggugccaggggauaucuuuuuaaggaaagaggcagaggacaggaaaacagaaaagucagaaaauuaguaggcuuggccugucccucagcagcuuaugccucaccuggacugaugagagcgauguuuagguuagguuccuuucugaguuuaucucagcaaaagugauuuggagagauuuccguaagcuugaaauaggcauaauuuuaucacacuauuaguaaauguaaccugacggggauugggcuuuugucuuaaguuuauuucuaguuuguggccagcguguguaugucuaucugcuuguuauguggauagcaaguagcuacaagccaaauguugaaagguuuccaaaaucacuaauuaaaauagucuuucuugacugggcgugauggcucacaccuauaaucccagcacuuugggaggcugaggcagguggaucacuugaggcuaggaguuugagacuugccuggccaauguggugaaaccccaucucuaaauuuaaaaauuagcugagugugguggcacguaccuauaaucccagcuacucaggaggcugaggcacgagaauugcuugaaccugggaggcagagguugcagugagcugagaucacgccacugcacuccagccuuggggacagagcaaggcugugucucaaaaaaauaaauaaauaaaauggucuuucucaaagguacauaaguggguucuucagaagucacuauuagaagaggagagggguuguuuuuauagaagaguaaaugaagaaagguauuuuuaaugcugugaggcgugaaauuuaacaauuuugaaucugccacccuccacgagccuuuccuugugaaagaaagauggcauuacaacccacguuuugccucuugagcagugagaggcaugauaguuguguuggauuaugggacauggccuauuuuagguacaugucugagguguggaacaccuuucaguggugggguuuuuagcagccaaacauuauaccaugaaagcagacaccacagauuuaaggaggugugaauuccugggcaccaacaucacaaguuacuuuguguguguuuuguuuuuuaauuuuuuguucuuuuuuaauuuuuuuuuccucacaaguuugacuuaaacuguaugacuucuuuacccagaagcgagccgacuucaguucucauuuugaagucacugagugguaccgauucuagugaggaauuucuuacuacaacauugaacacucaguaagggauuugcuauuuuguuaaccacucaaguuucagauggugauuugagggcagaauacaggcagaaacgacuguaagcugucaggccauccuuggcccucuggggagcacuggaguguggccucugcucauccuguuaggguuucaaguaccuguauuauguggaaaggucacaaggccagagacccagcaccuagaugugcaaauggggagaagaagcagggaagaaacgcuggcuugcuuuuggcuagggccaaauaaucuggcacauugaccaaucccugccugucuucuggaagaaggugcauuucaaaagcacuuuaaagaacuucagaaaccuuaggaaguucagugcagagaggcugugacagagguaagguggagagauuaccguguuauaaagaacuuugggauauuuuucaaaauuaaccugaccauucuuuugaaaccagaguccuuaacaagcauugagauauauuucuccaugaaggcuuaacagugaaaauuggagauuuugguuuggcaacaguaaagucacgcuggagugguucucagcagguugaacaaccuacuggcucuguccucuggauggugagaaucugggcucccaccagcagucucugguauagggcaaaaggaaugccuuggagauuuaugugcaaacuuaaagcguuucuguacauuuccccgaaauccacaugaccccuagugacagccagccucagggcaauuguagauuuucuugaggaagcuguugaucagaaccacugugaagcuuaguguggagaggaguuaauaagcugggugacagaaaugcugggucuugguccuuuaaagacaaggauuccugagcuguuuuaaccagugccugaguuggaguccuuugggggaaaagcuauguggggacugaagaauggacucauucauaacuaaugaaagggacagccuggccccuagaugucugugaggccugucauauggugauaaaugcacuuuugucauauggugauacauguaggccccagaggugauccgaaugcaggauaacaacccauucaguuuccagucggaugucuacuccuauggcaucguauuguaugaacugaugacgggggagcuuccuuauucucacaucaacaaccgagaucagguaagucugugcuggugcgaaaggacccaacucgugggagccccugggccuccgccagccuaagcagcuagaggguuaggacuuguuauuaucuguuguucauucaccccccauuagcucagcuguuuucuuucccuuagaucaucuucauggugggccgaggauaugccuccccagaucuuaguaagcuauauaagaacugccccaaagcaaugaagaggcugguagcugacugugugaagaaaguaaaggaagagaggccucuuuuuccccagguaaggcucagggcugcuagaaugugauuaaagcauggguugguucguaaagauggcaauauaaggugggaguguuuuguuuuguuuuauagggaggggacccagguccucuacaagaugguggggggcaggguacauccugugucuuugagacacagcuaaugagagcauucuugggcuuuguuucagauccugucuuccauugagcugcuccaacacucucuaccgaagaucaaccggagcgcuuccgagccauccuugcaucgggcagcccacacugaggauaucaaugcuugcacgcugaccacguccccgaggcugccugucuucuaguugacuuugcaccugucuucaggcugccaggggaggaggagaagccagcaggcaccacuuuucugcucccuuucuccagaggcagaacacauguuuucagagaagcugcugcuaaggaccuucuagacugcucacagggccuuaacuucauguugccuucuuuucuaucccuuugggcccugggagaaggaagccauuugcagugcugguguguccugcucccuccccacauuccccaugcucaaggcccagccuucuguagaugcgcaaguggauguugaugguaguacaaaaagcaggggcccagccccagcuguuggcuacaugaguauuuagaggaaguaagguagcaggcaguccagcccugauguggagacacaugggauuuuggaaaucagcuucuggaggaaugcaugucacaggcgggacuuucuucagagaguggugcagcgccagacauuuugcacauaaggcaccaaacagcccaggacugccgagacucuggccgcccgaaggagccugcuuugguacuauggaacuuuucuuaggggacacguccuccuuucacagcuucuaagguguccagugcauugggaugguuuuccaggcaaggcacucggccaauccgcaucucagcccucucagggagcagucuuccaucaugcugaauuuugucuuccaggagcugccccuauggggcggggccgcagggccagccuuguuucucuaacaaacaaacaaacaaacagccuuguuucucuagucacaucauguguauacaaggaagccaggaauacagguuuucuugaugauuuggguuuuaauuuuguuuuuauugcaccugacaaaauacaguuaucugauggucccucaauuauguuauuuuaauaaaauaaauuaaauuuagguguaa

SEQ ID NO: 191676 - RNA, 38143 nt, Homo sapiens
gcgccgccauauucccucccgccggccggcuccgcggcgcgcagccaccaugagcaccgccgccuuccacaucuccagccuccuggagaagaugacguccagcgacaaggacuucaggugcagcccgccgccggcccccuucucuccuucccgcucugaagccgggggccuucuuccccucucgaagcgccagcccaucccccaugaccaugcagcccccugccucuucucucuucucccugcauuaagcugccccccuccccacaggcccacuccugccucgugguccccacuggagcuccggccguucuccccuaggggccguccugccccuccgcgacuccagucccugcuucgucucccaccgugcaggcuucagcccuaccucucacccccgaucagagccccggcuccaccccucugcacccugccucggccucuccucccucguguguguccggcccccuucuucccccgcagcugaugccccagcgcccccucccccccgcccccaccaccuucagcgagcccacagugaagcccuacgccucucccuggggaccccagcaccugccucuccuccgcauugaacccggacccuucccgggaccgcaacccccagcugacuuucucacuggcacccucagugaugccuccuucucaacaucacccggaccccucccuccccgucucccuccccuccugcgauuguucagacccagccuaaaggagggggcugggcugagucuggcuuuccagucacagguaggugaugguuggggugggaccuucuagguuuugugugccacucuccuuccccacucccuuuuuccuucuuucccccucucacagcaucacagaaccacaggaauagagcugaaaagaacgguggaaacaucugguccaaugaguuuccaccugcauucccuggggaaacugaggcccagggaggaaaagggauuggcccguggucucauggccaguucuggccccuccagcugaaagaagaccuuggagacucaaugaacauuuuuucacuuuguccccauuuuacagauagggaaacugagucucagagacaugaagggcguagguucagucacagcgaggaagugggagacuuaguccaaauccaggccagucuaauacagaggccaagaucuuagugagguccucugauuccagcccccugacaggugaggagacagaccugcucugguggucugacuccuacucuucuccugcagcccauuccucaguaccccucaagagcccccccacauuaauagagccugggauccaaggucuuggcuucagaucccagcugccgucacucacuggccgugugaccauggacaaguaacuuaacccccaugagucucccugugcuucuguuucuauaaaauggggauaacagaacccaucucugaggguugggguaaggauuaaauaagauaguacaugugaaaugcucagguucauggcaggcacuaggucggugcuucauaaacggacacuguuaugauucugugcacauccaaaaucugccacgcccuguccccucucuagaccuucacuagggggauucuuugcucucccuugaccuccucccuucaucugacagcuccuauaacucuugaccccaggcaggauuagguaccuccuuucagcucccaucaugccuccccucauguuucugcuagaucacuuuucagcccugggagacccugagcuccugggccacugggacuaugcacuuccucuuagugccccaacaccugugcugaguacacgguaggugcuuagugaauguucgcugggucccaggcucccuacugugcaccccacguguaaucucaguccacccaugggugguagugauuguucuuccuguuuuccggaggcuuggaggagugcagugacuugcccaaggucacagagcuggcuaguggccuaggggauuugcgcuagugucucucaggccucugguccagucucugggagagggaguuggcccugccagcuacagcccgagaagcccuuucagccugucucugccaguggccuggagaacacuuaaaaccaccccaagcaugugagaauggugucuauuuuuaaaguccgaauaccagggugcuggguccugcagaccagcuguccaggcguccguguggccaaggguuucagcugaguugccucuaggguuucucuguaaugaaacugagacuguccucugguuccuggagcggggcagcgacugcaaaugggggucccaggugggguggagggagaccuuuguuuccuguucuuccugggcccuggcuuuaugggcaggaggugccccauuaccacggaggcuccagcagucaaaacgaguacccuugcaggucuugcaggaauuaccaagucauuucuugaaaacacaguaguauuauugguugaaaagccaggagaccuguguggugggcugguuuuccgcccaguuugcuguuaccguaggcaguuugugcagccucccugagccuaguuuucuuacuaccucaugcuaagagcuagauuguccuauugaaaccucccaaggauacuaugagguagggcaaagaaaaguucccauuuuauauauagaaaaucugaggcccagagaaaaggagguaguugcccaaugucaccuaguugauaaauggcaagacuaguaaguauacucacuuaaagccaaacuuuggugcucaagcucuuauccaccaaauuauauacuuuuccuucucucucccaucccuacacacauacacguauaaaacauggcuugcuuucuccgagagcuagugucugcaggaaccaggggugucugaaaugcugaggcauacuucagaagaguugguuucugaauucggacuauuuggcuguaaguucuguuaagggcuagcucucucacuaccucuccuccugcucucacccucccugacaaagcccucugcagaccuguucuuuguugagccuggagucccagagauaaaccugaugagccucugcccucagugaguguacaguccaauggagaagaugcucugguggccagacuuguauugcagugugagaagugcuauaaaggaggggugcagagugcucugaaaggaucuuguccagggaaccauugugcuuaggggcuguggaugcagggguagggcagggaggucagucauccuugagcugggacauuugagcugggcucuugaugggugaauaggaggagcucaacagaugaagaagaagagcggggauagaaggccuaucuugggcaaagaggcacaucgccuggguugccaggcugagcugggcccccauggacugcagcagaaacacaacuuggagacccugggugccaucucagaauguccccucagcugagcagacguaggggugcaugugcucaccucaggccuuggccuggcucaaauccaaaccuccuccuucacuuuaccuuugcccagaggugggcacagucaguccugccauccugcccaugcugccagcccagccuccuucucucuccuagcaacuuguggcuaaucuaccuguuaaaaauaaauaggucaucgaccaguccaccccugguaacagggcacugugggcugcagugacaucuaggagcaggucugagucugcacagaugagagccagaaucccaacugugauagauuuugccacaggaggcgggggucagggcucuugguugauuugcucaaccaugcuggaaagcagggccagcguggggugguagaguggcccagcagggucaguaaaagcuggaggcuuucuccgaggcagccuuacaguaucuccucgcugcucuguccuguuuucuccugagacuccgcucucacaugccugcaggagccagucagugggugaagugggccuaguggggaccaggugaacuggggagagggcagccacaaccugauucuaaucagguauugucaccagggauuguaggccccguuguacucaaauauucuguuuucaagauaaucuggaagucaguguuuuguuuuuguuuuuguuuuuguuuuuuuuugagucucacucugucacccaggcuggagugcuguggcacgaucuuggcucacugcaaccucugccuccuggguucaagugauucuccugccucagccucccaaguagcugggacuacaggugugcaccaccauaccuggcuaauuuucguauuuuuaguagagaugggguuucccccuguuggccaggcuggucucuaauuucugaccuuaagugaucuggcgaccuuggccucccaaagugcugggauugcaggcgugagcugcugcgcccagccuggaaaucaguauuuuuuuuuuuuuuuuuuuuugagauggauacucgcacuguuacccaggcuggagugcaguggcacgaucucagcucacugcaaccuuugccucccggguucaagugauucaccugccucagccuucccaguagcuaggauuacaggugucugccaccgcgcucggcuaauuuuuguauuuuuaauagagacaggguuucaccauauuggccaggcugaucuagaacuuuugaccucaggugauccacccgccucagccuccuaaagugcugggauuacaggcgugagccgccaugccaggccaaagucaguauuuuugugucaacuuucccaauguucaaauguugacaaguaauuuaaauuuuugaaaacauguuugcaagcuggacacagcugagggcuacuaguuucagaccucugcuccuacccucuuaauuuuggcgggaauggugcccaauucccgcaccauuccucgacuuggaaaguuggccccagccucaacuuuccguggcuuccagcuuagacucccacugcaguuucaaaugccugggacagcaucaggcuuuuggugucaggccccaugaaucccucaccuccggguggguagcccuugccucuggugcccacccuaggucagugagccagucagcuauuggcgcuggucuccaaaauaugcccaugcccaucagcauggcguggggcagugguuuucaaaguguggucccugacccucaguguccuccaggaauuuguuagaaauguggauuccugggccccaacucagaccugcugauucagaaacucugggaauggggacuaguauuauuuaacaagcgcugcuggugauucugaugcuggcuauagcuggagauccacugcucuaagggcagggacugagccgguucucugagaugggaguggacagggcucgcccuccuccaucuguuuggcagacaggccucuagcucugacuuggacacaaggugucuguucaaccuucugguaucccuuggcugggcgcgguggcucacgccuguaauccuagcauuuugggaggccgaggugggcggaucacgaggucaggagaucaagaccauccuggcuaacacagugaaaccccaccucuacuaaaaauacaaaaaauuagccgggcgugguggccggcaccuguagucccagcuacucgggaggcugaggcaggagaauggugugaacccaggagauggagcuugcagugagcugagaucgugccacugcacuccagccugggcaacagagcaagacuccaucucaaaaaacaaaacaaaacaaaacaaccuucuggcaucacuuucucagcuguugugagauguggaugauguccugugccauuauaauaauggcagugccauuuacugagcacacaccaugugcacuuaaaacaccaugaggcagguacuagucucaucccuguuuucagacagguaaacuaaggcuuggagaggugaaaugacuugcccaaguucacacucauaaauggcugaggcgggggccaccgauccugaaacauuaugcauuuagccagcaugcugagccguugcuagucugccacuauguggcaguuggugucacacauaugugggucuccuuguagcccaaccaugcccacugcccaaauaauccaccaucauguggcacuuaacgacggggaaacauucugagaagugcauccuuaggcgauuuuguccuugugugaaccucauagagugugccuacacaaccuagaugguagagccuacuacacucccaggcuauaugguguggccuguugcuccuaggcuacaaaccuguauugaguacuguaggcaguuguaacagagugguauuugugugucuaaacauagaaaagguacaguaaaaauaagguagaaaagauuaaaauggcaugccuguauagggcagcuccauuaaaaucuuuuuuuuuuuuuuuuuuggagacggagucucucucugucgcccaggcuggaguacaguggcaugaucuuggcucacugcaagcuccgccucccggguucacgccauucuccugcuucagccucccaaguagcugggacuacaggcgcccgccaccacaccuggcuaauuuuuuguauuuuguuuaguagagacuggguuucaccauguuagccaggauggucuugaucuccugaccucgugaucugcccaccucggccucccaaagugcugggauuacaggcgugagccauugcgcccggccagcuccauuauaaucuuaugggacaaccauuguauauguugccugucacuuaccaaaacaucauuaugugacacaggacugcauuugaccucgaaucuuuguauuaaggucuacuucuaggggaacccugagguacugcccaaauccaccagggcccaggagcugcucagcaaucuccuccacccucccugugcagguucauggccaccagcgaccugaugucggaguugcagaaggacuccauccagcuggacgaggacagcgagcgcaagguggugaagaugcugcuccggcuccuggaggacaagaacggugaggugcagaaccuggcugucaaguggugagugucagccucgguggagcaggagagggggcccuaccuugugugggagcauccuggggaccgcugucccuuugggguacagccucgcagaggagaccugcugagcagcucucguugaaugguaccuuagucugaguuuucccagaagaugcugagacaaggauucaaaucuaaguuuauuugggaggcgcucccaggaaacaugguagaggaguagggaagugaggcaggaaagggaagaggaccaaucaaggguaugguacgaagcaagugaccacagugggccugaugagcuuaaccccauggggaccucugggacacaguauaggacaugucccuuggacuuuucccacucaaaggguaagggagcugggguauuaauccaccagcucccugguagucauugguuaagggcugcuucugggguaggauggaggguuguccacugccugccaccuccagccagagaaagcccucagacagauguaaaugcugggaaggucaagcugacacacaucaaggugguaaaggcuuaaaggcugggugcgguggcucaugccuguaaucccagcacuuugagaggccaaggcagguggaucaccugaggucaggaguuugagaccagccugaccaacauggugaaacccugucucuacuaaauaauaauuaaaaaaaaaaaguugccgggcaugguggugcgugccuguaaucacagcuacuugggaggcugaggcaggagaaucgcuugaacccaggaggcagagauugcagugagccaagauugcgccauugcacuccagccugggcaacaagagcaaaaauuccaucucaaaaacaaacaaacaaaaaaggcuuagggcacaugggacugggagagguccuaaaagccccagccuuagaucacugugaggcugugauccugagacguuggccaguuaucucgaguagaaaaagacaagacaaggguaugugcagagcacguggggaugcuugugugguagggucauucucacacccacaccugagaaccacuaguguagggcagagguugucaagcuugacugcagguuagcaucaccuggguaauuuuaaauagaaugccagggaucaagggacaacagggugagagaauugggcacugucucucaaaccacugucugugagcuggguccaggcauucuucuggggcauguuaaugaauuugcaaugugaucccaagagcagagagaauucaguaaaggguuuuauguaggaaggugacauggacaaguuuaugagcugggaaugucuuucuggucauggaguagacuuaggauggguuucacaccagcagaaccaauaccuuuuuauaacaaauaguuuguaauaccguuuccuauuaggaaaugaaauucauacauuauaaaaccuaccucuacacauaaugcccuaaccauaaccauaaaggcaaacuagaaggaauguaguuuauaguaauguguguuuccauguaugcgugcuugggcacugugaugguagaagugaugaagucacgagaagccugcaucuacacgugaacucaucaugaguacagauacagacaggggguguuggggacucagguuucagaauuggaggccauugcucuuaguggcaagauuuucuuuuuuuuuucuucuuuuuuuuuuuuuugaaacagagucucacuuugucacucaggcuggaguacaguggugcaaucucagcucacugugaccucccccucccagguucaagcgauucccaugucucagccuccucaguagcugacauuacaggcaugcaccaccacacccggcuaauuuuuguauuuuuaguagagucgggguuuuaccauguuggccaggcuggucuugaacuccugaccucaagugaucugccugccuaggccucccaaagugcugggauuacaggcaugagccaccacacccagccaggauuuucuaaagugagugaccaucucccaauaaaguuucccagaaaacaaaguagaauuuuccuucaauuuaccugaaaauugcauucuuagaaaaucuaaaaugugguauauuaaaacaauguaaaaaaguauuuugugucuauguauaaaaugaaauuuuagacucagauaauuauagaaaggccuuuugccuauacaaaugcccauugggauguuagaaccucuugcggggcauggacagugcuuuguuuuacauuauugucuuucugccguuccugcuucucaaccccuuaaaggccagaaguacuaacucaauaguuuugaugaccaaggacccccauaaauugccaaggugguauuacuccuagugggaaccagugcuauaggagguaggauggaggacuccaugauuacguagauagaggagcuguggagaaggaaguugagagaaccaagguuugaaaaccauggugcacaugccuguaguccuagcuauucuggaggcugaggcaagaggaucacuugaggccagcaguucaagaccagccugggcaacauagcgagacacugaaaaaagaaauuagccaagcaugguggcuugaauauguaaucucaucuguguaggaggaucgcuugagcccaggaguuugaggcugcagugggcuaugaucacgccacuguauuccagccugggcaacagagcgagaccucaucucaauaaaaaucaagaaaaaagaaaaccauugugcauugcagucaccugaagcucuuguugaaacccuguauucccugcccagggauucagauucaggggauggagcaggaagggagcuggggcagaggaugagacuauagcacccuggaaucugcauucugaugcacaccaaugucugagaaccacucagguagggcagagguugucagccucgacugcauguuagaaucaccuggggaauuuuaaaagcccucccccaacccccuccaggccacaucugaaaccaauuaacugagacucucugagggcagugcccagguaggcauuuuuuagaggcccaggugauggcaacuaaggccaagaacgagggcgucuagugccgcuguuuuuacacuuuccugugcauuggaaucaccuggggaccuuguggcgcuacagauccuggcucaguagaucuaggguaggguaaggccugagauuccacauccugaacaagcucccgaguggcauugccaaugcuaacucaccaccaaacuuugagaagcaagccucuaaggcagagguucuccaagugugcucccuggaccaccuacaguaucagccucaacugggagcuugcuagaaaugcacacuaucaggccacaccuagauauagcccuccugacucugaaacucuggagguggggcccagccaucuguuuaaacaagcccgccaggggauucagaugcacccucaaguuugagaacccuuguucuggagcacuauuuggccauuuccugagacguaaaacacaagaagaaauguagguuugggaggucccaggaacgauguuggcauagccagagaguaucucuuucuggccaaacaggggcuccccugaugaucugaggccuuuuccucagcacguguggccgcaggagcaugaggggacauaaaggggcagccugacucaggcugaaccuugugcccuuggauucaccuucccacucccugcucagccuggguccucugguggucaaagugaaggaguaccagguggagaccauuguggacacccugugcaccaacaugcggucagacaaggagcagcugcgagacauugccggcauuggccucaagaccguccucucggagcucccuccugcagccacagguacccagguccccaggacuagguacuguuaguauuuguccuaguuuaugguaaaaaaacaaacgaaaaaacaaaaaaaaaacacugaggcucagagaguugaagagacauaccugaggucacucagcuaguaagcagggcagagaauucaggcccagcucaguuuaaguucaugguucugugucaggaaugcuuuuagcucaagugaugaaaucuaacuaacggcaguuuaaagaaaucaggggugguuuuuccucacauggcaauccuggaggaaucagccacuccauuuuuguagcaguucauuuaguggcucaauguugacaggguuccagucuugccccauguccccucccuuuauagggaaagcacacguuuucccagaaacccccagaggacuuccacuuauaucucacuggcaagagcuggaucacccagccacucccagcagcaagggaggcaggaaaggaaguguuuaacuuucccugccucccuaguggaauggggaaaggaagaagggcuuggguguguguaagucacccagaagcucggccaucagcucugcagcuccccuagcugucuccuugacuuuggccagacucugggucaaaccugggaccucuggagcccugguaagauucccggggaugugggcucaggaacacagccagagcagaggcagacuagugguggaggcugccuuucccccaggccagggccucacugugcccaccuugugcccugugcaggcuccgggcuggccaccaacgugugccggaagaucacaggccagcucaccagugccauugcccagcaggaggauguggcugugcagcuggaagcccuggacauccucucugacaugcugagcaggugugggaggccauccuggguauugaggaagaguggguaaaaggggacagggagggacucaaaucacagagcuagcaccuacugcacaccaggcccugugcuuggggcuccuuaaucaucccagcagccucguaaaggagaacucaauugucacaauuuuacaggcucugagagaugaugcggucaguaaaaccucccaugacuugaacaccugcucuggccagaaaaaugucaggugcuggccuaguguugggaacaugggguuagaucagucuugguuguucuagggaggaguucacagacauguauaaaacugugaauggaguaagcacaacaguaaggauaagagcagggcugauaggagcucagaggagcccccaguccagcugggagugaggagccuucuaaaagagagugcugcuagagcugagccuucgaggaggggcaggacuuagcugaguuugggcagguauaaagaggaugcuggaggggagacuguccccaguccagaaggcagagacaggggaagacuuggggucccagagucugccaggggucguggggcaggcuguaauguggagagguggguaugcagagcugaggugcagggcuggccaggagccauggggcaggggugaguauuuguguguucuacccugaucuuucucucugcaguggagaguaggugggaggggauugaacaggcaggggacugguuaagaggcugcuauagggaaagcaauucggguuguauucaggagggggacuccacaggacuuggagugggcaggggaggcagggacuggaggcugaccccuaggguucugccuuuaguaacuggcgggggcagacagaggugcugugauggggugcacuccgggagccagcagcagguguguggggaggaaggugauggauucaagcuggggcauguugaacuugaggcuccugggaggcacucacucaaccacacacuccaugagggcagcucccaggaucagucugucuuguucacccuggcuuccagcacagucccugucacuuagcaggugaacaggcaaacaaaugaaaccuaggagaggggguuggguaggacauagaaauaagggaggguaaggucagcguguuucuguaaagugagaaagaaaaggucucaagauguuuacaggacagaaaaugcacgggccucguuugaagguguggauagaagcugcugaggcaggcaggagcugugcugugugcgcagaaaccauugucugguguugccucuugucuugagcccagagcucagcaucuccaaaggcacuagggagccauggaaggaguuaagcagaggagugaccaggugagaaguagacuuuauacugcucuggucucagcgaggaggauggacagaaggggaugguauugaggcaaggccuagacuuccaagaaauagggacagccuuacuagauccucuaugcuuuccccuaucaggucuuucucccuaggcugggagccaggcuuugcacugcugagaagucccuuucucucuccgcuuucucucauguaacaaaaguaauuaaaauaauuccuccucacaguugcagggcaccucuuuugcaagggccauugaguugccauaauccugggaaggaggccgggagagaauggggagaggggcggagccuggcccagguugcccgcggagugcgaucggccugaugcccccucgugcuccccaggcugggugucccgcugggcgccuuccacgccagccuccugcacugucugcugccacagcugagcagcccgcgccuggcggugcgcaagcgggcggucggagcgcuuggccaccuggcggccgccugcagcaccgaccucuucgucgagcucgcugaccaccuacuggaccggcugcccggcccgcgggugcccaccagcccgacugccauccgcacccugauccaauguuugggcagcgucggccgccaggccggccaccgccucgguaagggggcagggggcggggccugggcuggcauggugggcggagcuuagggugagccaaugacucgguaaaggggcggagcuugggccgcagugcagccagggccuaagggugggccgucugccuugguagggaggauggggcggggccugggcugaugugguggguggggccuggggcgggcggcugaagccccugaaacgcagagguuggggccggauagggcuugagaggcgcagggcgggcccugagcucgacaaacccccaggccugagccccugcugagugcagacgguucagagaaggggguugguucaaucacuuaugagacguggaggcuggcugguaauuacaauuuuaagucaugccacuaaacuguuagacuauguucucuucucccaguuugacaaagauaucuuaguaacagcccaugagccaaguuugaauuuuuaagaaacaauuuaaugugcauacaauaaaccgcacuauuuaaagugugcaauucaguguguuuugaccuuuguguauauccgugaaaccuuuccaucacccccaaaagcuuccuuguguccguuugcaguccagcucucugccuuguccaggaagccacugaucugcuuucugucacuauagauuaguuuuuuagaaauggaaagcugcaaucagguuugaauguauccucagacaccuuggaguucugacuauaccaagacaguuuggauagaacuggcauauggucagccccucccaaccccuggcucucucacugcaaggggccuugcaggcacacggcggggggugggggggggaaccccagcugacauggccacacccugucccauuucucccaaacagcagccagcccucagccauccuugguugcauggaccuaggaaagaggccugcgcaggcucggacaaggggucaggauccauugggcaggaaacucggguccccagauacccagacagaauggagucuaggaguguugggggucucuaggucagcaugucucuucuuaugcuguagggaaggguauggcuggagaagggcuugaguggagugcucuaaagccuggagaccaggcaggaaccccucuugccuggucuauuagggcaguaccugccucccuuucuccuauccaaggacuuaaaccuagugaaggaaauuaggccaggacaugaauaaugguuuugauaacagaugcuauuuaucgagugccugcucguguagaaccuggacuaagcuuuuuuauuuauuuuuuugagacggagucucgcucuguugcccaggcuggagugcaauggugcagucucggcucaccgcaaccuccgccucccggauucaagugauucuccugucucagccuccugaguagcuggcacuacaggcgcacgcuaccauacccagcuaauuuuuguauuuuuaguagagacgggguuuaacuauguugguuggccagguuggucuugaaccccugaccuugugaucccaugaucugcccgccucggccucccaaagugcugggauuacaggggugagccacugcacccaaccuuggacuaagcuuuuuuaacuucuuuuuuuuuuuucuuuuugagacugagucucgugucuugcucuguuucccaggcuggaguguaguggcacgaucucugcucacuguaaccuccaccucccagguucaagcaauucugccucagccucccaaguagcugggauuacaggggcgcacugccacgugcagcuaauuuuuguauuuuuaguagagauggaguuucaccauguuggccaagcuggucucgaacuccugaccucagaugauccaucugccuuggccucccaaagugcugggauuacaggugugagccaccaugcccggccuaagcuguuuaucuuuuuuuuuuuuuuuuuuuggagauagaaucucgcucugucccccaggcuggaguacggugacgcuaucuugucucacugcaaccuccaccucccagguucaagcaauucuccugccucagccuccugaauagcugggacuacaggugugugccaccgugcccggcuaauuuuuuuuuuuuuuuuuuuuuuuuugagacggagucucgcucugucgcccaggccagacugcggacugcaguggcgcaaucucggcucacugcaagcuccgcuucccggguucacgccauucuccugccucagccuccugaguagcugggacuacaggcgcccgccaccgcgcccggcuaauuuuuuguauuuuuaguagagacgggguuucaccuuguuagccaggauagucucgaucuccugaccucaugauccacccgccucggccucccauagugcugggauuacaggcgcgccuggccuaagcuauuuaucauuauauaauuuaucuucacaaaaucucugcccaggaggcacuguuauccuuguugugaagauuagcugacuaaggucaaagaaauguugugaccugcccaaggucccauagcaguuggguggcagagucagggcuagaacccacauuugcuugacuaugaaaccucugaguugaaucuacaguggucagggcugcaggugcauagacagucugagugcugugggcugggggaacuccgggagagugucuggcuuggguucagugauccaccuggcccugcaggggcucaccuggaccgccuggugccccugguggaggauuucugcaaccuggaugaugaugagcuccgggaguccugccuccaggcuuuugaggccuucuugaggaaguauguauggugggguugccuggggaucccuuugggaaguugguggggaugcuggcccaaagcaguaaaauuucaggacucccauugggcccugucccccacuccuguccuggcuggauccagcaaagcauuccucauccugccccacaggugccccaaggaaauggguccucacgugcccaacgugaccagccucugccuccaauacauaaaacacgaccccaacuacaacuacgacagugaugaggaugaggagcagauggagacagaggauagugaauucagugagcaagguugguggacagcccaucauugggguuggaggguggaggugaacacagccuuccugggaucccccaaccaaagacagcggucacauuuggugccccuguccugaugccagcucuuucucaagcuccagucccacccgcugugacugcacagaccacaguaaugauaguagucauugcugucauuuauugagcaucuacuaguuguguuccucacaauaacccuaaaaaaacagaaauuauuacccacguguuucagacaaggacacauacugagaagagaguggccugagauaacacaacuaggaauuggcauagcugggccuuagagccaggucugucaggcucccccaccucugcacugccaccguguacccuuuuaugaauggcuuucaggagauaaugucuuuaacccagcagaggaaagcucugaugguggaauggcaggcacuggcaggggagcaagaugucucaauggggguggacuugauagcuucuuuccuccuaugccugugguccugucugucauucagacagauuuccagggcagagaugccccuaggccugaaggcagggcaucgauggagacgauggauuuagagccugaugggguacuuggaacaagaugggaugguaaaugagauuggacaggcaugcgggggccuugaaugccaagccagggaggugggacacuugucaguaauagagagcuaaggauguguguucguggguggccuacugugggggugacagugauccauuagaggggauggcugcugagcugcccgguggccguggcccacuguggcuguccagacaccacccuguggguccaagugguccacagagugguaugggcaaggccaugcugggcucugagccugugccuuggggugcucccaggcaagacugucccccucugagccuccugugugccuccacaggugauagggcugggccucguggaccugaaucucagcucugcuguuccucgcugugugcccugagagucucacccgcucugagucuuagucuuaucgucuguaaaauggagcuuggcaguaccuucacuuuugaggugaugguaaagacugcacgagcccuugacuuucagggagauugucagguagaaagccacacaaacccagcauuuccucuuuauuaauccugccuggaagccuuuggaaucaggacccuugagaggcagagaucgggggagagaagaggccaaagggaggcucugucccuucucccuucuggagucccaguaaacgaaacaucacauagccaaaccugaugccaaaagaugaguuuugugccccaaauugauucuccaagucuacaugaagacuuggaagucuguuuuuucccugguacaguccagacaauuaagggucuggaggcagaggggaggacccuaguuuaacuccaaguauuuccuuaacuuggggcaagccacuuccucuaucuaaaccccaguuuucucaucucuauaauggggaaauaaucccugucucaaaaggucgucaugaagcuaaaauaagauuauggguuugacaugcuuagccccauccguagcacucaguagaugcccauuaaaagguagggaauguuccccauaggguaucuauaaaugcugaucaucaaaaagugaagcacagugcccagcucucucuccucccugucccuucucccccgagccacagaccuguccugggagaugaggguuccacgugugucuuguuccugccccagagagugaagacgaguacagcgaugacgaugacaugagcuggaaggugcgccgggcagcugccaagugcaucgcagccuugaucagcucgcggccugaccugcugcccgauuuccacugcacccuggcaccugugcucauccgccgcuucaaagaacgcgaggagaacgucaaggcugacgucuucacugcuuacaucgugcugcugcggcaaacacagcccccgaagggauggcuggaggccauggaggaacccacccagaccggcagcaaccuccauaugcuacguggacaggugggcgugccuucaccuccaccccuacccccgauuugccuacccagccacucacuguuagugucccuggacuuggaaacucagcugggagaacauccagccauggaagggaagggaaggggucccugggguggggggcgggagccagccaggcuucuggaguguaguagugacagccagccugccugagugagcuugagcaaguugcuuggucucucuguaccuguaaaauggacgcagaaaauuugccuacucuccaagggucugugugcggucaccaaaagccuggcacagagugagggacgagugcuugggagauaucuugaugccgacauccucccuggggaugugucuggcaaagccuccugguagugggcagguggguagguuucuuggguguucccugaccuugacuucccccuccugcccacaggugccccuuguggucaaggcccugcagcggcagcuuaaagaucggagcgucagagcccgccagggaugcuucagccuccucaccgagcuggcggguguccucccaggcagccuggccgagcauaugccugugcugguaucagguaggcuggacugcaaccagguaucugcuguucugggccacuuccagaacccagaccccaccccugaguugagcccccaguuccugagacagucugagacccaaucccaggcucagucccuggucaagagucuccaguggccucccacuaccagcagugagaacaaggcuggcuccagugaguucccuggacauguuucccucagcccuggccacuggucagggcugacuucuuggaaacuucugcagaagaguuuaggugcuucaguccagcucaggcacuuguagguaccccagccuugcuuccagggagggccguguugcaucagaggcgguggccucauaaccuuugcauucacccugcaggcaucaucuucucgcuggccgaccgcuccagcuccuccaccauccggauggaugcccuggccuucuugcaggggcugcugggcaccgaaccagcugaggccuuccacccacacuugccuauccuccugccaccugugauggccuguguggcugacucuuucuacaagauugcagccgaggcccugguggugcugcaggagcuggugcgggcccuguggccgcugcacaggccucggaugcuggauccugagccauauguuggagagaugucugcugucacccuggcgcgacuucgugccacugaccuggaccaggaggugaaggagcgggccauuuccugcaugggccaccuuguaggccaccugggugaccggcuuggggaugaccuggagcccacguuacugcuccuccuggaccgccugcggaaugagaucacccggcugcccgccaucaaggcgcuuacgcugguggccguauccccacuacagcuugaccuacagcccauccuggccgaggcacugcacauucuggccucauuccugcggaagaaccagcgggcuuugcgacuggccacacuggcagcccuggacgcccuggcccagagccagggccucagccucccaccgucugccgugcaggccgugcuggcugagcugccugcccuggucaacgagagcgacaugcauguggcccagcuggcuguggacuuccuugccacagugacccaggcccagccagccucuuugguggaggucaguggcccugugcucucagagcugcugcggcugcugcguucgccccuguugccagccgggguucuggcagcugcugaaggcuuccugcaggcccugguagggacccgucccccguguguggacuaugccaaacucaucagccugcucacugcgccuguuuaugagcaggcuguggauggugggccuggccugcacaagcagguguuccacucauuggcccgguguguggcagcccucucagcugccuguccccaagaggcggcaagcacagccagucgccuggucugcgaugccaggucgccccacuccagcacgggggucaagguccuggcauucuugucgcuggcugaggugggucagguggcugggccaggccaccagcgggagcugaaggcggugcuccuggaagcuuuggggucacccagugaggaugugagggcugcagccucguaugcacugggccgugugggugcuggcagccugcccgacuuccugcccuuccugcuggagcagaucgaggcugagccccgacgacaguaccugcugcugcacucacucagggaggcccugggggccgcccagccugacagccugaagcccuacgccgaggacaucugggccuugcuguuccagcgcugcgagggugcugaggagggcacccggggggugguggccgagugcauugggaagcugguccuugugaacccuucguuccuucugccccgcuugcggaagcagcuugcugcagguaggcacacaggugugggcaaggcagcccaccucggaggugggcaguuugccacugagcauccaggcagcuggggcagagugagcuauuucaagucacuggauacaagaaucacgguaucuauacgacagaggcaaggaagcuacagaggaacacacagugauaccugagacuuaaagccuuccuccuaugggacugugggauagaagggacagaguccuugauuggucccuacaacaaauacauuuaaaaaucucaugauguuggcuaggcaugguggcacaugucuguaaucccagcacuuuggggaggcugagguggguggaucacuugagccuaggaguuugagaccagccugggcaacauggugagacccugccucuaccaaaaaaaaaaacaaaacaaaaaaccucaugaugccaacuucauaauccuugauguggacaguagcuuagugcuccacacagaggucaacaaaaacaguuuucccaguagccguagacugcagccugcagagggucagcucuuucggcuagccugagccaagagcagacgucaguauagacggggacaggcugacaugcccccgaggcuuggagagggcugggcaagaaccaggaggggcaggcguuuuggcuugucguguuuuggcacaccaggugucuuagcuucaggagguggaaagcagacagguagggucaucaggcuccuaggaaaaugagaguucccagaaugaaaggccagugggcuucgagcuggccagcuggccccuuacagaaccaguggaugcucugcuugacagaaugcagguacaguguuugguaaccuaugugguaccuacaguaauuaauacugaguaaaucaagagcugcuguuguuacuagguagguuagugauuucaguuaaggccuucuuggguugcuggguucguaagaagcaguugucuggccucaggacuggauggaagaacauuguugaggacacugucuauuacaucacacaaccuugagagacgagaguguuaagaugcagaggagcccugcuuugccuaaacaccuauuuguuucuaucucacgugcacuguugaaccagccacccggucacauuuccuuuuuagcaccaacugcugggaagcuuagagccagaugaguggucugcuucuaguagguuccugggacuuccuuauugaugcucucuguacaucuuccugcuagucuccuucucaccucccugccuucagucguccuuggccuuguucuuguuuucaguucacuuaaucuuacucucuugugccugucuucaucagccacccuaaaucuuccugggagccagucaggcuggcaagggaaagagguaaaagcugaaagucugaauucaguaacucuuccauucauucaugccuuagcaccaaaugguaaacuuuuccucgaggcugaacauaaagccugugggguggaaacaccuuagcccauucacugcauugugcugggguugggcagggagcaaagggggcgagccacugaggagagauucagacgcagguggagcguccacccauucguuuccuucauuaagggaauguacuuccccucuuuacugggcuucucuacucagaaagcaagcggcaaagcacaaguaagcaagcucucugugaccgagccuggaggugauccgaguucuguuaggccucccugaccaccagccagaacgcagccccaggaagaggggcccagccaggaauucuggaucugcuguguggcccuagacaugaacuuaaacccucugagucucucuuuccucauaugucaaagagaugauuuuuauuggugauuuuauugguucuuuuaauacuacuuuauuauuaauaggaucauuguuaggacucauugagauaacaugucugaaaaaucccaaggccugagggaaggucuuuguuggagcaguuccugucuugguuauugguucccuguuugcagccugugguguuaccugagcacuggcaguccuacuguuucagcugcagcaggaagaauugaggggagauucaaggcugccaagggaaaugguagaauccacuuucccagagauggggaggggguacaguucuguuuuccagggaagcagggggaggagccuaagcaccuucugaucugugagccuccaggauuggccccugccccucacuaacucaccucuucuuguccugcaggucggccacacacccggagcaccgucaucacagcggucaaguuccuuaucucggaccagccccaucccauugacccccuccugaagagcuucaucggugagcaccuaccucuugccccuccaccuuguucagugcccccacccaguccuugagcuugggcugauguuuacuacccaauagccaagggcaaugggagacccgggaggugugcccaugaugggcagcagggccuggcccuccaguuaaaaggccuggguucacaucccugccuuccuacugccacucaaucauggguggguguggcaugcccaucacaccucuaagccucgcuuuccucaucugucaaaugggcgugagaaacucuuauuaucugcauuuucuagaguuguccuggaagcccaugggcaacugagggagaagaugcuucaucaacauauagacucuugggaauggaaaaccaccagccucucacaugccuuagcuuuugcgggccccaaaguggggcagggaagagugcuccccccggccccgccuguccacuagaucgcccucugucugaggggccuucuggccugaggagcccaagcagccuucacugggaggagaggaacugagaccucccucuggggcucggcaggaccacuggguuuuuccuaggaaggcagagcccucgccccuucagagcuuggagccugcagccccucacugggccacacuggagucucagcccacaucuaggcagggcagcccaguagagagagguuuuggagcucaccugccucagguucaaauccuggcccugcuauucccugggugugugaguguggacaagucuucucauccucagcuauaaaaugggggugcugggccaggugcgguggcucucgccuguaaucccagcacuuugggaggccaaggcagguggaucaccugaggucaggaguucaagaccagccuggccaacacggugaaacccugucucuacuaaaaauacaaaaaugagccggguaugauggcaggcaccuguaaucccagcuacucuggaggcugaggcaggagaaucacuugaucccgggaggugaagguugcagugagcggagauugcaccacugcacucuagccugggcgacagagcaagacuccgucucaaaaaaaaaaaaaaaaauuaguugggcaugguggugggcaccuguaaucucagcuguuugagagacugaggcaaaagaauugcuugaacccgggaggcagagguugcagugagccaagaucguaccauugcacucuaaucugggcaacaagagcaaaacucugucucauaaauaaaaaaaaaggaacgguugugcugauacucaucugccaggggccuguuaugugggaccaaggggccagcagacgugaccguguucugcacuggagaacacgugcagaagcucuagcaaggucaucggcagcaacuuugucccuugcccuaaugcagugggcacaugcccccccuccggccugauuuccuccauuguaacggagcugcccuuggcuagcaccaccagcgaccuucacauggggguucuggcuugcuuuaaaacauuugaacugguuuuugagcucucacuguguaucaggcaccacacuaggcccuuuaauauaccucaucauaguggaugcucacaagcaaggagcugugagcauccuugcucugcugggagccuuccugcccuucccagugcaucacaucaggggcacauggagguggcuuguccccuggcuggcgaugguaacuuugaucacccaguucagguggauaccgccaugguuucucuccacucuaaaauuacucuuuuuuuccuuuggaaugaauaugaauuuuugaguacauaaaauaaguauuuuauguaaacauccuuguucucaucaauuuuuuugcccacuagguuuagcauccacgguuguuucuugccugggucaaugauuacugugauauuugccaaauggugacuuucuaguuccauuauucuuuccauaguuacaaguuugcauucuacugucuggaagaacuuuuucuucucucccacuuauuuauucaucaauuuauuugucauuagagacucauggcuucuucccacuucauuccgugggcuauacuguuacugucuuuaauuuugaugcauuggaagcccuucaagcugguuccuauuuuuuauugacauguuucaaucuuuuuuuuuuuuuuuugagagagucucacucugucacccaggcuggaaggcaauggcacagucauaccuuacugcaaccugccucucaggcucaagcaauccucccacuugagccucccaaguagcugggauuacagaugugcgccagccaccacaccuggcuacuuuuuaaauuuuuuuuauaaaaacaggguuuugcuauguuacccaggcuggucucgaacuccuaggcuuaagugauccacucaccuuagccucccaaagugcugggauuccagacgugagcccccgugcccagccuccaucauucucuuaaguguauccuugcuuuuggcacgaugagaugcuccagauucauugcgaaccucuccugccccaguccuggaaucagccauuucuccaaggaguccugauuccuuuuaguggagaaugguauuuugaauccaaaaucuggacacuagaugugccuguugcuguuggggccucauugcuucuaggcccucucagcagacagaacuaggaaaugcaugucuauacgcagagacacaaacacauacguguauacaugugcuuccagaugcacacccaugcacaucuuucuuugucccuccuucuuucccucccugccucucuuucucucccucucucuucuuucucuucuaccuaccuacccaccuauuuugaaaaccuugaguucauagcugcuucguauugcagucuagcccccuuuccauauguguaacuccuuucucuuacaguaagaaacccagcucccauuaucuacaagauauuuauuuucuuaauccugaaauacacagaaaguagucugagaauugcugacucuuaucucugugaaaacuaauacucguguguaguuuuuuuguguuucgcuagagggcagcuagucaaaauacucgaaguggcuugguuuguucucuccuucauaagcugggugguuauguggaucauuuuaaauacaguuuuuguugguuuguuuuugcaggggguggguauggguacggugguucacuccuguaaucccagcacuuugggaggcugaggcgggagaauaaccugaggucaggaguuccagaccagccuggcaaaaccccaucucuaccaaaaaauauaaaaauuagccagguguaggcugggcgcgguggcucacgccuguaaucccagcacuuugggaggccgaggcgggcggaucacaaggucaggagaucgagaccauccuggcuaacacagugaaaccccgucucuacuaaaaauauaaaaaaauuagccgggcaugcuggcgggcgccuguagucccagcuacucaggaggcuugaggcaggagaauggcgugaacccgggaggcagagcuugcagugagccgagauugcgccacugcacuccagucugggcgacagagcgagacuccaucucaaaaaaaaaaacaacaaaaaaacggggugugguggcacacgccuauaaucccagcuaccugggaggcugaggccugagaaucgcuugaacccgggagaugaagguugcagugagcugagauugugccacuguacuccguccugggcgacagagcgagacugucuuuugacucaaacaaaaaaaugauaaauacaguuuuuuugcauuuugguuuuauuuuuagggauucccccauccuuauuucuuuauuaaguauauaaaacauuaacaauucuaaaauguuuaaacuauaauggcugggcguaauggcucaugccuguaaucccaacacuuugggaggcugaggcagaaggaucacuugaguccaggaguuugagaccagccuggguaacauagugagacccccaucucuaaaaaaauuuuuuuuuccaaaccaacauggcacauguauaccuauguaacaaaccugcacguugugcacauguacccuagaacuuaaaguauaauaaaaaaauuuuuuuuaaguuuaaacucuauaucauaguccuuuucugcuacuauaacagaauacuacagauuggguaauuuauaaagaagagaaauucauuccucacaguuguggagacugggagguccaagaacauggcaccagcaucuggugagggccaucccaugguggaaggaagggcagaagugagcaugggagacagagagacgagaggcggggcuuaacaggagcucccucccaugaucacugacccacuccuguagugacggcauuaauccaugcgucagggcuucacccucgugaccuaaucaccucucaauacuauuaccauggcaauuaaguuucaacaugaguuuugguggggacauucaaaucauagcacuguacaagucugggcacaguggcucaugccuguaaucucggcacuguggguggccgaggugguggauuacuugaggucaggaguucgagaccagccuggccaacauggugaaaccccgucucuacuaaaaauacaaaaauuagccaggcauggugguucgugccuguaaucccagguacuugggaggcugaggcaggagaaucgcuugaaccugagagguggagguugcagugugccgagaucacaccacugcacuccagccugggcaacagagugagacucugucucaacaacaaaacaaaacaaaaacaaaucauggcacuguacaaaaaggaguauccugagaagugcuggugacucuguguaaguuucuugaccucucugaucuuuaagagccucaccuguaauaacaaguucacauucacagaguccgugcugugugccaggcacucugcucugugcuuuuaaugcauuaccacauucaaaaaauuuuuuucuuuuuuuuuuuuucaagauaaugcugaggcaccacauuuuaaauucuaaagacagucccauagcauagguucuguuacgacucccauuuuacagaugaggacauugaggcucuccaaggucccacaguaaauugguagagcuggaauggaagccacaucagcucaagcccacauucuuaucuggccuuugaaggguuguuugugccuggcacaaaguagaugcucaccacacccagcuuacccccauucagccaguucugcacgugcacaguaaccagauggccgggguggugagggaggugacuuugugcuuuggcugugcaucccccacgccccucauguucuucugccaggagaguucauggagagccugcaggacccagaccugaacgugcgccgugcgacucuggcuuucuucaacucagcugugcacaacaagcccucgcuaguccgggaccugcuggaugacauccugccccuccucuaccaggagacaaagauccggcgggaccucauccgagagguguggagcagagcuggggacccaggggaagcugggggugaugccaccucucaugccucacuguuagggcauuauuaucucaucagagcaggugccggggccacauggccugggucaaguccugcccugacuccgagcugugggaccccagccagggcaaccugauccucucugagccucaguuucuccucgugagcacaugagggugcuaauugugucugcgucauaggguugcugcaacaauuuggugagugagguccuguaaguguucagaaccaccgcaggcacacagccagcgcucaguaaauguugauguuugacagguguucacugaacaucugcacugcgcccaagugccaggacucagaguugggccugacuggguuucugccaccaaggaguucaucguggcccccuaaaggacagagaugccaacucugcugauuacagacagcccccgccuuacaaugguucaacuuuacaauggugcaaaagcaguagcguucagcaggcuccucaccuuaugaugggauugcuucuggaagccaacuuacaauggaccuauugugauguaaucccaucauacaccaaggagcagcugcguuucacuuagagcccaccugguaaaggaaggauucgggggcagagguuaaaggugauuuaguaaguuugagcuguggaauacuagcagcauugaggcccuuuaagcugggcuuugaagggugaaaagguguuuaccauuaaaacagggcuucaugguugaaagcuucagaaagaccugggugucuuuuuuguuguuuuuuuuugagacaggaucuugcugugucaccuaggcuggagugcaguggcacaaucacagcucacugcagccucgaccuccugggcucaagcgauccucccaccucagccuccugaguagcugggacuacaggcguguaccaccacaccuagcuaauauuuuguauuuuuuuguagagaugcgguuuugccauguugcccagacgucucaaauuccuccugccucggccucucaaagugcugggaggacagccaucaugcccaaccuaccuggguuuuaaauuccaguucagccacuuacaagcaguguauccuuaaccuguccagcucaguuaauuaaccugcccaacucaguuuccucaucugucauuaaaugggaucaguaacauuuacuuuuuuuuuuuuuuuuuugagauggagucucgcucugucacccaggcuggagugcaguggcgcgaucucagcucacugcaaccuccaccucccugguucaagcaauucuccugccucagccacccaaguagcugggacuacaggcacgugccaccaugcccggcuaauuuuuuuguauuuuuaguagaggugaaguuucgccauguuagccaggauggccucaaucuccugacuucaugauccgcccgccuuggccucccaaagugcugggauuauaggcgugaaccacugugccuggccaguaacauuuacuucugauggcauuugugaugcuugaaugaaacgucaucagucaagcagucagcacagugccugccacucagacagugccugcucaguagauuauaagaauaauuguucuuauugccacuguuaucacuugggggaaaugacacugcaggcugagcaaaggcauggagacuugagaguauaaggcacgauuuggggcuggcauggauuguggaauagagaugugggguuuguagcagaagcuagaagagguguccuuacacccuggggccauaucaccaaccuucaucccuccugcagguggagauggggcccuuuaaacauacaguggacgaugggcuggacgugcggaaggcggccuuugaaugcauguauucacugcuugagagcugccugggccagcuggauaucugugaguuccugaaccauguggaggacgggcugaaggaccacuacgacauccggguaagaccaagcccccugccagaucuaugugccccuguaccaagggauagucgggcaccauuggggccaugcuuguuuguccuugcucccuacuccaggcacccaaugaaaauagcugcauuguuguuuucugauaagaaaaggaaccugugucucaaacaccuuuggugggagucuacacugggcaggcucuuuggaggaugguuucacagcaaccagaaaaaaaaaauuguccaggugugguggcuuaugccuguaaucccagcacuuugggaggcugaggcaggaggauggcuugagcccaggagguugaggcugcagugaaacaugaucacaccacugcacuccaaccuggacgacaaagcgagacccugucucaaaaaaaaaaaaaaaauucccagacgaaauuuuugacccugcagggcacuuucagcuguggaauacuagcagcauugaggagcgagcugcaucucuucguguugugaccugaaagagcuccaagccccaauguugaguggcaagagcuaguuccagaaguuaggaccauuuucuuaacagacagagugagucuggggcugguggagacgucgguuucuucaauuuauaucuuucuauaucauuuuuuuaaauguuaaaguuuauucacauauaugauagaaaucauuuaauuguggcgaaauauuaauaauacaaguuacuaucuucaguaacuuacuaucugcaggugaaguguuuuuuuuuuuuuuuuuuugagacagggucuugcacugucacucaggcuggagugcaguggcuugaucucagcugacugcaaccucugccucccagguucaagcgauucuccugccucagccucccaaguagcugggacuacaggugcccaccaccacacucagcuaaauuuuuuuuguauuuuuaguagagacgggguuucaccauauuggccaggcuggucucgaacuccugaccucaaguaaucugccugcccuggccucccaaagugcugggauuacaggugugagccacugcgccaggcuccaucuucacuauuuuaaagugcacagcacaguggcaguaagcacauucacauugcggugcagccgucaccacuguccaucucagaacucuuuucuccuucccaaacugaaaacugcacccauucaacacucuaugaauuugacuacucuagguuucugcccuuguaaguggaaucauacaguauuuguccuuuugugaccaacuuguuucacuuagucugauguccucaagguucauccauguugcagcaugucagaauuucccaguguuguauguacagaccaccaguuuguuuacccauucauccaucgcuggacaaauauuuggguguucccagcuucuggcuauuaugaguaaugcgacugugaaccuagguguuccgauauccuuuggaauccugccuucaguucucuucacuuuacccagaagugaaauugcuggaucauacggcaauucuguguuuaaugucuuaaggaacugcuauacuacaacuuuauuuuuaaguuuuuauuuauuuguuugagauggagucucacuuuauggcccaggcuggagugcauuggugcaaucuuggcucacugcaaccuccgccucccggguucaagugauucuccugccucggccucuugaguagcugggauuacagaugugcaccaccacgcucggcuaauuuuuauauguuuuaguagagacaggguuucgccauguuggcuaggcuggucuugaacuccugaccucaggugacccacccaccucggccucccaaaguguugggauuacaggcaugagccaccacgcccggccccauauuacaacuuuaaaaaauauguacuguaagcgugagucacuuuuuauaaggaaaaauuaauacaaaguaaucaaaaguaacccauacuuguuuuaaaagauuuacacaagaugaaagcaaauaaagaagcaaguaauaaucacccaaaagcuucuccacacccagagaggccugcugucucaguguguuucuugggaugaugcacauagacccucauucauuagucagccaguauuaagugagugccaacacgccaaggucaaugugagagguggggucccuguucucaaagcuguggagaugaguuuaugagaccuguuuucuagaaaugggaucacacacaugcuguuuuuuuccccagccuuuuaacuuacauuuacuguauguuguuugcuuugcuuuucaauauauaucaguccugucaacagcugcaggaguucccauuucuguugcacucacugcuacacauguauguuauuugcacauuuucacaauuacagacaaugcugcugugaacacccuggugcauuacugugacccacggugugaucggugggcuucuaggguggagugcauguuccugcuaaagcauccgaugcgcguggugaggcugcaccuccugcagcgggcgugccucugaccacuccagacuuggaguuccugggacgcuccuuccugcacuuccugucugccugucucccccucggcuuuauuauugcuuuaaacucuugcuuccugccaacccccaagaaagagaaaagaagaaacaacauaaguucucugggauuccagccccaagaucuugguugagaaaggggguuggguuuuccaguguaugccaugcaaacuaguggaaaaugauggggcgcacaaagcugaacaggacuuuccaccacaggguuccgggaggcuccagacgggagggguguacucagcuuccaucaucugggugugccugguauuaggcaucuuguggggcuacugaccccaggacacagagugaggaguucugggccagcccaaagcuccaccuuguggggauuuuucuccaggaucgagcaagucuguuucuuccauccagucuggccauauccucucaugccugcccuccaggagcgcaggacagggccuaggcaccagugcagccuuggaguccacucugcugccacccccuggggugaggaggguggguguuacagcuauagagcccacagcuuugcgucaucaagucuucaagugagccuuuagagagggagugaacaccgcccaguucacaggggagacggaaucuugucuaguucuagggcacagggucauggaguagccaagagucauagcuccugaaguccagcaccgcugcuccuugcugccgugggcugggccuccuccuuugcuguggggcuuaggggucaggguguggagauggguagggcguggggauuucagacaaccagucuuuauggugugcaaggcuucuuugugaggacuugacuauuuucaaaagacaggacaauuauuccccuacaggcugaaucuaggccugcagccauguuuaguuguuguuaaaaguuuuuguuugguuuugaaaucaggugucaacauuuaaaaaucgagacuuuuuuuuuacaugaaaauugggauuucuuuugaaaacaauccaguggccccaagcuacauguuugcacucccaccuggccacacucagccagagcugccccagcagcccccuucacucauccccagcaucugccugacuggugggcaucugagcuugagaacgacucccucccuggugcuuuucugauccuccuugggucauccaaguguaguuggcaaagaaagugucaccauuugaggaaacagacccagagagggagagacucuggcaggacuucacgguggucugaacuugggcuucagguuucaguuguggggccucugcucuuucccagggcuggcugcugcucuugcuccugcaccauuucacuaagaaccaucuccuuccucugggcagaugcugaccuucaucaugguugcccggcuggccacccuguguccugcaccuguccugcagaggguggaccgacucauugagccacuaagggccaccugcacugccaagguaagucccuggcccagcccuagcccaggcccuggagcaccuauggaguccucggccagucguucaguuacccuuacugagcacuuccugcagugcaggugauguugugaaagugcuucauuuaaucauugucauugcccuauaaaguaccucuuauuaucauuguauacacaggggaacagaggcuuugagaaguuguuauuggccaaggcuacacagcuaguaaauugcagagcuggauucagacccaccucugucucuccuuccauucauuaaacacuuccugggugcugagccucgugggagauacuaaagauguaacauugagccugauagguucccuacugucaaucucucaccuccuuguugggaagcugggucagaugacuggucuaggacaaagcugcugcuagacuggagugccugaagggucuggaggagggauguggggugcaagcccucauggaaagcuggcguugggagcagagccuggcgcaccuacgugguaccuaguaaauaccuguugaaugaaagaauacauuuggguuuuuuaaggaugggaaucauuaccaaaaggagagcaguguuuuagguuggcacuuaaagaggagagauacccauaaaguggugauuuucaaaaaugaaaucuucuguggauaaaacacuaaaauugguaguuuauucauagaaaccugccuuguaaguuuacauuuuuaacauaugcuuauuauugaguccauccaaaaaaacacuucuacagggccaggccaguuuugacagucucucauuucugguuuucucugagcucuauggcaccaagaaaagucccaguucuuaagagggagguauauauggcacugcagugccagaacauucuugcaguaaagccgagguggcaagagaagcucugcccugaguuuccacaagagccacucaucuggccacgcggaggaugcugucuguugggcauugggaugagcauggguaaauccacacccacaguccuuacccaugacccugaaaucuaccaagcucugacaaccaaaagcuuuuuaggaaccuguuugucacacaacuugacuugaaguggcaugaggcuaugaucuuuaauucuuaccaauguaccacuuuuauauaagggacuugaucaucugaggauuuuggcauccccugggauccuggaaccaaacucccauggauacugagggacaccuguacuacucacauuacucauacauguaguagaguauucauguauuugauuacaggguauuguacaaaaccccucgggaauguuaucugcacaguauuaccuuucuaaaacccaaaaugucuuggauuccaaagcacaucuggcuccagggguuucagagaagggaguguggacuugugucguuuaauccucuuggcaacucuuacgacgaggcagcucuuacuuauagauggggaaaugaggcucaaagauguaguuaccugaagucacagcucuugggggcagagccauuugaacacaggacucugcaacuccaaugccaagcuguuacccacugcauugaauucuuuaggaagagcccagcauaauaaggaacuugaacuuuaguccauaagcaguggaggaauuacugagcuccucugccuagguaggagauggugggggaagaggaaacagaaacugcaggagguaguuuggggugcuuacacuccggcugcaucugcaaaacugauugcggggcagggacuugaguauggggaggaggcugcuagaagaccaucgcagugauccauucauucagucuagucauauggugcuaagagcugguuuuaagcacagcaaauauaggcuggaucccugcagucuguaggagguaaguaugggaacacaguacuugccacugucaauuaacaaaaagcgagcacuucagauuggcugcucagaggccccucaggcuguacucaagcugauuugaauggcaaagaaccucuguggggaaacuagccagugcaaaagcccagagguggaguuaggaaauagcuggugagacagaagccucaggagaccucgcagcagggauuuauguuggggaagaugauggggcagagaggaagccaaagaccagugaggaggcaguggugugggccaggcucaauaaaggauggcugcuucugcuguuuccuacuuuaggucaaagcugguucugugaagcaggaguuugaaaagcaagaugaacugaagcgcucugcaaugagggcaguggcugcccugcugaccauccccgagguggggaaaagccccaucauggccgacuucucuucccaaaucagauccaacccugaacuugcugcccucuuugaaagcauccagaaggauuccgcuucagcccccagcacagacucaauggagcucagcuaguccccucagcaccaaggugggcccucgcuuaagagaaaggagcccacccaaguccgaggccuccccaucccaccaucgcaggucucuacuuuugcccuuccaccaucucacugggggcccugucgcuccuggucagggcuuacagugccuucuccagggacccaacucaaaggcccccagcccaagcugugaggcugccaacaguugggccccuuccuuaacucaggacagucauccaaagaaauagggugaggaaguuuuccagugacuucacacuguaccccuccauagucugucugguuccuucagagggugucucugccucacaaacuaguaguauuuagaaauaggcugugcugucagcuguaaaagaucaggaggcagcagacaccacucugguuucuucacugcauucagcaaugccugaaguuagugcucaggccgggcaucucaaaagaaaagauacuugaguuauucacauuuuaaaauucaaaacgguucauuuuuaaguggcagugaugaaucagaaauuuggaagaugauacggguuucuuuuuuccagggaggaggaauggguuggguagggaacuggacaggcuuggaccucauguuucauuucuaauuucaaaauacuuauuagcaaauugggcaacaaugggcaucuuccaugccaccacccaggcauaaccaguugguuuguuuccuucugaggaagguuucaaaugugucuaguguucaguauugaggacaaagaaauacaaguggcaggcccaaguauuuucugugauaucccagguuaauaaagauuagauucuaaguuacuucuuuccuc

SEQ ID NO: 191677 - RNA, 27331 nt, Homo sapiens
guccguagccacggcaacagguugcuucugcagucugagcugagcgccuuucgcacgacuuggaguuacgguuuaucugauaccccgguaccccuacgcaagcaagcccacaucgacacacauucacacacgcccuucagcacccccucccagcaccacgaccauggacgacgacuaugaagcguaccacagucuguucuugucgcugcucgguaagccccgggaagaagcgucugcagggagcgcucagcgcccuaaggacgcgugaaaguggggugagggcaaaaacucagccacagauauugugccgacccccucugggugaaggguugccauggagucgggggcaggucauguacauuucugagauuucuaucugagccuaguuggaggaaccagaggcccgacccaugugacgggagcccuccagcucgcccuguuucucugcaggacauuaauguauucaguacuggaggagaggcauggagaagacgucagucuucaagguuuuggcaguaaugugcuggggaccaaguucuuggcaaagcaaugcagcuucacggguaaaggacagagauaaauggauaauuacagaauaagaagggguaaaugccgggcccagggaugacacccaggaguaaaaggugugcugaggguaugggauggggaggaacaguuccaagcuuuuggaaaagaucuuuacacuggagcuuaaaggauaaaaaggaguucuccaagccaaaaggggaaggaaaagcauuucgggcaaggaaacagcaugacccaagaggucuggugucucuggaaaugaggugagagaggucagaagggacaagaucauaaaagauacugcaagccaggagauggagaggccacugggaguggcaggacuggauugggagcagucagaaaagaccugagacugaguuggcagacucagaauguugguguggggagaugagagcugggggcuauaaagcuugaagacugaaggucuucuccaugccgcuucuccagcacugaacacauuaaugcccaguggagaaacagggagagcuggagaggcuggccaccuuucccaggcacacaggucagggcucuggucaaaugcccaagcuaaagaugcugggaggugagggagaaggcccaggcuagagggaacuacgggacuugggggcugguuggucaggaaacacagaagaggcaaauaaagaugguucucaaguuggcagcugggggaccugguagauggagaugucuuccacagagauaagagaacguacucagaggacccaguuagugggggaaggggcacaaagacaaauccagucuugguugguugaguuuaagauccuugucaguagcugggcacaguaucucacgccuguaaucccagcacuaugggaagcugaggcaggaggauugcuugagcccaggaguuugagaauagccugggcaacauagugagaucccaucucuacaaaauuguuuuuuaaaguuagccaggccuggugggguggcucacgccuguaaucccagcacuuuaggaggcugagguggguggaucacgaggucaggagaucaagaccauccuggcuaacacaaugaaaccccgucucuacuaaaaauacaaaaaauuagccgggcaugguggcaggcgccuguagucacagcuacucaggaggcugaggcaggagaauggcaugaaccagggagguggagcuugcagugagccaagaucaugccauugcacuccagccugggugacagagcaagacaccaucucaaaaaaaaaaaaaaaaaaaagguuagcuaggcuuaauggcaugcaccuguagucccagcuacucaggaggcugagcugggaggaucauuugagcccaggaguucaaggcugcagugagcuaugauugagccacuguacuccagcuuggggaacagagcaagacccugucucaauuaaaaauaaauaauaaaaaaagauccccggccgggcgccguggcucacgccuguaauccuagcacuuugggaggcugaggugggcggaucaccaggucaggagaucgagaccauccuggcuaacacagugaaaccccaucucuacuaaaaauacaaaaaauuagccggucgugguggcagacaccuguagucccagguacucgggaggcugaggcaggagaauggcgugaacccgggaggcagagcuugcagagagccgagaucgugccacugcacuuuagccugggaaacagagcaagaguccgucucaaaaaaaaaaaaaaaaaaaaaaacaaaaaaaaacccuguaagccauccaaguggagauguuuuaggaacaacuggagguauaaacuuggagcuaauuccaagucaaaaauauugguauggauguccccagcauacagaaggucauagaaacaugagaauggaagggauuauuuaaaaagagaagagacccuggguauaagccuggaagcaacaaccuuuaaggaguaaucaggaaaagaggggcccaaaaacaauagccggagagguagaauuggacauagcaagagauugaaucaagccaagagcagggagaauuucaagaaagaguagaauuguuuccagacaccuauaggcugucugagaaaagagagaacaaguguguuuucugggacauccauggggaggacuagaaccaaaggguagaaaguccagggaaacaaauucugggucaauauaaggaaauauuuucuagcagucagaguuuaguguccaccauguuaaguagaaaguuccacgucacaggagauguauaaacagaggcaaagucugccaguggcauugaggagagugucccugaccugggcaggugauugaacuagcuggcgucugagagcuuuccuugccaauuuccuaggaacauugucacauagucucuacccauaacuacacaaugacagccucuuuuauuauaagagcccauuucccuuucugucaauggacacaggacuccaaagagcacuagaaugaagcucccugaggagguuuggugggcaggcacccuuggaaaguggggucaggggcuggugcagguuuagaacugugaggagaaugacucggccaggggaagcccuggggaaugcagugcucuucagagggcacagcaaaugcaaaaacugaaaacccagagccaggaaggaacaaggcaccucagacaacagaaaggaggacagcagcugggaccacaugagugagggggcgggggcugggaggugacaagggaagaguggggagcagggccagugaaggcagcuuuguaggccacagaaggaggcggguauuuauucaaagagcacuaagaauccauugaaugguuucaaauggggaagggacagacugugaauuuacauuuguaaggcucuccuggcugagggcagaacauggauugggggucuagggaggacccaaaugggagcagcaagaccuguggggagcagguuuuguguucccguggccugcaggguaaaguuucaaucucuuagccuggcauuugagaugacgccaaccuuauuucccacuaaccuccuccuuuacacacagugggcuuccaacauguggaacugucuggugacccuaaaauccccaaaucccacuccugaccuuuccccaucccugccccuccaccccaugaagccagaccauucuugaagguccacaucaaagacaccucuuccuugaugcccucccaggucccacagucagcauuucucccccaacugagaacaucuuguuacccucugggugccccaccuuguuccauuggguggacugagaacaggugaaccacgguaggugcccagccuaguuuaaucugcaccugguucagcaccaagcccugggggauucucaauaaauacugauuugaugaaugacuacauucucagucauccccugcugggaaugaacuuucuuguggucaaaguaaugauacauguguuguuuagaaguguucgcuuccaucccuauugauguguaauaucuguucuagcauugcuauaaagaacuaccugagacuagguaauuuauaaagagaugagguuuaauugacucacaguuccucaggcuguacaggaaacauggcuggggaggccucaggaaacuuacaaucauggcagaaggcaaagacaggcacaucuuacauaacccaagaaggaggaagugagagcagggggaggugcuaugcuuuugaacaaccagaucuugugagcacucgcucucaugagaacagcaagggggacguccucucccaugauccaaucaccucccacuagaccccuccuccaacaauggggauuauaauuuaacaugagauuugggcaaggacacagaugcaaaccauaccaugauguuuacuuuucuuauuugcugacucugaaaggaacacaugggccuuguaaagagacuuaacaaauguacugaauguccacuuugggccaggcugggcaccgaggacacaggggaacuaagacacaguccuggucacugggaaacucacaggcuguugggaaagaaagaugcagaaaguaucuucauuucagaaaaauaugguaaaugcuuaugaugggacuaagugugggggcuaugggacccagagggcccaugagaaggggagugggagggcuucaaggggccgggaugccugagcugagucucaaagggugagucagggaucaagaagugaagcagggagggagaagagcaugucacagggaggaaacagcauggcuuguguguguugguggggcagaucuguuuggauacaaacguaagggaaggcagaaggagccagagaaaucggagaggcugguaggggugagaggaccagguggggccagguuaaggagcuugaacuuuacucuagaggcaguuaggagccauggacagguuuuaagcaagggaguuuggguuuuaggaggaaaaugacagugacaguauuuccaauaagauuguuauaucccuucugauuuuuuuaaauuuuuuugaaaaagggucucuguugcccaggcuggauuacaaugcggguaaucucagcucacuguagccuugaccucccaggcucaagugauccucccaccucagccuccugaggagcugcgacuacaggcgugcaccaccaugcccggcuaguuuuuaaauuuuuuuguauagaugaggucucacuauuuugcccaggcuggccuugaacuccugggcucaagcaauccucccaccucagccucccaaagugcuuggauuacaggcauaagcuaccaugccuggccccuucugauuuuuuagaacacuuccaaacuguuaucucauuugaucuucauaacaacuucaagagguagauagagcagaguuuauaucauuucagaaguaaaauacuugagacucagcaggauugggugacagcccuggguaauaucaaguaacagcuaagagccgagcucuggggccagacaaacugaaguucaugucucagcucugcuacuaaucaacugagugaccuugggccucucuaggccucaauguccuuaucugcaaaaugggcauaaucauaguaccagcaucauaggucuguccauuuuucacucaccaaauauuuacugaguucccauuauauguagacacuguggaggugucagggcuccagucaggaacaagagagauaggguuacagucuucauggagcucauagucuacuagaaaaaauaaacaugaaccaaauaauugcaccaggggucucaaaggcaaauugcugcccaaaccgaggacuuaauaaagaaaaugagcugccugugagacaaaaaggaaugggggagccuguggcaagcuggagagggcaaugccucagcccaaaguagcucagauugaaaaauaucaagcaaguugucaaacaaaacaagaccucagcccucauucagcaugagggccaccaguuuucagcccuuguuguacccagucgugauaaguggucugaaggaaagugcagguugugaugcaaagaugggaccuggaggauaaggaagagugcccaggguguggauggggagggagcacuccugcuagagggaggagcacgugccaaccccuagucaggaugaggcuuggaccacucagcaaacagagagaagcccaggcauccaggacauaguaagggaagagaagcaagggauuagggggacagguugacagaagaggggcccgggacuucauuuuaagguuaucaaaagucauggaagggcuucaaaaugagugcauggugaguauauaccaauaauagcagauauauuauguacaaagcaacucuaauaaauugacugauuuuaacaucacucccauccgauaaaauagguuaccaucauuaugcccauuuuaccaaugaggagguugagacagagaaguuaggugguuugcucaagaucaugcagccaguagguggcagggccaggacucagaccgaagaacguucuggccccaaagccucugcucuuaauacugugcugccucagaugaucacacaagaucagacuggcaucuuuaaaaguucauucugauugccaaugggagguguugggggcuggguauggagaagaugaaauaagagaaagcauauagagcccuuagcuugcugccugcuguugggagcacccgguaacauuagaugaaauuauccuuacgauuacagcaagacaaugauaaagccuggccugggauccagggcccuguugcccagccuggagcaaaaguguuuuuccuuccuggcuccuuucaguccucuuccagagagaaacucaucuuuuaacucucuuaccccaaggacucugcccgucuaagacucccaucaaugaaaaugcucccgucuuugauccugaaccggucauugcccacugcuucaagcaguuccagcagaaggacuuccgccugccucagacccgccggcgaaucaucauggugccucgcaaggaggaucagacaccccuuaauccugcaucccaaccucaggcucccccaaagcccauccccagcuucaaaguucuggaagcuagagauauccaagagcagccagaggacaggaagaccuggcugagccagaggucgaagcugcggcaggagcuagaguccuuuggugauguaaagagguggcuggagaacaagcccagcaucacgccuucagaggccaaggucuuacacaugauccacgaggagcagagugcccagccaaaugccucccaggcaacuaccaggaccaccagggugagcagccccauuugccagaugaagacaccaaggguuuagggaugcaucauuauuuuauucccuuggguuaggcuggauagggauaguucacaccauuucacagaggagcaaacagaagucuugagagggagguguauuaguugucuaguuaucuauugcugcauaacaaacacccccaaaugacugaaagcaacaaauauuuaugaucacacaccguuucuagagucagaaaucagggaguagcuuugcugggucgcucuggcucagagucucucaugagguugcagucaggauguuggccugggccacagucaucugaaggcuugacuggggcaaaaggaucugcuuccaagcuggcucacccauguggcuauuggcaggaggccucaguuccuccccacauggaccucuccauagggcugcuuaaguguccucacaguaugucugcuggcaucccccagagugaaggguccaaaaaagagagcaagacagaggcugcccuuucagaccuagcuucugaaggccucaguuucagaaguuccacacuaucacuuccaccacauucucuuugucagaagugagucccugaguacuacccaugcucaagaaggaaagaagacuccaucuuagaaaggagggaagcagaagaguuuguggacauaccuuaaaaucaccccaaaagggaucauccuggcaguccaucuuaugggguauuuaaaauacccauuguucauucauuuguucauugacacaaguuugcugaggguuccauguagcaagcuauugugaggaugacgauugugagguugggaggaaaaggaggaucccccuuuuacaaauguggaaauagaagcucagugaggccaacauuuauccaaacauauagugauaguaagugauaaggguacuaccaacucauucucucucugugacauuuccuugggauaagaagacagauaaguuggguuuaaacauagcucugcuacuuccuagcuguaccauuugggucucaguuuucucaucuauaaaauggagacaaccauuguuccuaccuccuggggucgcuaugaugucuaaaugcauucauuuauauaaggugccuaggacgcuauugggcacauagugagcacucaaacaugauuuccaucuguauuauuauuguaaucucacaaguguccauuggguugguuggcccggaaacuucagggucaguccuugcuguuauuauagcccaaauccuaauuucaugggucuaacacacccucuucugccagcagcauagugucuaagaauaagaacuagacuuggguuagaaaugcagcuguacugcuuaccugcuguguggcauugggaaaaccuuucacaucucugagccugauuccuuauugugaauuagguaguaccucauaccuaauucauaggaucauuuauuccuucagcaaacaauuacugccugucuuccuacggccugggcuuuguucaguauaaaggugggagauggggauacacuguaaauaagacacggucuuacuuccagggugucuuagccuggccucucuugcugucacagaagacaugaugcuggguaauuuauaaagaaaagagaguuuuuuuuggcucacaguccuggaggcugaaaguccucaugagguugcagucaggauguuggccugggccacagucaucugaaggcuugacugguuggccucuagggagggccucgugcugcauccuaacacaguggaaggcaucucagggugagggggugcacgagagggagccaaacuggcuuuucuagcugaucccauucaugauaacgagcccucuuccaugauaaccaauuaauccuuagcccauuaauccauuaauccauaaaugaauuaauggauucauaagagcagacaccucaugacccaaucaccucuuaaaggccccaccuguuaauaccauuauguugauaacaguauuaaguugcuucugacccagcccaucuguggaucaucaaaagaugcugcauuuccaacgaacuccuggugaugccugugguagugguccacgggaccacacuuuuacuuuugcuagcuauuuaauaauguaaauuaauuauaaauuuaaaaauggaguccuucaaucacaccagccacauuuugagugcucaauagucacaugugccaaguggcuuaacaaaagucauguucaguuuaaacauguauuuuggaggggacaaacauuaagccauagcacaagguguucacauguuagugggagaggcagacacauaggauuaauggcucuacaguuugcuacaggccauuaauagaggugggucucuauuauaauaagcacccugggaggagcacagaggaacaauacccuagggaaugggaaggcccuuuguaaacugcccagugcugcaccaagguagaagauuaucauccauuacaaaauaugcccuuucacuuggaauuggagaaggaggauuuggacagauagagaaagagagaaaagucuuccaggcaggaggccuauagcagaugcaaaggcugggggcggggauggggagucuccaccuggcuccagggaaggguauagguuuuggugcacugagagaccagaccagugggauuacgcauacugacugguuugacaggagagauguggauaagaaugaaauuuuaguuccuauauugcccaagccuuguguuuuucagaugagaaaaccaaggcucagagaagcaaagucucccaggcauuuuguggccaaacacaguugcccugaacccagugcccuuuguacucuauccugcuauuuagagcugcucguccucuccuuagucccuaacucuggggacugcauccgccuggccugucuccuuugaacucucuccucugcccuacccucucaccucuuccagaagaaagcccccaggcucucccggcugucccgccagauggugccccagcuccagcugcccgagcccccugcccugucggucauguacuccuaccugcauagccgcaagaucaagauccuggagauauuucacaaggugggccagggugagaaccagagaaucaccagggaggaguucaucgcggcuguaaaggcaguaagugccaccugcuuucucuggaugggccuaagugggcaggauguacauguacucccucuuugccacccccgccccucccccgccaugcuggguucugguucaacugagaaguagacacaaggagugcaaacugucagccuuauuacuuauuaaggcuagaaaauauggauuaacuuguggccaaaucagauccucaauaucugccccgcaccagucugaccuugaaaacccccaccugaguggaaagucuguggaguccaccucauaaccagccagcuaccuuggagaaucccugucuugcacagcagaccccaaaacuaagaucagagaaagcugguagagugucuccaacugucacuggcauauaaguuacauggguguccugucgaaaugcagcuucugacccagcacaucugugggucaucaaaagaugcuguauuucuaacgagcuccuggugaugccuguaguacuggucuauggaccacacuuuuacuuucacuggcuauuuauuaauuuaaaucaauuauaaauuuaaaaauccagucuuucaaucacaccagccacauauuuugagugcucaguagucacauguggcaaguagcuccucuacuggacugcacagauguggaacauuuccaucaucauggaaaguuguaucggccuagcagaggucugcaaacuguggcucaagagacaaguccagccugcuuccuguuuuuuaaauagaguuuuauuggaacacagccacacucauucauccuugaauugucuauggcugcuuucaugcuacaauggcagaguugagcaguaugacacagaccauauggcuagccaaaccuaaaauauuuacuaucugagguuuuuuguuuuuaguuuuuuuuuuuuuugguuuuggguuuuuuuuuuuugguuuuuuuuuuuuuuuugaggcagagucucacucugucaccaggcuggagugcgguggugcgaucuuggcucacugcaaccuccgccucccagguucaagcaauuuuccugccucagacucccgaguaguugggacuauaggcgugcaccaccacgcccggcuaauuuuuguauuuuuaguagagaagggguuucaccauguuggccaggauggucuugaucucuugaccuugugauccaccugccucagccucccaaagugcugggauuacaggcaugagccacugcgccuggccuuaucugacuuuuuauagaaaaagcuugcuaacuugcuaacccuagucuagaugaauuacguuuuuauacauuuugaaugcaagauacuuuacccuagcaugcuggcucaugccuguaaucccccaacacuuuggaaggccaaagugagaagacugcuugaggccaagagcuugagaucagccuggguaacacagugagacccccaucucuacaaaaaauuaaaaaacuuaucccaguguggugguacacaccugucgucccagcuacaugggagggucagaugggaggaucacuugagcccgggaguuagaggcugcagugagcuaugaucacaccacuacacuccagccugggugacagagcaagaucucaacuuaaaagaaacccaaacaacgacaacaaauaccuuaaacaacuuuagggaguugacugugaugucuuucgugguuuuaaauuauuaucaguuuucucacacauguuuuaugacauguaauuaucucaacaacauuucaaagcauuuaaagauaauagucuuuaaucuccauaaccaaaaguuuaaauauuacauucuuuagcaccaggagaguucauuuuuuuguuuguuuguuuguuuguuuguuuguuuugagacggagcuucguucuugucacccaggcugcagugcaauggcacagucuugggucacugcaaccucccucucccugguucaagggauucuccugccucagccuccugggugcugggauuacaggcauguguccccaugccuggcuaauuuuguguuuuuaguagagauggggcuucaccaugcuggccagucuggucucgaacuccuggccucaggcauuccacccaccugggccuccuaaagugcuggguuuacaaacgugaggcacaacguccagccagcaccaggagaguucugaucuuacuuagcucugaucaaguuaguucugaucaaggcuaggcacaguggcucaugucuguuuacccagcacuuugggaggccgaaccaggcggaucacuugaggccaggaguuugaguaaaguucagugaacaaugacuauugucuaaagaaacugaagaacaaaaucauauuuccuuuaaaacuuuucuucuugaauauccaauguugcuggcaagcauuauacaccuccagaguugcucaucguccuuaaaagaaugaggaguauaguauucuugaucccauuuuccaggaauuaagggagauuuauguguuacuuguguauagggaugauccacaugugaaaucaugcuucguauccagcaugguagaugcugccauugagacugguaggaaguggggugggacccuagaggaagaagaaacccacucuauaaagauggugacaucuggacuggacuuugaaggagggauaggaguuuuucaggcagagaaggggaacugccugagcaaaggcaaagguaacaaagugcagaguucauucaaggaccgggaaagggcucugagcugcagcagggaccuuggguauaguagggagugguugaggaugaaacuggaagcaggaugggggucugaggaggcugguaaggccuuggccaucagagcaggauguuuggaugggagccugcuagucugaaggucuucucucuccucaggucggagucccucugaagaaccaagagguggaggauauagugaucuaccucagcucucuugggaagcacaacaccaucaccauggauauccuggccaauaccuacaagcaguggucuauggcucagcaaaggagcagccuggccacugcaagggagcgugcguaccccuccccauccugugccuccaccuccccguccugggagcaagcauggugcaggcagccuuggccucuccuccaaacucacuuccucaguguguuccccaguuuuggccgacugugguuuggccaagccucuggaaauuuucaggcccagagauuaacuaaggaguagauauucccuugagugcccagcuaccacuguguccauucaaagacaaaugagucccagcccuuguucuuagaggaggauacucagcccaccagagcccaccugagaggcugagaacugacccaaauggcaagccuuuccagagacauuuauguguguguggguccaaggccuccucacuauuaauccauagcuuauugauaaaauucuuguucagaaccagaauuagcacauguuuacaguuuacuggaaaguguauuuugguauucugcuaucagggguauuauggcaggguugcugucaacaguuguaaagguuguacauggcucaaguuccaucugccaagcaauacauuuguggggccacaucuguccagacaaggcacagaggcaaauuagaaauggacuugcuaaagcucuggcugugaauuuacucuacaacacaaaggugcauuguauaauauuucuuuauaucuuaguaccauucuuguaguaaacaaacaaacaaaaaagaaccauuacaaccacccacccauucuagcacccuucccaaacauagccacagcuuuguuuuucuaaaugaaacaaaucuugcucuguucccaucuaccagguuggcaggaacuuaaucucaugcauguuuggggcuuccuuguccucccugagucacacaggagcccuggaggaggcaguggagggguuuccuaacaaugguaaagaucuggggugaggccguuggaguuuacagucacaccaagaggaguuacucagcauccucacuggaguggcucauuuggggacagcaggcagcucagagcauccauuccucaguccuccaggagauuuucaauguccagucucaaccagcugcccugcagagaaacuaucaccucccaagcagggucucugccucucucagagcucagggaagcucagcaccccaacagucgcuccugcaugugucaccaccccaacaguaguaaucuccuuuauguccagcacauuuuuaaggucaccucaaguugggcugcuuucccucugauacucuuugugccuuuuuguuauaaauuaccaagcuuaucauuaucuguguagcuggcugugagucauuucaaugaccacagugugcugugaugcauauucgcagcagagauauuuuggguccuguuauuucccaguaaguaaacacaaagccaagcagcagaccuuugcucucauggugcuacuuuggcgucaucacugaguucuuuuucccuggugagcaauaguggguaagauagguagacugggguguguaagaauuaaagaaagaggaaagaaacaggaaagguggcucaauagucaaagacagguuuauuuuagagaaaacaaaccugagaggggcugcuggcugaguuaggucagagccacauucucuuacagacuaagaguuuuuaaggauucacaguggaagaguuuaucagaggcuuggacugcuucucugucucuuuguuguguuuaucugggaggcagaguugcgugucuguuuccauacaucuuucugcagcugcaggcauaucccccaagucugcuuuuagcuucccuaucuuagugcaccugaagggaaaggaaugugcuuauuaaggcccacaguuuuacuggggcccauuguaugagggugaaguuuggcagucacccaagagacuuucccccgaccucccucugugccugagcugucuugucuguguuuuacugucugcucuuucuggcugcuuauaguuagaagagaagugauuuccuugaaaugcaugaggcuagaaagggagcuggaacuuaaaguggcgguguuugucccagaugacggugcuccugcucuguccgggugucucucacuuugucuaaagaggcaagaguuugagcgucuuggcaggggugccuucuuccaguaguucuucuugcaguagcucuucuucauucuugcagaaugaucucaguuuauccuuuauguccgcagaggucaggauugcuauuccugcuuuacgaggaggaagcuggagcucagagaggcugagccacuuguucacagccucaauagaaggugguaaggucaggauauuauuucagcuugagacgaugaaggucugaaccagggcagggacaaugggauucuuucauucauuggaaucuuuguugagcaacuacuaugugccacuucuagaaacugggaacacagcagugggccagccaaagccccagcuuucgaugagcuugcaccuaaagggcugguggucagggacggccucucugagaagcagacauuggagcugacaucugagugauugacaggaacuagucuugggggaagcacaaucuaggcagauagaacugugaaggcaaaggcccugggguaggauagcuugcaagagacagaagguggucaggguggcuggguggaaugggugaagggugaaugguaugccauggaccaggugggaaggcagcugaggccagaugguacagcagggccuuguagcccagggagaggacucuggguuuuggucuaaaugcugugggaagccaagggaaugaggcgaucuggucggucggucagucugucuaucuaucuaucuaucuaucuaucuaucuaucuaucuaucuaucuauccauccaucuacacauauccaacauaaggagacucaugcaauggggucuccuuauguugccuaggcuggagugaaguggcuauucacaggugugaucauagcuuacugcagccucaaauuccugggcauaagcaauccucccacuucagcuuccugaguagcuagaaccacaggcgugccacugcacccugcuuuauauauguguauauauauuuuuggggggggauggagucuugcucugccauccagguuugagugcaguggugugaucucuucucacugcaaccuccaccucccggguucaagcaauucuccugucucagccucccaaguaacuacuacaggugcacaccacugcacccggcuaauuuuuguauuuuuaguagagaugggguuucaccauauuggucaggcuggucuugaacuacugaccucagcugauccacucgccucagccucccaaaguacccugcucuauauuuuuuguuuguuuguuuuugagagggagucucaccgugucacccaggcuggagugcaguggcacgaucucggcucacugcaaccuccaggucccagguuaaagcaauucugccucagccucccgaauagcugggacuacaggcacgugccaccaugcccggcuaauuuuuuguauuuuuaguagagacgggguuucacaguguuagccaggauggucucgaucuccugacuucaugauccgcccuccucggccucccaaagugcugggauuacuggcgugagccaccgcgccuggcuauacucuauauuuuuuaaagauccuauuugcugcuuggugagacagggugacaggacgagaauggcaaccagagggcugggguuggugcaguaagggacgccauuaguggagauggagaggagggccacaucuaagguacagcuuagguggcuuaggugggcacugcccagacgugugggaagggagcggagggguggccuggugccugcugggugacacuggauaacugcuuggcagguuccguggcugggcacccucuuagucccuccuuccuucaucucuucccucugacuccagauuauaucuuggccaagcacagagauucccugaaggguccgcucaagaagcaggagguggauucagccccacagcuucccaaaguggaccuacugacggugccugcagucgacacgcagauggagacgcggcccaugacccuggaggagauggaggaagugggcaagcgguaccgcgagcggcagcgacagcacaagguaccucgccagcccaaggagagcaugcggcuuggggacuggagcagcugggguucagaucaccgcagcagcaccacccgcuggcugcagaacccuggggaggggggucuucgccucuacaaccaccccuucuucacgucccucaucuguaaaauaagaacaauaccugccuccugagguuuuuguaaaauguaguaagauccuguuucugaaacuaucacgucccccucucccuauucuuuaauuaugacuuuucauccuuagaccaggccugcauuuucaucacagcuggaauccaggcaccuggcacagggccugacacuggguagacucuccagaaauacauggcaagugaaggaaggauugauugcaugaauuagcuuguccaguaaacauuuauugagagccuaccaugugccaggcacucuuccggguguuauaguaagcauaacagucccugccccuaggaagcugacagucugguaagggaggcagacaacaucaauacaauacuacauauaaauauucauauauaauauagucugggaguggugucucgcaccuguuagcccagcgcuuugagaggccaagguaggaggacugcuuaagcccaggaguucgaggccauccuaggcaacauagggagauccugucucuacaaaaaauuuagaaaguuagccuggggugauggcaugugccuguggucccagcuacucaggaggcugaggugagaggacugccugagcccaggagguugagacugaagugagcuaagaucgcaccacuggacuccagccgaggggaaagagcaagaucuugucucaaaaaaaaaaaaaaaauuauauacaggccaggugcaguggcucaugccuguaauccuagcaauuugggaggccaaaguaggaggaucacuugaggccaggaguuugagaccagccugggcaacacagcaaggccccgucucuacacaaaauuuuuaaaaaauuagccagcaugguggcaugugccuguggcugcaccuacugaagaggcugaggccagaagauggcuugaaccugggaggccaaggcugcagugagcuauuacugcacaguacaccccagcccaggcuacagagugagaccgugucucuaaaaaaaaaaauaaauaaauaaacacaaauauauauauaauuaaaaauacauauuuguauuuauaccuauaauauuuguauuuguacauauaauaaaauggcagauauugcuaagugcuauaucuacuaagauuugauucaguugcaugacaagaaaacccaaaauguuugagcagggaccagcaaaguuccccuguaaagggccagauaguaaacauuuuaggccuggugagccaugucuugucugucgcaacuacucagcucuguguugcagcaggaaagcagccacagacagcaccuuaacaaaugaguguggcugugcuccaacaaaacuuuauaaaaacagcuggugggccagauuuggcucaugggcuggucuuugcugauucugguuuuagaagcuuuaaaaguuaggguuuuuuuuuccuuguuaaaaaacaaggugguggcagccaacaaaagcagcuaccugcuccgccagccuccuccuaucuuagcucauggcuuucaccucaaggucacagauggcuacuccuaauuuaaaugucacuuuucuuuucuucucuucuuuucuuuucuuuuuuugagacagucucacucuacugcccaggcuggagugcaguggcuugaucuuggcucacugcagccucaacuucccggacucaagccaucauuccaccucagccuccugagaagcugggacuacaggcgcgcgccaccaugcccagcuaauuuuuuuguagagacagaguuuugccauguugcccaggcugaucucggacuccugggcucaaguuauccuccugccucggccucccgaagugcugggaugacaggugugagccaucuuguggccccgcgaauguccuuuuucaauaggacgccucuagggcauguguacuguguuuuaccauauauguuacacagucaugugugcacuccugcacacccgucuacagggcugugacuucagaaccugagcuucugaaccugaagucuucacugacuucagaaccggaacugcagccccacuggacguugguugccaucaccccucauggggaccucgcaggggagaggucgaugaggcacugcaucuuccuucuucuggccaggaggagggacacaggcgagagaagggcgagccccuuucugcuuccuucgcagcucacgauccccuccauccaguacacggagcaaugucaccuggugcgcugugggaaucggcacuuugaugagcacugccucccguccaccauccacggggauaugagggagcucauugacucggcccgcaggcacaacuuucuggucuaccugcaaugcuggaagcucuguaaguccuauggccucccgcugacagaggacauccucaugaaagguaagggccucgguagcuggcccuaggaagaugccaagggaaccccagagcuggggugagggugaugccacccagggcacccaugcagccauucaagccacuguaaucucugguggggacauugggaauaaggcggagugggggcguggaggagaagaggaggagcccagucuguuuugcugcuagaugggauuucuagaacacaagacccggaggucuggguuccacaacugagauuugggggucuggauucuggaacccugagcuuggugaaccaaaagcucauucuagaguagaaagcuccaaggacaggaguuccaagugagaaagcccugagguugaacauaaaggaagaguugcaauauugaagagggauauuugauagaaaugauaacugcuaucaaaacaaagccuuucucuaggccaggcuguugccugguucuucugcaacaagcagugggguaugaaagcacguggagacaggaccugcuaaagcccuuugagcagagagcacucagacucagcccugagauuuccacacugcuucuucccucugcuuggguggaaaacacguuuucauacauccaagcuggucugagcccacugugucucugcggggugagcacuucuaauaugugggagcggagaagggcccagccccgagaugacaauuuagcaaugccugcauuccaaacuugugaauuggugaauguauaaauuuguuuuguuuugaaauggagucucacucugucgcccaggcuagaguguaguagugcgauugcggcucacugcaagcuccgccucccagguucaagcaauucuccugccuuggccuccugaguagcugggacuaaaggugcgcaccaccaugcacagcuaauuuuuguauuuuuaguagagaugggguuucaccauguuggccaggccggucuugaacuccugaccucaggugauccaccugccuuggccucccaaagugcugggaugacaggcaugagccaccgcacccggccuggugaauguauaaauuuaaugggcaggaucuucucugugcuuuaaaaacaugaaggagcaagcugcacuugggggcagagguuuucuccuaggaaccucugccuaggaaggaacuuuggccauacugggaaauguagcuuucugagaaaggaacacgucacacaggcaguggugugacuuacgugagaacuagacuuuacagucacaauugauuauuaccaucuuuuucccaagagggagggaaacaagcgcuaaauuuauagggcccugggucuucuuagauuaguuugcuagggcuccuauaacaaaauaccagucuguggacugcgcggcuuccacaacaagaauuuauuuuucaccguucuggaggcuggaggucccagaucaagaugccagcagggcugguuuccaaggccucucuccuuggcuggcagauggcugccuccuugcugccuccacacaguuuuuucucugcacaugcacaccuguugucucucuuguguguccacauuuucucuuauaaggacaccagucaaauuggauuagcacccacccauggacaaccucguuuuagcuugaucaucuccuucaagacuuuaucuccaggcugggcacagugguucaccccaguaaucccaguacuuugggaggccaaggcaggaggauagcuugaucccaggaguucaaggcuguggugagcuaugaucauaccacuguacuccagccugagugacagagcgagacccugucaaaaaaaaaaaaaacccaccaaaaucuccaaaugaagucacaaccuuuuuuaucuccccccuccaacggucacauucuagcagcgugaaguggcucaugccuauaaucccagcacuuugggaggccgagguggguggauugcuugaacccaggaguucgagaacagccugggcaacauggcaaaaccccaucucuacaaaaaauacaaacauucaucaggcauaguggcaugugccuguaaucucagcuacucaggaggcugagguaggaggaucacuugagccugggaggucgaaguugcagcuagccgagauugcaccacugcacuccagccuaggugacagagcaagacccuuucucucucgcucucugucucucucucauacacacacacgugcacacacacaucacauucuaagguacuaaggauuagaauuacaacauaagaauuucggggagacacaauuuggcccaucacaaguguauacaggggaauguggucagaggcugucaggaacacaggcaagcaacuucaguggucauugucucccacaugugcuaccuggguugggagggcagagacagaaggagauccuauagcucuggaugcugacuuuucaccaaaacaucccuccuucuuccuuccuuggggaaccucaccuuuccggauuauuuacaccauggucuuacgcagugguggagcugcagcucugucuucucaaaugcagccagcuugccaugugcccuggacugcuccucuggguuaggucuuccccucugugcuucuuugucuguccccaccagaauaucgagccacuuuuuuuuuuuuuuuaagagauggggucuugcuuuguugcccaggcugaucucgaacuccugggcucaagcgaucgucccacuucagcuucccaaaguacugggauuacaggcgugagccacugcauccaccccuggcuucugcuagcugcuggguuccuacaugagugagcuucaccugucugcaggaucucacguucaugggcacacaggagcauccugugggugggacuaggcccaaauccaucucugaccacugucuuggccacuugcuauucgguaucuuuaugacagaggccugaucuccuauaagcagagaggcucaaauaucaggacuuccagcucuguguucuagacuagaccuugguggcucagacuccaggcuucaagcucaggagccagaauucuaaacaaggucucccccuccccugugaauauagcuuuauuggcuuuccacccugguuuuggcgauaauacuugcucauuugaauuuuuugaaaacauaaaaaucaaaauuccccagccugaguuggcuguugugaauauuuuagugaccauccuuucacaaaucucuuuuccuuuuccauuuacagaaaauuauuuauauaacucauuguuaaaucacacuuuaaaaaaucauguguaccuuuugaaaauauuaauguuacauaucucccccuucccucuccuuccuucucaccuccacagccccuucccaacccccaaauaaccaacauuaacucgcuggagcguaacuuccaucacuuuuucuagaacaugagcuuucauguguuaccagcuuaagacaagcacugcuugauaguugcagaagguggagacccuggcucaguauuuuuuuuauauucagcacaucugagaaaacucucccaaggaucuccaugagauuaauucaagacaaggagaaaacugccaccaaacaaauccaagugggcugggcgcaguggcucaugccuguaaucccagcaguuugggaggccgggguagguaggauggcuugagcccaggaguuccagaccagccuggguaucauaacaagaacccaucucuacuaaaaauuuaagaaaucagccaggcaugguggugcaugccuguggcccuagcuacuuaggaggcuaagguaggagggucgcuuaagcccaggaaguugaggcugcagugagccaugaucuguacuuuagccugggcgacagugugagaccuugcucagaaaaacaaaacaaaaccgaaaauuggucuaaguuaaccucaucaagucuuggucaaauccuccugccuccugggacagcucagaccucguugcaccggggccuugggggcuuuguuguccuuguuaugaacaaaccccccucaucuguaguccccugagccauauugucccaaggccccuuuccuggcaucacacuacagcuauaugcaugucaccacugggacagugguucaagggaccccucugcaguauuuuugcaacuuccagugaaucuacaacuauucaacaauaaaaaguuacuauauagauaagaagaaaacgucuuaaaaaugugaauuaaaaaaaaaaaaaacaccuccucugaccccagaggcuuagggagggaugggcagucuggguugaugggugcagauguuucucuugcuguccacagccuugcuguacccaggagacaagaucauuuuccagauggacaaagugugccccauccggcagccgggaggcuacuacucugacuggaaggucuuuucuccgaaucuggcucugcuccggucccagggcccuggcaagucuaagaggacugacaagcugaguuucggacccccuuucucccugccuuggccuccugcuccauugcuaucccuucagugugggggcuggaggcuggaguaccuggggcgccaugcugugcuugcgucugcauccuagggcaacaucccccaaccugacugcucacugcagacuggccagucccgggucacccuuggcgcaugucucaggaucauggccugcuggccucagcucccacacagcuacccuccugaccccaguccugcacaaucauaagguuucuggaaaagaugaaaaggagagccuccuuagagaacagggcuggagcgagggccuucacaaauccccagccaggugucagggcccugcagagaacagggggcagcccuuucucugcccugccaccuugcagcggccacaccccuucucuggcaagaggugggcuugcagcucauaggaggauaaaagaacauuuccccgggaccugccuccagcccuuucgagaggccaaccugagucuucucuaagaaaauggccuccuuugguacuccaaagccugagcuacccagauuugagucaagcagcaggugacaacccgugggcagcauccgugggugacugcagaggaacaaggcagcaucccugcagaggcaggggcgcggcaugggaggaggagagcccagcuggccggauaccaugaggugggaggggccuggaccugccccugcuucuagaccccugccagcugcccacuggguguguggccagaaugccugcagugggacacagcagggcccuguagagaucagacaggccuucgguuaaauggacaaggcacuucucugagucuuagcaucuucauauguaaaggggccuaguagcuccuaccauacacuaugaggaucagaugagaaagagugucaacaucuuagcagggacagcacucaaucaaugauugucguuguuuuaccuugcucugguuggggcaucuucaagugcaggaguaggcccaggccugcagguggguccuggccaugacacgggcugugacuuccuuccagccccggggugggccaggaaguggcugggaacccaggaaggggauuuugguccaugcuuagguaggccauagcuaauaaaggauaaagagaguucucuuaggucaaggagagacguugacuguaucuugcuacuuaugguugauggaggcugggugggaaagagugccgugaacgauuagugaugucugucaggcucaggguuggaggggaaggggguuagauuucaccaccuuuguccucagggcuggguuaagcucuggaguggggaguaggagccagggaccccaaaaggauuuggcagugacuuacugagccucccucguaacuacccugagaggucucuauucuggaccaugagaaaaccaaggaugagaaaggggaagugacuugcccaggucaccuggccagauucugaggguagguccagcugacccaagcccacuguguuccccuggagcauggaggcacagagucaggguccaccccagguggaagacauuuuucuuucagagcucucguuugagacuuagaaacggguccaccccugcggcccugaccuacucccuaaagccccauuggccuggauuuccacucuccucacaaaaugccucucucuucuccacuaggaaaacgccaaagaaaagcaagaaaaugcgcuuuaaggaguuugaggaauuuaccaggucuguggcaaucaucuaacuccacaaggaaggaaggugggaggaggggcagcuucgccugagacaacugggacucugcacuccuggcacaacagcuggggcucggugcccuggccugagaggcagugacacaacacagagagggccaggaggcauugcucuggggcuuuccauguguucacucacucagauccucccaacagcccuacgaagugacacuaagcauauucauuuuacacaggaggaaacugaggcacagacaggguaaauaucaugcucagagucgcacaucuacgaagugaugcaguggggaucugaacccagcuaggguggcugcaggggccguacuccaaacaccacauuaaaaugccuccagauaacagaugguucgcgcuuaagacuuugaguuuagaggcauuggacaaggaaugaagccugcacuuggccacuugcucagugugcgacggccuccccaggccucuggguccucacaggugaggucgacaggauaacagagcugaccauauggaacuguggggaggacugaggugcugaagugcuuggcacagugcuaaaucuccacuuuggucacaguuggugggcucugcgaugaagccucagcucuggccugucugccaugacaaccaucccugugucuucuuguuuuccaggaagcugaaggugaagagguccaguggucugcagcaaacacaccccaauuccuucuggccgggucaucuucuggauaagcugcagcucuaccugcccacuguggccacagaccggagccuggcgcucuucaguuguguucaacaccagccccaugucuacccagccaccuaccacccugaccacugguggccccuuaggaacaagaacuacaugacccacgcccauuaugaugccgccaagguguacuacaucaacuagagcuagccagguguugccggacccagccuuccugggccaggggccagugcagccagcggcccagagcccagacacaagaggagugucaaagagucaaacuaaagaaauccuuucaaagagggauggaccgggggccaguucccucuggacucaaaguguccagugucucagaggguagauguguccaaggaaugacgugcaguuuuugacuauuucccuccccugaccucugcccuuucuacauaaagcagguuggaguuuuucucauuuca

SEQ ID NO: 191678 - RNA, 65586 nt, Homo sapiens
uuggcuggggcuaggcuuccggggcucugcaguccucggcgugugcuggcagcuucggagcccaccgagccgggcggcuaggauggugagggcgccgggcaggagagaggccggccugggcuggggccgccgucccugccgcccucaggcucagcuucucuucucguuuuuuucgcugcagaugaaccggacgacccccgaccaggagcuggcgccagcgucggagcccgugugggagcggccguggucgguggaggagauccgcaggagcagccagagcuggucgcuggcggccgacgcgggcgugagaggcgggccccggggacgcgagagcggcaggggugacgcuuggcuugcgcgcaggagggccggaccgcgacugccccugcaccuggcccgucccguugccugcccucuuaggaacacacgccccguuuagcccccgagaaugccacccuggcaguccccggccaccagggagaggggcagacacugaccguggcccagacgcgacguucccuucaugggguuucuggcucagcuccauccggaggggagauccguuuccgccacacugagggauugcucgggcacuagggaggcgauuccuguugggaccuggacuaaauggggugggaaacaagccaguauguggauauccuuuaaugggauuuuucaaaucgggggcccaaaaagcucagaacuguuggagucccaaaugaauaggauuuuugaauaagaguggugguugauuagcuaacccuuggucugugaucucuguagauugacaaccaaagaggacuuuuaaaaggagacaggguuuugcccugucgcccaggcuggagugcaaguggcuugaucuuggcucacugaauccucugggguucaggugauccucucaccucagcguccugagaagcugggacuauaggcguccaccacaccugucugauuuguuuauuuauuuaauuuuaguagagaugggggucuugcuauguugcccagacuggucugcaacuccuggacucuagcgauaacccugccucagccucccaaaguauuggauuacaagcgugagccaccauacccagugccaaaaagggauuuuaaauuuuuccagaaacgagauagguguccauuagcucacugccacucuuuugaugagcuuucuuaguguuuuccaaugucacuugguuuuaguacuugucaaaccagcauuccagccgggcacaguggcucacaccuguaauccuagcacuuugggaggccgaggugggcgaaucacgaggucaggaguucgagaccagccuggccaacauggugaaaccccgucucuacuaaaaauacacaaaauuaguugggcguuguggcgggcaccuguaauuccagcuacucgggaggcugaggcaggagaaucgcuugaacgcgggaggugcagugagccgagauggcgccauuguacuccagcccaggcaacagagugaaacucucucaaaaaaaaaaaaagcauuucuuucacauucuaacacucaaaggugaaaggaaauggguucuuuuuugaugugacaugcagaauaguuacauguaacauugauacuacuguauguuuauuuuuuaaaauagcuacuacaguuucuacaggaauucucacagcaaacuaucucuaggacccaugaaaucaagaaacaaguggacggacuaauucgggaaaccaaagccacagauugucgccugcauaaugucuucaaugacuuccuuaugcucucuaauacccaguucauugagaaugugaguuauuuaguuauauuaucauuccuuuuuugggaguaggagauauuguaauuuuaaauaacuuacuguuagguucccuccuaaauuuugguggaagugugguucuugguaauuguagcuuuuuucucugggauuaauaccucuuuuuuauuuguaaaguuuuaaguccuuuuuuccaagccucuaaaaaagucuaaugauaacauuuucuuauacuucggugcuuccaucuuuugucguuuugagaguagucagcaauugugcugaauuuuguggcacucacacugccuuuguuguggcgugaucuguaaggacagcuguuuaccugguuagacccucuggacaccagcauaugguuucacuuguugauuggggucauucuguucugauaaauuauauucaggggauauauaugucugcuugcaauacucucaacuaaaguuuaugauggcugaacuuacaauauggaaucaacuguaaacagauuacugagcuuaaaucuaugugugauuuuugucuauuuacuguuucuucuaggugguaggaauacauagguaaauuagauagagccucucccuuggcaaauaguauaauuccagcauacaaaggaaguaaguauggcuggagcagaguggagacuuaagagaugaggauggagaggaagcuuagguaacagaccuguguuucucauagggugucccaacuuucugaauaucagcauucauuuguggaaaaaggauuauuaaaguaagcgaucuccugagauuguuagauauaaaguaauaaaauuuucagaaucacaaaauuauuuaaaaagcccaagauuuagaauaguuaagagaaugccauguagucaacuugugcagcauguuugugcauuuuuuaauagcuggaguuaaaugccacuuccugucuuuuuuuggagagcuauauauaaaauaaagacauuaauaaagguguuagagaucucuuugccaguuauuuccuuuaacagcaaaggaguacuuaugaguuugaaaaauaacaaguauucggccaggcgugguggcucaugccuguaaucccagcacuuugggaggccaagacggguggaucaccugagguugggaguucgagaccagccugaccaacauggagaaaccccgucucuacuaaaaaaauacaaaauuagccgggcaugguggcgcaugccuguaaucccagcuacuugggaaggcugaggcaggagaaucgcuugaaccugggaggcggagguugcggugagccgagauccugccauuguacuccagccugggcaauaagagcgaaacuccgucucaaaaaaaaaaaaaaaguauucaaguaaaaucaguaguuuucugauuguuuacacagaauguccaugcuugguccugacuaucucacuggaaaagucagggacucuagacucaacuucucuggugugcacagccccauaauguuuucaucaagauuaauuugguguccuuuuaagcacuccuguucuuuucauucuguacuuuucuugcuggaucagguagucagcacuucucugcagucagugcugcagcaccagagucccaaaggauuugggaaguuucuuuuuuuuuuugagauggagucucacucugucacccaggcuggagugcaguggugcgaucuccgcucacugcaagcuccgccucccggguucacgccauucuccugccucagccuuccaaguagcugggacuacaggcgcgugccaccacgccuggcuaauuuuuuguauuuuuagaagagacgggguuucaccgaguuagccaggaugaucucgaucuccugaccucgugauccgcccaccucggccucccaaagugcugggauuacaggccugagccacggcgcccggcaagggaaguuuacuuuguacccagugugcuuguaccagauugguacuagauugguaccagaucaauacuucagugggaagaaauggggaacaucauacaauuuuucucaaucacagucuuaggucuuaucuuuucuccagcucuuuucuagccaaguuuucguagauucugaguuuuccauguuguaguuuuuguggaguuuuuuugguuuuguuuuauuguguuuugguaauuguucuuuauuucuguccaauacuggggauuuccuguuuuccauccaucucuccaucccuuuagccuuagcuuuuuuuuuuuuuucuuccgagacagagucuugcucugucauccaggcuggagugcagugacaccaucucggcucacugcaacauccgccucccguguucaagcaauucuccugcccacaccucccauguaguugggauuacaggcucccgccaccaggccuggcuaauuuuuuuucuauuuuuaguagagaugggguuucaccauguuggugagucugcuuuugaacuucugaccucaagcgaucugcccauugcaaccuccgccucccggguucaagcaguuauccuacuucagccucccaaagugcuaggauuacaggcgcgagccacugcgcucggcccuuaguguuaagucuugaugccccuucgccuuccagucugcagccagaacucuucuccggaugugcugguugccgcugccaaaucuuaauuacuucccagaccuucuauaaggccacaugcuauagguuuuuuuaauuuguggcaaagcaugauaauacugagaaaacagcuaaugcuuaauaaaacucugaaaaaauauaguugcugauauauauuuguaagugaucuggcuuuuuuuuuuuuuuuuuuuuuuugagacggagucucacucugucgcccagacuggagugcaguggugcaaucucagcccacugcaagcucuaccucccggguucacgccauucuccugacucagccuccugaguagcugggaugacaggcacccgccaccacaccuggcuaauuuuuuuugcauuuuuaguagagaugggguuucaccguguuagccaggauggucucgaucuccugaccucaugauccacccgccuuggccucccaagugcugggauuacaggugugagccaccauacccggcaaucuggcuuuuuaauguuuuauuuucaaucccugacaucaguacuuagguguuacaauuccagcuugaauuauggugccauuugguuucaugguaauuuaucagaaacauucaaagucagauagguuucugggucuuauuaauuagccucaggggcagccacaaaguugcaaacuauauuauaaaguuagugaaacaauccagacuuucuagggcgagaacagucaggacuuuuuagggcaagagaaauuaauaccauuaguaaaggcucaagaggggacuuggagggagaagaaauacuaauuaacauuggccaguguucuagugucuaauuagaaggcaacacaauucuaaagccuuaauuaucuguuaauuuaggaauuggauccugaaauagcaagugccauaguuaaugacuuuaguuuguuaaaugaacuggugagggaggauuuuuucuuuuuaaagucaauuguuuccaaaucuuagcuuuguaaaauuaaaaaaaaaauuccagaaugaaacaaauuaaccuguuuaugcccaagguuagaauuuuuuuugugaaaagccagaucuuggcaaugaccuugagcaguaggauauacauaacucugacaagcuuaguguuccaauaaugggacacuaggcauaaauugguuaauuuuccagaucaucuuccuguugauuuauaaaagcugaauuuuggucauuuuucccuccuuuucuacuuuucuauugaagaaacagauggaguugcugaaacugucaaguacucagcaauuagagagaaggagguaaagcccaaaagcguuauuaacauauaauuuccugcacagguuuuucccucucccccuagaccugcuuuauuuuacauaaugccccuugcuuuugacacuccagccuucucauuccuuggagaugccauaugcccugcugcuacggggccuuugcuuacauugcuuccuaugccucuacccuuugauugacaucugucugucuucuaggucucugcucaauuauauuacuuccuccuggacccucugcacuaggcacacccccuggauaaaagcagcugaagcaucacauucuuuaguagacuucuuacaauuguaauuuuacaauuauugaugggauuugaugaguuggacccucccgcuaaaucaagccccauauuuuuaacaacaacuauauuugagggguccagcacaagccugauauuuagggauccagugaauauuugaaugaaugagaguacgcauaaaugaaaggggaccagggcuguguauagucuguuacucuccagcccuggucccuuuuuccccaguuccccucuuuccccuuuuacccugucuccccagaugaggagcaauaccaaagauauuuaacaguccuggguauagcuaucugacuguaaauugaucacaaaacacaugaagcugugaguuuagcaggugaggaugaaagaaguuagcauugguuaucugcuggauaugaaguaguugaggaugcauaguccugcucacccugaaaagaucccaugggcuuuaggucccauggguuuagguuucuuagaugucauguuuggcuuuccagcugcaggcugcugauagguaaccaugguagcugccaggucuuaaagucucacuuuugagauuuacuuaacuuuuuggaguccugacuuugaaaauuaccaaaguaaucccugaucuuuauagagcaauuaggaaaaguaagaaaaagaaaaaucaugugaaauuuccucagcuugaggggagccucucaagguuuagcacauauauucuaaguccauuucccaugcagacaucaggcuuaaaagaauugaaccuacaguaggccgggugcgguggcucacgccuguagcacuuugggaggccgaggugggcggaucacgaggucaggagauugagaccauccugacuaacacggugaagcuccgucuuuacuaaaaaauacaaaaaaauuagccaggcgugguggcaggcgccuguagucccagcuacucgggagcuugaggcaggagaagggcgugaacccgggaggcagagcuugcagugagccgagauccugccacugcacuucagccagggugacagagcaagacuccgucucaaaaaaauaauaauaaauaaauaaauaaauaauugaaccuacaaaaaaucagcuaccccaaauuaaccaaccauugaacuuuucaguguauuuuuuucuguucuuguuuuuuaacuuuaaccuuuucuagaugacgguauguguguguguguguguauuuacauuugcagccuacuuuuuuucuuaaugugaacuuauuuaacccaucuuugagacuuuugugaauauaauuuuuuuguucuuaaaccguaucauaauuuauuuaauaaucuucuaauauuaaauguuauuuaugaaauguuucauaaauuucauaaauguuucauaaauaaauagaaaaguucagagagaaaccacaagugcuaagaaaauguagcaccuagcaucagugguuuuguaucuugccacauuugcuucaaaggugccuacccaccauauucguccuuaacucuaaucauuuuggguggggauuccuugguaucucugccuuuuuauucuuuuuuuguuuuugagacaggaucucccucuguugcccaggcuggaguucagugguggagacagcucacugcagccucaaacuccugggcucaagccauccucccaucucagccuccugaauagcuggcuaggaccacagguguucgccaccaugccuggccaacuuuuuauucuuuuuaccuagagagggauuucauuuuuaucccuuauagauaaccuuuauuguguaguuguucuuuucuucauugacuauuauguaugaacguuuguguguguuuaugugaaaauaaaaucaggccuccauggaauugugggucuguuucugcccucugcuguuuguuuuguuucucugcuguuugccaguaucauaaucuuaaauacugcagauuucuaaugucuuauuagggcaaguccccauaaucucuuuuuauucagaauugucaugguuaucaaucuuuggcuuuuuacuuuucugugugaauuugaggauuaucuuuuacuuauuuauuuauuuuuuugaaauagaguuucagucuuguugcucagacuggagugcaauugugcaaucucggcucacugcaaccucugccucccaaguuuaagcgauucuccugccucagccuccugaguagcugggauuacaggcaccggccaccacaucaagcuaauuuuuauauuuuuaguaaagaugggguuuugccaugguuucaccauguuggccaggcuggucucaaacuccugaccgcaggugaucccaaagugcugggauuacaggcaugagccucccaaagugcugggauuacaggcgugagccuccuaaagugcugggauuacagucgugagccacugcccccagcacgauuaucuuacuauauugugccacagaauauuuuauuagcguuugauuggaauugcauagaauuauaaauuugguauuugugacuuucugcuggaaaucaugauaccaugaacauucugauguuugcauuuaugauaauuuucaugggagcuaaauuucaagaaguagaauuuugggucagaggauaugaucguuuaaaaacaacauuguuugaucagauuggcagauacuuaaagauggguggacaggagccauugcuggcaaagguuuggguaaggggcacuugaguaugcugcuagugacagggaauucuacacauuugugcauagaaucugggaaugacuauuaagauuuauuuauucccucucuagguaaaaucccucucuagguauauaaauaaauaauaaauaaauaaucaguuucagccgggcacaauggcucacaccuguaaucccagcacuuugggaggccaaggccgauggaucacuugaggucaaggaguuugagaccagccuggccaacauggugaaaccccaucucuacuaaaaaaaaaaaaaaaugcaggccgggcaugguggcucacaccuguaaucccagcacuuugggaggcugaggugggcgaaucacgaggucagauugagaccauccugguuaacauggugaaaccccaucucuacuaaaaauacaaaaaaaauuagcugggcauggguggcaggcaccuguagucccagcuacucgggaggcugaggcaggagaauggcgugaacccaggaggcagagcuugcagugagccgagaucgcaccacugcacuccagccuuggcaacagagugagacuccaucucaaaaaaaaaaaaaaagggcaaaaacaaauuagccgggugugguggugcccgccuguaaucccaacuacucgggaggcugagacaagagaaucauuugagccugggagguggagguugcagugagccaagauccugccacugcacuccagccugggugacagagcuagacucugucucuaaauaaauaaauaaauaagcaggaaggguaggagagcucuaaauauaugcacuuguuagcuuauauuuauguucagagccucaggaaaugagcauacacaccaggcuuaaauuggguauuccaaggaucagguuggggauagggagggaacuauuuuaaaauacaucucuuuuacaugugccuuuauauugacuuaaaauuuuaaaaauugagauagaauucacauaccauaaaauucaguccuuuaaaaaguauacaauuuggugguuuuuacuguacucaaaguuuuauaaucacggccacugucuaaugccagaagauuuucaucaguucauuuauauugacuucuuauuucuuucuuuuuaaaaaauuuuaauuucauuucauuuuauuuuugagauagggucucacuuuuucacccaagcugcagugcaguggugcaaucagggcucacugcagccuuuaccucccaagcucaagaguuccuccugacuaagccccacaaguagcuggaauuacaggugcacaccaccauaccuggcuaauuuuuguauuuuuuguagagaugaggucucacuauguugcccaggcugaucuugaacuccugagcucaagugauccccuugccucggucucagagagugcuggccuuacaggcgugagccaccgcaccuggccuauauugacuuuuuauaacaagcauguuguacuucgguaguuuuuaaaacauaaaaaugauuuuaaaaaccaagaaucacagugauuuggcagagcagugggucuuuucuggaaaagagagucuugccuacccaugcugucaggguuagucaaaugcccaggcuuucuggcaagucagugguagauuuuucucucugcuuucauacaaaugggauaauaaaaauuuaucagccauuuuaagcaacugaaugaaaauaaguuuugccuuuaccauuuuccuuguucaaaauccugaaguucuaguuuccuaguugauaaauuacaucaguugacauucuccauaaccuggggucagaauacuguaucauugcccaucaacauuauuagguuaaaugaaaaggugugaaaacugauaucuuacuguuuuugcaacucuugguuuacaacgagguuaaaguuucaucauguuuccuagucauuuguauuuaaaaauuuucuuuuuuuuuuuggugaauggacuauucuuugcuguuuguccaugacccacuguuacggacacccaccugguaguggucucagcccuuugcugaauaaccauuuccuuccccaucuuuguccuuaguuacugugugaauucuuauauugugauuuauuuccaaugacguguugaccuuuuaacauugaguuugcuuccauauuuagcguguauaugaugaagaaguggaggagccaguacucaaggcugaggcagaaaaaacagagcagguacuuguauaaaaucacucuuagcugaguuucugacuuugaaaaaugugguggagaucgauguguuaugugggaacugggggauggugggcgggguugggaaagggagggacugcuccugacagcagcccaagaggggauucuuuccuuuguuucugaaauguaguguauuaacuaauacagagaucaaauccuugaauucugauauaagaauagaguagaagucagcaaacuucuuuuguaaagggccagauaguacauauuacagauuuggagggucacagaggucauuuuuuuccuguggcuuccugaguuacagauggaccagccuucuuccugagaucuucucacaccagagcccaaaacauagcuaagagguucugggucacacugacuucuuagcacuccagcagagauuucuuuuucuuccacucaggaaggcacauggacugugaauaaguuuauuauuggaguagcuuugauuuuguucucauuuauucagaaaauauggaucaccuguaaagguuggcccuuugucagcaauuauuacuuguaacagaugaagcuguuagacuaggaaaaggguauucgaaaccagcuauaguucugccuguugccagcauuuuuuaaaaaaaguuauuuuauuuuauuuuuuauuuaaaaaaauuuuuuauuuugagauggagucucacucuguugcccaggcuggagugcaguggcacgauaucagcucacugcaaccucugcuuccugggugcaagugauucuccuggcucagcuucccgaguagcugggacuacaggcgugugccaccacgccuggcuaauuuuuuuguauuuauuguagagacgggguuuugccauguuggccaggcucgucucaaacuccugaccucaaaugauccgccagccuuggccuaccaaagugcuaggauuacaggcgugagcuacugugcccagcagguuauuuuauuuuuaauagaacucaaggauuugcuagccauuuaagugcaguaguaucugguuauaccaauucaggguuuaauuugaaggugauagguauuuaguguacuauuuuuaaaaacugcuauauauuucauacacauuuucacaaacucaguacaauauuagcuauuuaacucagaaucaagcauauccaaauagaaaaauacacaaccaagacaaaaaaguucaguuagaaagacuucaguacuugagauaaaagacuaaaaugcucguaggguuuuuuuuuugccuuuggcccucagaacaacacugugugguuugguuccuucuagaauauuuguagagggggaaaugacacuaaauauuuuucgguauuucucacaauggcacacuugugucugcggggacugccauugagaacugcuguugcaggaagaagacaccugagggagauucucagccuguuggugauaugaacaaaccuuuuuucuugaguggggcauuguuguaggguauacacagaauagaccggagaugaaaaugacccccuuuugauguagaacagauuuauaaaauaauuguaauuguccaguauuuuuuuuuugucucuuuaaacuguaauugaaaaaugagaccucugugaccuuccuucuaagucuuaacaccuaaaauuacccaagggauaaccagggcucgugggauagucauggugagucugagagucuaggcccuccagcaguggggaaacagcauguauucauuguugggauacuucuccacacacuaguuguaccucugcuuuuguagacgaugacccuugagcucuggaaccuuagguaguuugaugcauguccagaaaggggcaaacuugggauuuaaaacuugcagucuuacuccaaagucugugucaaggcauucagcagaauuugacuuuuuuaacauuuuuaauaaguuuuuuuggagcuugaggcuaggcuuuagagaacauucacaguauucuuuuggggcaguaucaguauauuggagacccauacugcaugguauuuauuuuguaggagaagacacgagagcagaaagaaguagaucucauuccuaaaguccaggaggcugugaacuauggcuuacaaguauuggacagugccuuugagcaacuugauaucaaagcaggaaacucagacuccgaggaagaugaugcuaaugggcggguggaacugauccuugaaccaaaggugaagacauucaacuuaaauauuuauugcacaacuauuauguuugggcuacuuuaauugggcacacgauuaguaagucauggacuuaaccucugggaagugaguaugucacuuaguagucucacauugacuccaccagaaagacucgcuuuaccugagcacugauggaguacuugugaggcgcaaggcaacaugucaaguuggggugcaaagaugcagagcauggccucuacucucgagguguguguugcagucuggugggagagaggagacauacauacgaauaaccguuguaaaugcccugagagagaauugacuuccagcuggaauuuuggggcaaagaugauauuugaauugggguuugaaggguggggaggcucaaaagagacagagaguguugggaaccugaaauuauguagcuugggcuaaggaagacugcagaagaacugaaaggcauuuggguuguuuccgguuugggcaauuauuaaauacaaaugaagcugcugugagcauucacguccaggcucccucauagccuagugaguguugguugcuugacacacuuucucccacauuguucaaagagacaauuggggugacacagagucucucgguagugaacacagaaaguuaccacagugauuuauagaaagaggccuugugacacacaaggccuuccgaauuaaaacaugccacagaaccaaacccuuuuuuuuuuuugagacggaguuucacucuguccuccaggcuggagugcauggcacgauguuggcucacugcaaccucugccuccuggguucaagcgauucuccugccccagccucccgaguagcugggauuacaggcgcccaccaccacacccagcuaauuuuuguauuuuuaguauagacaggguuucaccauguuggccaggcuggucucgaacucccgaccucaggugauccgccugccuuggccucccaaagugcugggauuacagacaugagccaccgcacccagccugaaccacucuucuagucauucuguagcugcacauuucucuuccaguuugagcuuugcugagucacaccaaauugaggcagaucauuuggcacugaccgguacacuugcugcuuggauuuucacuguaugccuuuaaaagucagcaguggacucugggaaauggauugccuggaccacacuugauacuuccaagacacacagcacuuucucucuuuuuuuuuuccccuugcagagaaaguuguggagguacacuuuucuuuuguaggaggauuugggguugucuucugagucagugagaauuaguccaaauuaacgcugucuuugccuuaugcuccauugguugcugugacgucguugaaccuuuacuuuaaccuucccaaucuuucuguuguugugugaaaugucagaauuauucuccccugccccagaguccuuugacaaggaagagauaucauugccaaagggcaaugccucacaggggacagggcagcauuuccuucagcaguggagguaggaggcugugcaaggguggagcacuuucuugacccuauuuuuuuuuuuuuuuugagacagaguuucacucuuguugcccaagcuggaguggcgcaaucucggcucacugcagcuucugucuccuggguucaagugauucuccugccucagccuuccaaguagcugggauuacaggcauguaacaugacaccuggcuaauuuuuguauuuuuuaguagagacgggguuucaccauggugaccaggcuggucuugaacuccugaccucaagugauccgcccgccucggccucccaaaagugcugggauuacaggugggagcuacugcaaccgaccaacccuaaauuuuuaauguguguguggugugggacugacaggaguagacggcugacaugggcagaucuccagcaugugcuguuggggccacagucuccugcccucacucuguuuucucaucuggucuuauuuuaccaacuucaauuuucuaaauucaacaguguggaaccacuaggggguauuguucuucuguuuauugaguuauaaucuuuuuuauuuauuuauuuauuuauuuugagucagaguuucgcucuuguugcccaggcuggaguggagugaugugauguuggcucacugcaaccuccaccuccuggguucaagagauucuccugucuuagucuccugaguaaaugggauuauaggugugcgccaccacacccagcuaauuuuuaguauuuucgguagauauuggguuucaccacguuggccaggcuggucucaaacuccugaccucaagugauccaucugccucagccuccgaaagugcugggauuacaggcaugagccacugugcccggccuaaucuauuuuuauauuaaaauauauaguuacauuaugucucauuaguacugcuuuuuaggggacagcucaccagaauguucaguuucuuuccuugguccuccucuucuuggaccuuauacuaggagguuguacccuuuucccuguuugcuugcugcugauagacuuuugguaggcuuuugccauuuuuguuaaauuuuguuaauuaggcccuuggggagggagauucugugugauacagcuuuacuuugguaucuuuuuuuuuuuuuuuuuuuugagauggaguuuugcucuuauugcccaggcuggagugcaguagugcaaucucagcucacugcaacacuguuuccuggguucaagugauucuccugccucagccgcccgaguagcuaggaugacaguuacccgccaccaugucccgcuaauuuuuuuggauuuuuaguagagacgggguuucaccacguuggucaggcuggucucaaacuccugaccucaagugauccacccgccuuggcuucccaaagugcuaggauuacaggcgugagccauggugcccggccuuaccuugacaucuuuaccuaggauuugacuuuuaaaaaaaucagugaaaaaaagaauuuuuuuuuuaacuuuuaguccugcuguguuucuuauucuccacuuucguuauguagcuuguuugggauagucagauggaacaggguaucagguggcacauguaaguuuguuuucaacugaaauguuugacagccuauuccuuucaugauguacaggaucuauacauugaucguccuuuaccauaucucauugggucaaagcuguucauggaacaagaagauguaggucuuggagagcuguccagugaagguacuuuucuucaccaaauaauuuuguuccuuaacauuucuuuuuuauuuuaaaauaauuucaaauuuuacauuaaaguuucaagaauaguucaaagaacucucauauacccuucaccuggguuuaccaguuaacauuucaccacauuuguuagauuguucucuacauauacguaauauuuugucuugagccuauuugggagacaucaugcucaugcccuguuacuucuaaauguuucucuguguguuuucuuuuuuucuuuucuuugucuuuuucuuuuuuugagacagagucucgcucuguggcccaggcuggagugcaguggugcgaucucagcucacugcaaccuccgccucccggauuuaagcgauuuuucugccucagccuccugaguagcugggaccacaggcgugcaccaccacaccuggccaauuuuuguauuuuuaguagagacgggguuucaccauauuguccaggcuggucucgaauuccugaccucaugaucugcccgccucggccucccaaagugcugggauuacaagcaugagccaccgugcccggcuguuuuucuuucuuucuuucuuuuugagccggaguuucucucuggucacccaggcuggaaugcaauggcgcgaucuuggcucacugcaaccuccaccuccuggguucaagcaauucuccuaccucagccuccugaguagcugggauuacaggugcccaccaccacaccuggcuaauuuuuguauuuuuaguagagaugggguuuuaccauguugggcagguuggucucgaacgccugaccucaggugauccucuguguguguuuucuaagaacaaggacaucucuuguauaaucacaguagaauuacaaagccaggauauuuuccuggacauaaggguauuauccaaucugcugcuauguucacauuuugccguuugucccagugacacccuuuacagucucucucuuuuguucugugguccgggacucaauccaggaccagccaccacauuugguugucaaaucuucaguuaucuuuuaaucugaugccauuucucagccuuucuuugcuuuuuaugacccugacaucuuuaaagaguacaagcaauuuuuuuuuuauuuguaaugaauaauuuuuggggggagagauacuucaagacuacauaaauauguaauuccucaccauaaugacacuuucaauuccaguaaguggguauagaugguuuuaucaagaucucugugaugcuguuguauggugguuugugauuuugagcuaaggacauuuucuugugaauauugguguggugacccuuaucucucuucucaacagaaggcucuguaggcagugaucguggcaguauuguggacacugaggaagagaaagaagaggagguaagggcuguuugguaugaccaggucacggugggcagcaagcuuaauuuaagaugggccuagcaggcuaaguaaauagcauaacugugaauucguaaucugcuuccauaaagcuuuuaacagugauagaagccacauucugaguuuuuuuucccaaggguuagauuuccuuuuugccuuauguacaauaauagggaaagcugcuuucaucucuuccacuauuauccucucucccaccuugccaccaaauaucucuuucacccaauauauuuuugagaagggcagcuuagauguuuugguggaaucucugccugggauauagucuuugaguauauucugucuuugaauaauucuaagggaaaaaaucuacauuuagaacuuuuguaaacuauaaaaccuagagcaggauauaccgaaagccaccacuuacauucuauuuugcugcugccgcuagcgcuuucauauccacagagcauaauuucauuuccuugucuagaguuugaguuugugggccuugacuacaguugaaucuguaguuguucuuuagaugggauauucguuauugcaaaggacacagccauguugcaggagaguccucgaguaugggauuuccgaaaggagacaguguuguguaugugcuuuucucuucugguuggucccccuuucugcacucucccugcccgccuuucuuccaguccuccaaagaaaaaccugacagcaggaaaugagcuuuucuuaaguaacuuucguauaacaaaagcagugcucauuaggggaaucccuugcuuuuagccaccgauguggcacuucuauguggcacuucaucaauaguugcucguagcaacuauugauguccccuucuugggccuaaugaaguaguuauuuuuauuauuuuuuuuauuauacuuuaaguuuuaggguacaugugcacauugugcagguuaguuacauauguauacaugugccaugcuggugcgcugcacccauuagcucgucaucuagcauuagguauaucucccaaugcuaucccuccccccuccccccaccccaccacaguccccagagcgugauauuccccuuccuguguccaugugaucucauuguucaauucccaccuaugagugagaauaugcgguguuugguuuuuuguucuugcgauaguuuacugagaaugaugguuuccaguuucauccaugucccuacaaaggacaugaacucaucauuuuuuauggcugcauaguauuccaugguguauaugugccacauuuucuuaauccagucuauuauuguuggacauuuggguugguuccaagucuuugcuauugugaauaaugcaaggaaauagagacaguauaguccaaaauguaaaauaacacaaacugacuuucaguaauuuaguuaguuaaaugugcaacucuuuaaauccaaaggcaagaguugaaagugcaggugaugugaacaaauuguuagaggcauuuaagugaaccacaaaaauuacauguuaacuggaacaacccuucacaauauugccagcuauccagcuuaucugcaccuugauacuuaaggugaccaguagucaguacaaagagacugagugucagagcuuuuucuccacuugacauagaaucagccugccccagagacuuagaccugcaaucauuucugugcuucuaaguaaagcccauuuaacaacaaagccuuuucuuccccacaaaggagucagaugaagauuuugcccaucauagugacaaugaacaaaaccggguaaggcucauauauugaaaugacuuuguuuuuacauuuuaauugaagcauaguauauauacuaauauuacuuuggaaugauuuaugaccaagugaggauuuuuucuuguauacaauuuauuuuccuuuaagcauuucauguauuuaggcuaacuaccuccuuuguauauauuuuuuccaauuuugcuuuauaguuuauuuuucuuagaaaagaaguuucaaagaagugaaaaacacaauuggaaaacagagccucuaaaagaagacucaguuacccaaacugaacuacuuugcaugagucccucuucuguuuuaaaauuggagacaaucuagcaguaacauuauugaguauucacaagaugaaaacuucuuacccuacugucuuagcacgguuaucuuaauuuuugaauagcuaaaggcguauucuuuucauagugugcaucuuucauuuucugccauuuuauguuaacauuuuauaaauguauccuuauuuauuauuauuauuuuuuugagauggaguuuugcucuuguuguccaggcuggagugccguggcaugaucucagcucacugcaaccuccgccuccuggguucaaauaauucuucugccucagccucccgaguagcuggcauuacaggugcccaccaccaugcucagccaacuuuuuuuguauuuuuaguagagaugggguuucaccauguuggccaggcuggucucgagcuccugaccucagguaauccacccaccuuggccucccaaaaugcugggauuacaggcgugagccaccaugccuggccuccuuauuuugaauagccuuugcaguuugcguuguaaacuucuauacuuuuaaacauacugaguaugauacugucauagucucuaaauguauaagggaaaggguuuauuucuagaguuguauuuuugauguaauaauguauucaauauuuucuuuucuuuuuuuugagacagagucucgcucuguugccuaggcuggagugcaguggugugaucucagcucaauguaaucuccgccuacaggguucaagcgauucucaugccucagccucccugaguagcugggacuauggguguguggcaccaugcccggcuaauuuuuuguauuuuuaguggagucagggucuucccauguuucccaggcuggucuugagcucaggcaaaccgcccacuucgcccucccagaguacugggauuacagguaugagccaccacgcccagccaauauuuucauauauagaaauccuuugcuucggugaacuguuucuucagaaugaggugguauagaguuauguuaauaacucuuaaugucugguggacauucuaaauuaaguauuaugcauguagauuuuccuacaaucucaucacuggggugauuauuuuaaauuucuuuuaguuaaaaauuugcauuuaaauuucuuaacugggaaauauuuuuuucacaaaaauguuuaacuaucaaaugaaggauuuuauacuuucugguuguuacuguauuuuccugguuguauucauaaaugugguugaucucuauaauuuuaacgaucagucuuucuucauaggauauuuguuucuauggaauuuccuauuaagaucuguaaaugcaaacaguuuuucuuuccuuuuuuuuuuuuuuuuuuuuuuuugagacagagucucucucuguuacccaggcuggagugcaguggcacgauauugguucacuacaaccuccaccucuucgguucaagugauucucaugccucagccucccaaguagcugggauuauaggcaugugccaccaugcccagcuaguuuuuguauuuuuaguggagaugggguaucgccauguuggcgcggcuggucuugaacuccugaccucaggugaucugccugccucagcuucccaaaguguugggauuacaggcgugagccaccacgcccggccacaaacaguuuuucaaaaacaguacaguauagugaguaaaagcacuagcuuaugcaacagguugguuuugugugcugcagcuaaccucaaaguuguaaggauuaaauuagauaauaaagugcuuuuaguaacaugccuggcacaguucauugauucaaacauugaaaaaaaauuuuuuuaauuauacauaguaguguguaccuuuggaaaaauuagaacuuaacagauaaggcuaaguuugagccuuccaguccuuuccuucucugcauacucuucagagguaacugggaucauguucugggagcaugucauuccaagucuguuucuuugcuuuuauaaacacaucuguuuccauagaaaugcuguaguguuugcagagggggcggggcgugguaucauccuggauuuguuauucugcgcuuuuuugcuugaccuaccuuggauggcucucuagucguuacagcuuuuaccuuuuaacuauuacucaguauucuuacuaagguaagacuaugcugaugauguuuauauuucucuaguaaaaggcugggcaugguggcucacgccuguaaucccagugcuuugagaauguaaucccagcgcuuugggaagcugaggugguuggaucaccugaggucaggaguucgagaccagccuggccaacauggugaaaccccgucucuaccaaaaauauaaaaauuagccgggcgugguggcgggugccuguaauccuagcuacucagagggcugaggcaggagaauggcuugaaccuaggaggcggagguugcagugagccgagaucaccccauugcacuucagccugggcaaaaagagcgaaacuccuucucaaaaauaaauaaauaaauaaaaauauuucucuaguaagccauuuuugauauuuuaauauucugcuuuuuauauucuuguuguuacauucuuauaaaggauacauuuuuaggccgggcuugguggcucacgccuguaauccuagcaguuugggaggcugaggcggguggaucaccugaagucaggaguucaagaccagccuagacaauauggugaaacuccaucucuacuaaaaauacaaaaaauuugcugggcgugguggugcaugcguguaaucccagcuacucggaaggccgaggcaggagaauagcaugaacugggcaggcagagguugcagugagccgagaucgugcugaugcacuccagccugggccacagagcuagacuccaucucaaaaaaaaaaaaaauauauauauauauauuuauauuuauauauauauauuuauauuuuauauauauuuuuauauauauauuuuucuuagauucaaaguaaaucuuguguauuauuucuuccagcacaucuuuugcuucauaacuugcugcaucauguuuaugauuauuauuuuaaaaagcuguuacuucuuugaaggaggagccuaaaggcugacaguaucucuucuuuagcuuaauaacuaguaguucuaauuugguauuuuauacucuuagcacaccacacaaaugagugaugaggaagaggaugaugauggcugugaccuuuucgcugacucugagaaggaggaggaagauauugaggacauugaagaaaauacuagaccuguaaggaaggcuguaguugcuaucacuuggcagaguuuuagaaccaaugacuuguuuuucuuuuuauugugacuuacuuuguacaucacucauuuuggcauauuugucauuucauuuacacuuuggaaaauaauggcaagcaucucaaauugccucacaaguaccacuuucuuguccagauguuaugauuuuaugagucagaucauucagaauaugucuaguuccagaguuugaagaccauagugcuccugucucuccauccauucaccuuuuucuuauuuucguauuuagauuuuuaaguauuaaagucaaguauuaaaaagaauaaggaaauaaagggcaucucccuuugaaggaacauuuuaugaguccuauuccuugggugagcuguauaggguacauauguuuaaauucauuuaauuaaacucuguuuucuccucaguucaauuucuuugcucuuguauacauaauguuguuagguguccaaagugaaguguacuaguuuguuacaaaaaagcgauucuuuugauuucuccugcuguagaaaagaagcagaccuacaucguuugcagaugagcuggcugcccgcaucaagggggaugccgugggucgaguggacgaggagccgacaagugagccccagccgcguugauggggaguagggggggaguagugcagggcccucugcuggcuucaccaaaggcggauuucucuuuuuauuaguaauuacuacauauauuuauuaguaauugcuacauauaauuuaaauuguagcgcuuauuccuuuuuugguuaaugagcuccuuuagauaacugaacacuguggacccacaagaaaaacguacauguacacauguagauaacccuuuacauauaauuucaggggauuaauagaaacuccagagaaccaugggcaacagcuuaagaauuccuggcugaauauuuacuccuauauuuugaacacguaagaaugugcuauauagcauauucuaguuauaacaggguagaaagauaacacaauaauucuuucaacaaauacaauccuguuaugcacaugagccugguacgaaagcagaaggcuucugccuuacaaagagacucuugagugcccacugugggcagggccaggggguucagugcucuggugcagcugagaugaaaggcagaugucuugcucuuagcugugaguuaugaggaugacagacguggaaagaaccaggauguguauacugagggaggacuuaguacuauuaaaacugugaacuguucuucaagccuuacccucaggagaagcaaaaccucggaagacacucaaagagaagaaggaaaggagaacuccuucagacggugggccuuuucccucaauucuguuauuuuaggagccuguugacuaaggaauguugcuuacauaauucaugaaguacugcuuuacaugcuguuuucccucugacaaaugggucugucuccauuuacuuuucuaaagccucugggcugggcgcgguggcucacaccuguaaucccagcgcuuugggaggccgaggcgggcggaucaugaggucaggaguuuaagaccagccuggccaacauagugaaaccccauuucuacuaaaaauacaaaaaauuagcuuggcaugguggugggugccuguugucccagcuacuugggaggcugaggcaggagaaucacuugaacccgggaggcagagauugcagugagccuugaucgcgccacugcauuccagcccaggugauggugugagacuccaucccaaaaacaaacagaagccuuggaaggcauguuuuggggugcugggaggauauguggguguggaguaaaaauuccuguagagauuugauuuauuagauuuuacagcaaucauuucuugucuuccuagaauucuuagaaguauagaaacuuaggaaucucuagcauuuguuuucaauaaaggauacaccaggccuuuuucugcaaacagccauguccauuacauuagacuugucccugugucaguuugcagaucccuuuguuuauucugcccuuccuucccccagauugguuggggaaugggucuugaauguggcgucugacccgaaugcuugcuucagaguaaagcuagauccagggugcuggccuagagaaugaauacugugugccacagacguggacagacuugagaguggaggcccagagagucuuuugagggugucaguggacugugccagggguuuagugugaaauucaucagacugccucacacuuuguuaaauagugucagauaaacuccaugccaguuuggagacacagcagaugccaacccgggaauuugaguucuggacccaucuuuaauacucccugcaaaacauugcuuucuguuugcuagaugaagaggauaacuuauucgcaccccccaagcugaccgacgaggacuucucgccauuuggcucuggagguggccuguucagugggggcaaggggcucuuugaugaugaggacgaggaggugaguccauggcacccagcaacacucccugcagcuagcugugucagggguccacagggaagauauaggcuuugcuuguuuagugggggaaaaacaguuucucaguuggaaguugcuucuauuuucauauuuugggacauuuugaacuaagaaucacagagugagaaaugccguauccuucuaugcuuuguuaggugaggagaagaugugcacguguuaaugugaauaauuuacuaggugauuguuucuugccuuaucuguugucuuccacguuuguuuuuaauuccuggacaggccuaaauuauuuuagggucugauuuugccauaguuaucacuuugcaacugauuuucuggcagaguaguaaauauguagcuuuaaaucuuguagguuauuuuuccuuaggaauccucacaugcagcuaugcuuucuccugguuuuuugaauucuuugucauauaccuuauuucaaccagagugaccucuucacggaagccccccaggaucggcaagcuggagccucuguuaaggaggguaagcuggggcugggcagcugcgucuccgugugcagaguuccaaaacugucuuucucacuaggagauggaacaagguuguucccaagccuuguuucuguguuaagcaggaagcuguuguuuuuacugugguccaguugaaaguaauucaucuucacuaauucaugucuuggaaaaaacaguaccaucuguaaacccauaccacagucuugccucuuuguuaggagagaacucauagaaagucaaacaagaaaaguacccuagagcaauguugaggaugguuuucauugaaugaaguuuaauuuaaagaaacauuuuuaacauucuguauauaaguuggagaccaguaauuccccaacccagugugcauuaaaaucaucugugcagguuuuuuuguuuuuuuguuuuuuguuuuuguauuuuuaguagagacaggguuucaccauguuggacgguuggacaggcuggucuuaaacuccuauccucaagugaucacccgccuagaccuggcaaaaugcuaggaauacaggcaugagccacugcaccuguccccuuggugcaguuuuuaaaaaacacaaauauaaauauguuuuuuaaccuacaaauguuacuccauagguuugugguaguucuugggacuugggaauuagugauucuaagugccgagucucccgggcacaggcaucagagcugggccuuggaggccgcuccuugugccugcugugcgggcugcuagccuggcucuccucugcuuucugcuguccauguuuuggcaucagugacuugcuugguuucccccuuugcucuuaugucuuuauuuuuuuacugaugacucacauguuuuugcgguucuuuuucacccguucauucucauccaacuggaauggguagagguggaacuguuugggggagcccuggucaugcugucccugccucugcugugcucaccuccucccuuggugucccccagcugacccacugcuguggcuugaugacggucagcaugcucuuccauuggagucacagcucagauuguguuaauccccaaaaaaaaguccugacaucgguagagaagaaaauacuaaagaauuuuaaaaugacuuguucaggaaaaagugguuucaaaaggucugauacuagcuguguuuuacaucgcacguauuucaggaagaaaauagcaaggaaaguuauuucccuuguaaaaugguuaccccuugcuuucucauucuagagucuucaucauccaaaccuggaaagaaaaucccagcaggagcuguuucuguauuuuuagguaacauaacuuagguuuguuuucuaaaaacuacacaaauacuguuuuuugcauuucaaaauuaucaucuucuaaagucuggcuggagaugaggaaguaccugggagcuucaaagggcuuugagcaucuuauagaaagagcucauuuacugauauuagcucuuauucuccuagagcucaguggccuuggacuuuuuuguguuugagcugaccuggugauucuccguugugagauguucuguagcaguaauggauggaggcuauugggcccuguuaugcauuuuguggauuaacugaaauggaaaguuuuuggugggugauaauuuuuuucuguaaauucaaccggcccacacuggcucacagcuguggcugucuugucuuuccacccacaggagacacggauguguuuggugcugccuccguuccaucaaugaaggagccacagaagccugagcagcccacuccaaggaaaagccccuauggucccccucccacuggccucuuugaugaugaugauggugaugaugaugacgacuuuuucucggcaccccacagcaaaccuucuaaaacagguauguguuccugccuccguuucuaggacuucagccagaaaaagaacguugccuaaaaagaacauaagcucaccuaguucuguaucucuuacagugccagaaucccuucuccagcauuccugucauugaguuguugugucuguacuuacauagguguggugccugggaggucuguuuuaugauccaaucuuuucugcucuguaagcuaauuacuaugauuauuuuccuuauagagagcugaaauccuuuucuguauaauuuuugcuugcaauuuccaguucugaccuuugguauuguaaaguuuuaaucauccuuucuuccagccgaccuuagucaauuacaugagcagcagguugugugccggccauuuauuucccagcuucucauuucucugccaaaaagcucagguggccuuggucuuuccucagaugauguuuucauccccuuggccacuucggcauucuccucucuuuuccucuuaaauguaaguccuauguccugaagucauucccauaaaucauuuguuuuuaaaugugcagaugaaucuuccaggggcuuuugucaaaaugaagauuccgauucaguagguccaggguggggccugagaauuuacauuuccagcaagcuucauggucuguagaucacacuucgaauagcaagacuuagauccauugacugcucuuccagaaaagaaagguagaucccuagaucccuaaggugcacaugauuuucagcaacuuuaaaaaauaaaaaaggauggcauaggaauggauggaacuagaaugcauuuagaagccggcuguuuggacucacucucuuccaguguuagguguagaaaguaaggauggaagccgaagugugagggaaaacgauagccuaguuaaucuagaaagagugcaaacggaugcagaaugcacacaggucucagugaagaugacaaugcacacaggucucggugaagaugacagugaaugaagguaguagugcuuuuuguagcuccacagggcucuuacuuaguggauaucuuugagaacugauuuagaaucccuaguaaauugaugcugcuuucuuugacaacuccuagucucuucagacauucaugagucagugaccucauuucagcaacacaugcccuauucgguacagcagugcuuauggugaugaaagguuggaaaccacccaaauacuuaucaguagaguaagcuauggcccuucuauucaguggacuauucugugacaguuaaaaagaaaggggucuacgcuuguugacuugggaagauuuuguagguacauuaaguggaaaacacaaaugguaagacauuguucaaauuaucuucuuauuuauagccuuauuuauaaauaacuaguguuaauucauuaguacauccuuugggggaauuagaagcauguaugcugaacuguucccaauguucaucuuguuugaguagacugguggaauuaugaggggauuucauuauuugcuuuuaucugcuuuuguacaguuugauuuuuuuuaaaacaggagccaagccuucauuucucagauuccuuagaugauugacuugguggcccucuuaaaugaucuuucuuccucuagaucucucuucaccuuguaagccaguccaagcuacucuaaguacaggaaauggcugcuuggauaagcaugucagccacguggauaaacugucuguucugucuuucaacugaacugcuacuaugcacuuugaaaaauuccaagggaagaguauaguuccacuuacuauuucuuuauaacuaaucaagaaacaacauaacuuuuuauguuuauucuuugggagggaagaauuuuuuaaucugugaauuuugugauaggauguuugacguuagugucauuuuaugccuugguauuuuuuacaggcaaaguccaauccacugccgauaucuuuggugacgaagaaggagaucuguucaaagaaaaagccguagcaucgccagaagccacugugagucagacagaugaaaauaaagcaagagcagaaaaaaaggugagcaggagggaagacuuaacgcaggagcauugaucugccgcauuuuaauaauucauccugaacccagagggaagugcuguucccuuucacguucauauugaagaacuucaaacagaaaguggaaagaacauugcagugaacacccaaauaacugccacccagauugaucaguucuuaggguuuuggcaaacacuuuauggauguaaaccuuguuacauaucuauuuuuuuccugaacuauuugcauguaaguuguuugaacuguuugcugcauggaacuguuuccauguagucauugugacauucuaccccuaaauauuucauuaagccucucuugaaaagacuuccauauaagcgcaaugccauuaucaacagcugugagacuaacaguaauucuauaguagaaucuaauaucuagucuguauuagaauugcuccaguugccccagaaugucuuuguaaaaucaccccaacaaauagaauacagauuuaaaauuaucucgcauauaguucauacugcaauuuccucucuuguccccaaaaugccauuuacagcagugauccccaaccuuuuuggcauuagggacauaaggagagugcaaccugcaaucuagaucccucacaugcacaguucacaauagcguuugccuuccugugagaaucugaugcugccacugaucugacaggaggaggagcuuaggcaguaaugcuugcugcucaccucaccuccugcuguguggcccggcuucuaacaggccauggacuggucugcagcccaggguuggggaccccugcuuuauaguauuuuuuuauguuuugauuuuuuuuuuguucuaagaaacucaggauuuggacagugugucugcauugcauuugguugucaugucucuuuggucuccuuaaucuagagcaacaccucccacaucuuuuuuuuuuuaauauccagccacuuguauuguagaaugugucucgugaauuugcuugauuauuuuccuaugaauagauucagggugagaaguuuuggcaagaauacaagcaggcaggguugugcacuuccaguuggaucaccucccaagacacaucagguccacugucugccucauucagacacguuugucacuugguuguuagggugcccaccacacugcuucauuggaaagguacccuguccucuuuugccauugcuaaguugaucucuaaagcgauaguugaacacagugugaauaccuguucucucccagccuuuuacucaguguuuugaaaauccacugaugaucuuuucuugacucaguuaaucuguuagcgggcacaaaccacuauuuuuuuaauucuauauuucuuauuaguuggcauucuucugaaugaaguucuuucucucccucuccuuccccgauuuuuaguauugcuuugggaucauguauucauucuucaguguagaugauaauccauuaccaucauucuucuucuuuuuuuuuuuuuuuuaugagacagggucuugcucuguugcccagacuggaguguagugguacaaucacagcucacugcagccucaaccuccuggguucaagcgauucuccagccucagccuaccaaguagcugggacuauaugcgugcgccaccaugcccggcuaauuuuuuguggagacggguuuugcccauguuggccaaaccaucauucuuuuugaugcucagauugaccugcauuuggccaguguguguguccccagcagucuuuaagcccuucugacugcuugaccuuucacugcuguccuguacagcuggucccuccucuuucuacaguuuugucucuuugugucguguccuggcugugaagcccugacuuucuccugccgaccaccuaaggcccagcauucagaaccugucaggcccgucaggcagccugucuuuccaugcugucucucauugcauaugucccaucugugcacccauugacccagacuguguguccugcucccugauacaccagauguguccucuguuugucuugcuguucucuuaacagcccccucagcuugcugccuaucacagcagagacuccgugcguuuucucgauugauugaguaaacccucuuuucuggguaucuuacguguuaaugcuuaauuuuucuuuuucuuuuuuucuuccccacccccccccccacccccgacaaagguuaccuuaucuuccagcaaaaaucucaagcccucaucagaaacaaagacucaaaaaggcuuauuuucagaugaggaggacucugagguauggaauucuuuugcuuaguuguggguauuagucuauggauaugacauagaaacuauuuuugaaucagguuuuucucaauagaguuauaagacuuuuuguuaaguacuccaguucuuuaaaaauuaucucuagaggccaggaguagugguucaugccuguaaucccagcacuuugguaggccaaggcaggcggauaccugaggucaggaguuggagaccaggcuggccaacaugaugaaacccagucucuauuaaaaagacaaaaauuagcuggguaugguggugcgagccuguaaucccaguuacucagaaggcugagauaggagauucacuugaacccgggaggcagaaguugcaaugaaccgagaucacaccauugcacuccagucugggcgacagagcgagacuucaucucaaaauaaauaaaugaauaaaaaauaaucucuugagagcacaggggcuuuagaaagcaauauguuuacaauacuuuucacuuuggguuggacuguauuuacauuuccugggaugaaaauccucucucuuuaggaugcucagauuuuaaacuguucaugggcucaugaugugaugaggagcuugcaccagaguggaggucaccaugcuacuuccuuuauucacauucucacuaacuagaccaugccuuaacgcuguagcagauggguucuggcauagccaucugucuugucgagacugagaccacuaacagccucugggacccugguucauagguugcuuuggucccuccaggcaccuuagaaccaccucucagaauuucacugcuuuuccugagucucucaggccuaggucgucuuagauccaauuuuaaguuggccuuuuaggagaucauagaacuguaugagauuguaaugggaaguaauaagccccuuuuacagaaaaauauguggacauggcagaaacuuacauguauuucaagaaacugugggcucuagauuaggcugucaugguugggcuuugcacucacagcaaggaugaacauggaacccuuuggaaguagagugauugcccuugauguaaagaauaccuuugaggcuaucacugaaggcgaguguacaaaacguaggaauuaaccaaaguccaguuaagucacaacccugaccccugagaaacagcaugauggggccuccaccgucuuaugcucauggaucccaugugucacccacaccugcaccucagggucuuugcaccggccccugccacucugaggaaugcuguucccagaauccagcuugcuuccucacucuucgauuucucugugaggccucccugaugaaauacacacagcaggaagccugcuagcacauaccacgcugugcuccuguuccucuuuccuauuucacuguuuaccacagcacguguugccagggacaguguauauuuacuuauucauugucucuacuucccacuaaaguacgugccaugagggcaggacuuuguauucccuauuuguaucccuaacaccccguccuuaauaccagugcuuggcauguuguaagccauccaguaauuguugauuagacaagaaaaccaaaugugaacaauuucagugacuuacgagauguucugguuauuuguugcuaugaaacaaguaacucaaaaaccuagugguucauaacacccauaguuuuguugucucacaguucgagagguugacugggcuuagcuaggccauugucacugagggucucuugugucugaagguggcugggcugaggaucaccuuauucauaugucugguaccugggcacuggggccccugggacaucucucacuagcccuguguggcucccagcauguagucagggaagccgguccucuuacaugcuggcucagggcuguaggggagaguccucagagagagcccgauggaggccauguugccuucuuuguuccagccuuggaagucaacgguguuccuuuugcuucauuuguuggccaagauggucacaauggcccauccagguuuauggggagaggccauaggcuccccuucuugauggugggaguguaaauguacucucagacuugugugaaaacccuaccaaaggcuuugccccaugugugucaucauagagcgaauguuuuuauuggauauuguucagauucuaaggcaaggagagguaaaacuaaggcagucuaaguaagaguuaaagcuuuggacccgaaggaaugcguccugacuccuuucucuauaucucaagugugaggcugaagcuugcccuguggucauuuugggggaacauauuugagguaauggaagugucuuuucuugcaguaccaagaaagguaucaguuaaggguccgaaacugugauguugacauuuguuuuuguucuuugcuuugguuuacuuucauuuucuuagaacagcagaacccuuucucuugccauuguguaacaugcaggagggacacgggaugccuggaauuccccuuguggccucuucuaucuaaauaaacccaugggacuccggggagcacaggggaaaaacacuguguggaggagaucucacuuagugaacucauuaggucuauauuuaggaguagacagcgaccccauaauuaaaaaaaaaaaaaacuguccaaagaggucuuagaaauaucuucuuguccuauuuaauuguucggcucuuguguauugaaguuuaucuucccaagggaauagaugucccauuuuauguuucuacuucauguaggucaacuugcaggucuuucuuugcaggauaagcugauguuuuauaacauuuugaaaauuucuugauuuuuauauuuuuuagcuauuuugagaugaaauuauacucuuuuugccuaggcuggagugcaauggugggaucuuggcucacugcaaccucugccuuccggguucaagcaauucuccugccacagccuccugaguagcugagauaacaggcacccaccaccacaccuggcuaaucugguauuuuuacaaaauuaauauaggcuggucuugaacuccugaccucaggugaucugccugccccagccucccaaaaugcugggauuauagacaugagccacagcaccgagcugaaaguuucuuuagaaucuaucaggucuuauccugguuugcaaugucauauaccuauaguuaagcuaaguagacuagcaaacauuuaaaaauaaaguuuaauuuguauuuacuuaaaagaaauaugucggccgggugugguggcucaagccuguaaucccagcacuuguggaagccgaggcgggcggaucacaaggucaggagaucgagaccauccuggcuaacauggugaaaccccgucucuacuaaaaauacaaaaaaauuagccaggcgugguggcaggcgccuguagucucagcuacucaggaggcagaggcaggagaauggcgugaauccgggaggcggagcuuucagugagccgagauugcaccacugcacugcagccugggcaacagagcgagacuccgccucaaaaaaaagaaaaagaaguaagucauaaucuuaggggaggaggguguuacuaaauaaaauaguuguagcuccauuaauuugggaaucuagccccuguuucuuuauugacccugucuaaucuuugauucuuuagacgguaaugggaagccaugcuuauauauuuauuuuuuuagcaugguguaggaaauugauucaaaaacuuauuccugccuucugucauucaggugggaauacagaagccccugggcucugcgaggccaccagauccuguagcucuccuccuccuuagugccacugcacacacccugcacagacccugaggccuaucccuuuaaggacucugucugagccaccuucccucucaggaaagaagccuagacacauggcagcugucaugucugagucacuuguguuuuauacugaccugauauuuuaaaaacugauauuccuguuaaccagcaacuuuaauuucaauccaacaggauuuguuuucuucucaaagugcgaguaaguuaaaaggugcgucucugcugccuggcaagcuccccacguugguuucccuguuugaugaugaagaugaagagguaaacauuguuauuguaacacuagauaauuuagauuaggagaaaacgguuguugaugcaacuuucuacccagaggcucauauacuagcaaaaggugguagggaagcagucaggccaccugaaguuuauauaacaaaaauauuucuguuuuuauuucagugacuucuuccuuauauuuuccuagcugugcaauggagaagacauuagauucuugaugcaguucuuuuuuuuuuuuuuuuccgaguuggagacuuucucugucacccaggcuggagugcagugaugcgaucuuggcucacugcaaccggguucaggugauucuccugccucgaccucccaaguagcugggacuacaggcgugcaccaccacucccggcuaauuuuuguauuguuaauagagacaggguuucaccauguuggccaggcuaguuucgaacuccugaucucaggugauccgccugccucggccucccuaagugcuaggauuacaggugugagccaccaugccuggcuucuugacacaguucuuauggagugaaaucuacagguuuuauuuuuagaaaucugccuuugagaaauacaauugacccuuuaacaguguggagguuauuuugacuuccacauugcagugaaaaauccauauauaacuucuuacuucccaaaaacuuaucuacugauagcuuacuguuaaccagaagccucauggauaacauaaacaggugauuaacauauaaauaguauaauaucuauuuauauauuuuuguauuccugacauauccagcuuuuccuuauuuuuuuuaugauauuucuaggccacaugguuugucugcaagauuuuucaaauuguugcaaauguccaaaaaaauuuucaacauauuacugagaaaacauuuguguagaaguggaccugugcagcucaaaccugugucauucagggucagcuguacuuuagucuagaggauggaucaacauauacccaaugaccuacaagaauguuuuggaucaaguggagauacaaaggagaaggcagccauguccugaccauugucuuucuuucccauccuggcuggagagagcacaguggggaagagaaauaagagagaagacaacccaaaccuuaacucucaugcaguacugggcgguggugagcucaaaggcuuugccaucagaccccuggguucauaucccagcuccaccacuugcaaaccagggaccuggggcaaguaacuuaaccuuccuuaagcuuauguggcuuaacagugaguagggucacuguggcagcuguaacuacuagugugaagcucuugcagagugcuggcacauaauaagugcauagugaaugugagcucugucauuagcauccccaauggacaccagcucauuauucuccuggccuguccuacauuaccgcacucuccuuaaaggagacuucauccaggaagacacucccuucauccaucuucacauuccagggcuguucaccugaguuuguccauccuaacucagauucaggcccucugaugcuuuuguuccccuuaucugaauaaaagcaccuuaauaaauauaacuuuuggggagugcuugaccacagaagaauuuacaaaugccauuaaacuuaguacaccagcaauuuuauuuaguaagcuauuucuccacuuuguauaaucucuuugaaacuaaugagaaacacaagucaugccuucccuccaucccagguguaugucuuucugaccuguaaaggaguggagacagacccccaguucucuccuuucagccauuguucugguuucucauucguggagacaacagugugaguuucuggcugcugcgggggcucccgugcccauugcaggcuguaacccccugaaaugagcagagaggcacuugcccacagggugacuggauggggcucaguuucuccuuguacuucaugaucucauuugcauguuguucuccugcuuauaugcagcuguucugccuucgaguucuaugguaaucucuuucccuucuaugggugcagugagaaaaggcuguaguuugggauuuacuagcauuuugcgguuuuuccccgccagaguuguuauuuguauaccugacuggagacuuacuuccuuaaaguuugauauaggaggacauccuauguuuucugauuauaaaguugucuuaccuuucugccauuugcuuuucuaggauaaucuuuuuggggguacagcugcuaagaagcagacauugugucuacaagcucagagagaagagaaagcaaaagccuccgagcucuccaaaaagaaagcaucugcccuguuguucagcagugaugaggaggugagcugagguuucugcuaaagaagaggggauuauuucaugggauuuaagaguuaaagccaucccaagucuuuuucuaccuguuuuauaucucgugauguucagucaccaaaggcgauguucacaagauugucuuuucugacggaagacauuuaauguaauauauuaauuuaaagaugaaucucuucaaaaugguuaggaauagguaugacucccacacaauaguguaugcuccuucaaaugaguuaggccggcuaggggggaaaugauuucucagccaucgcuaguucauggucgagucccuuagaacaaaugacagauuaaccagagaaaagugugcaaguuuacguaagauaaguuuuaccagacacaggagccuucagaaagaaaaacucaagagaaacaggaaauccugugucaauuuuaugcagucugaugaagaagcggacaguuuuggggagcacgauuagaugaaaggggugugaccugaugggaauaagcuggggggagcucagcaaggccuguguggucagaucauucucugcaucuuuacaaauaaggaggcuccuuuccucugggaauagggaggacuggaaugaagguuuuaugaccuacuccagagaggguuagaggauucuucuauguccugcuucagaggagaagggccagggaaaggucagagagaccuuucugcuucuguuuucucaaaugccaaggugucauauuuugagguagcaugucccguauaccccaauggccauauauacuaguaucuuguuaaaugacuacuguguuucauuaauuuagaacuauaguuaggaggaguuaccuauugagguuaaacuccuuuuugagggagucuuaacaauauuucuguuugugaucuggauagauacuaccaaaucaguuaguuuaguugcuaacucaaucagauuuaguagcagggaaucagauuuagcugugcagaaaaagacuuuaaauaugaugauauaaaaaauccugaguaguaaacaucuuccuguguuauaauaauuccucuuuuuuuuuaacauuguaggcaaguuaauagggggugaaguggauauauaagucauagauauguucauguucuuacugaaagcaauuuaaaaauuccgaagcagauugcaaaaaaaaauguauuaaaagcuuaugcggccgggcgugguggcucacgucuguaaucccagcacuuugagagucugaggcaggcagaucacuugagguugggaguucgagaccagccuaaccaacauggagaaaccuugucucuauuaaaaauacaaaaaaauuagcagguugugguggcgcaugccuguaaucccaacuacucaggaggcugaggcaggagaaucacuugaacccaggagauggagguugucgugaaccgagaucacgccauugcacuccagccugggcaacgagcgaaacuccgucucaaaaaaaagcuuaugcaacacacaugugaacaagacacaaugaaaaacugcuaguaauccuuuuacuacaaaagucugagucuggccuuuagaaagcguuuaaggaauucccacccagcugugcucaugccuucacaucaaggaacucccaagcauauauaauuuguguuuucuacucaaauguaugaauuuaugauagauuauccaguuuuuuucuuuuaaacauugucggugauuguucccccuguagcaacagccagacaucaguguaguugcuccuacuagaguauuauagugguucagggaaaauaaaaacauuaccuaaagcuuggagcaaaaagacaugcagaagaaagacagccaagguucuagaacaggggcguccagucuuuuggcuucccuggcccacacuggaagaagaagaauugucuugggucacacauaaagugcgcuaauacuaacaauagcugacgaacuaaaaaaauaaaaagguucgugcauaaaucccauaauguuuuaagaaaguuuacagauuuguggugggccgcauucaaagccauacugggcuguguguggcccaugggccacagguuggacaagcuuguccuagaacaaaggcugucaacuucggcugcucauugggauccauggggaacuuaaaagagugcugacaggccgggcacaguggcucacgccuguaaucccagcacucugggaggccaaggaggugggcagaucaccugagauuaggaguuugagaccagccuggccaacauggcgaaacucugucucuacuaaaaaauacaaaaauuaucuggguguuguggugcuugccuguaaucccagcuacucaggaggcugaggcaagagaaucacuugaacccgggaggcagagguugcagugagccgagacugcgccacugcacuccagcccgggccacagagcaagacucugucucgaaaaaggaaaaaaaaaaaaaaaaaaaaaaagaagaccugacgagugcugacaguggaucccagcuccagagauucugaauuaaucugguugggguacagccucgucauuggaguuuugugauacucucuaguggauuucagcguuuagucacugcuaaacauugaggagcacuucucaaaccuucauguuuaggaaaucacccaggcacccugugaaaugcagguucugauucagaaaauaggcgcggggccugaaauucugcauaaucugcugcuggcuuguggacuccaguuugauuugcaagacucuagacuccagagauagagcacuuaugcaagugcuugggaguucuuugauuugaaggggugugagcauagucgaguagaauuuccuuaaaugcuuucuaaaggccacauucagacuugugguaaaaggauuacuagcaguuuuucauugugucuuguucacaugugugcugcaugaguuuuuacacuuuuuuuucaaucugcuuuaggauuuuuagaauuaaaauauucuucucuggaguuggaaguucuugaguucuugguauuuuuacauuuggcuuccuucuuauagccucuguaauuaauguugauucccugaaauagacaagucgcuugucguaauacagugcagaaccacagugggaagagacaucguggcagguguuggaggaggaaaucaugagaagcucugugaggucagagagcccagcugucuagauuugaguucaaagaaaagucuuaagcaugagcuuucuucaagacugaugcacuaaguuuaauacuuaguuuaaauacaacuuaguuuaacaaauauaaguuugauuuuacuccccauguuuuauaaucuaaauugccauuggacuuuuuuuucuuuuuuugagacagagucucgcucugucccccaggcuggagugcaguggcacgaucuccguucacugcaagcucugccuccuggguucacuccauucuccugccucagccucccgaguagcugggacuacaggcucccgccaccacgcccggcuaauuuucuuguauuuuuaguagagacgggguuucaccauguuagcaaggauggucuugaucugcugaucucgugauucacccgccucggccucccaaagugcugggauuauagguaugagccacugcgccuggccuggaguuuuaauauauauuuuauguuuuaaggaccaguggaauauuccugcuucacagacccacuuagcaucugacagcaggucuaaaggagaacccagggauucugggacccuccagagccaggaggccaaggcugugaaaaagaccagucucuuugaggaagacgaagaagaugaucuuuuugccauugccaaggacaggugagauagucauuggaaggagucccucacuccguuaccgugguaacaagaaaaggaaucugaugcacaaucuaguucaucgggugauugcuaaucauggaucacauagugauugugccagugagaaugucuuugcuuuucaauggcaccaucuuuucccucaguacccggaaauguuugucuuuguggauccuuaucugauuucuuccccaaucauuauuuuuuaaccauauucuuuuucuuuguuugucagggauuugaguaucuuuuguuugugauuuuucucugggcuacucuaaaguaugucagguuuggucaggauuacuuaaaaguuacuuuaggccaggcacguuggcucaugccuguaaucccagcacuuugggaggccgaggugggcggaucacgaugucaggaguucaagaccagccuggccaauauggugaaacccugucucuacuaaaaaaauauaaaaauuagccgggugugguggcacgcgccuguagucccagcuacuugggaggcugaggcagaagaauggcuugaacuugggagguggagguugcagugagcugagauggcaccacugcacuccagccugggcaacggagcaagacuccaucucaaaaaaaaaaaaaaaaaaaaaaaaguuauuugaauagaaaucugcucagcauuuaacacauccuguuaggaggaaguucccuguagagcugugcaguaucacuccaggggcugauaacccauagccaaccuaggugccucuccccauuaaugcuggaacugaagcugcuaggauauucagagugagcgugggcugugguugguauaacaugcugccagauuagcuuauggguucagaauuacuucccugcaaauacuuuuuuuccuuuugaaagccugacaugauuacuuugaaauucaccugaauguuauuagcagaaagaaguaacugauuggacauguaaauccuaugcuuuggugugguuaagcgucauuugauagauucagaaguacgucagguuucugucuccaaauacucgaaucuugucaagcaucaccauuucugcauuaggccucuguaacuugacacucggaugcaucuuuggucucugauuuagaauauaggcucuggaaacuugauauuaaauucugauucugccaguuccugucugaauaaccuugggcaaguuaccuaacuucccugugccucaauuuccucauuuguuaaacaaaaauaaaaacagcauuucucucaucgguuuguugggaugaugagguggaaucuaaaugugaaaugcugagcacaagagcuggcacauucugagcccucagguauugccaguuagcaucgugacugcagggaaauaguacauuccuuuauuuuuguugcucucuccugggacauucuucuuccuguguugccuggccaccuucuuucaaaacuaaguguaagucuuguuucauaagaagccuucccggcugggcgcaguggcucacgccuguaaucccagcacuuggggaggccgaggcaggcagaucacgaggucaggaguugaagaacagccugaccaacauggugaaaccccgucucuacuaaaaauacaaaaaugagcugggcgucaugucacgcaccuguaaucccagcuacucgggaggcugaggcaggagaauugcuugaaccugggaggcagagguuacagugagccaagaucucaccacugcacuccagccugggcaacagagagagacuccaucucaaaaaaaaaggccuuuccuaacuuuaaacagacgagaaagagaagaaguagggagucgagggcggucauggcuccaccuucauaccccaacacccucagcugagcauuuucugcacuguauccagguuagcuuauucccaugaguguccacuacccccaccccacacaaggucauaaaucuggcagucugaaccccaucuuguuuguggguccugguuccagccacacaccauaccuggcuuucaggaaugcuuucucugcuccagauacauccuaccuccuauuguucccgaaguugucugucaaguuuuguguauggaaaguaauucauaccuucaucagaucucaaaagaagcuuuacacacacaagaagaaguugaggugaggauguggaggaauuggaacccucauacacugcuggugggaacguaaaaugguguagucacuuuggaaaguaguuuggcauuuccucaaaauguuaaacauagagucaccauaugacauaauaguuucauuccuauguauauacguauaaagagaaaugaaauuaguuguucauauaaaaacuuguacaugaguguuuauugcagccuuagucauaacagccgaaaguguaaacaacccaaauguccaucaacugaugacuggauaaacaaaauguauaaccauacgauggacuguucuucagcaauaaaaaagaauaaaguagcgaugcauccuagaacaugaaugaaccuagaaaauuuuauguuacuugaaagaagcuggucacagaaaaccacauauuguauuguuccauuuauaugaaauguauagauaaaccacagagacagaaaguagauuagugguugccagggccuguggggcagggggaauggagagugauggcucauaggcauggcgguucuuuuuggggucaugauaauguugugcacuuagguuguagugauauugcacaacucgaugaguauauuaaagaaaacauugaaguaugcacuuuaaaagagugaaucuggauuaagaaaaccauugaaguacgcacuuuaaaagagugaaucuggccaggugcaacggcucaugccuguaauccuaacugauugggaggccaaguggaaggaucucuugaggccagguguuugagaccagccugagcaacauagagcgaccucaccucuccaaaaaaguaaaaaaauuagccaggcauggugacgugugccuguaguuguagcuacuugagaggcuacuugaguucaggaauuugaggcugcagugggauaugauugugccauugcucuccagccugggcaguagagugagacccugucuuaaaaaguaaaauaaauauuaaaaauaaaguaaauacaaggugaauuuuauggaauguaaauuaugucucaauaacgcuacuaaaaaaaagaaauagaagccaggcacagggucauuucccagugcugauccuggcccugugaucucucuuggcaaccgucuucaugacaauucuggaaauaggccuguccgcuuugauucuuuuugugcuauaggaagugggagagaauguucugcuugggaaggcucaggcaucgugugccuugcagcgguaacagcugaugaaccugcacuggauaguaacaggaaaggggcaaccugaggcaggagggacagaggcuggugauuuguuggagucagauuucaucuauuucaaaggucuuuccuguuugcuuucaacuguguaaggucaacuaauggcuuggguguuugggugguagguggauuccuguaggugcagucuagaagaaauauuguuguuaugguuuuuguuuuuuucaucacacuuuuccuuaauuugaccuuuuguuuguuuguguagccaaaagaagacccagagagugucacuccucuuugaagacgauguugauagcggaggcucucuguuuggcucuccucccacaucuguuccuccugcaacaaagguauucuucaucucuuagucccaggaaauguccuugaguuuaugcugcaucaguagugguacuuccccgaaucagcucuucauaccuaaccuuggaggcugagucuuauggaagaccuuauuugccugguuucagaaagagaucuucugauuaauaguauucuagagaagaagcacacgugcaaaaccaucauucagugucagguguaggaacaaggaacugggucucagaagaggcuugggccccauugucauggaauucugcuaacauuagacuaggccaguuaaggcaaaaucauuccuuuuaugagugugugucgaguacuaacacugguccugguuuauauuagccagucaguaaaaaggaaggaaauucucacaugugcuacaaaaugcaugaaccuugaggccguuauacucuaucaguggagaaauggucacacagguccuaguacaguuagacuguggaauacuauacagugguaaaaaaaacccaggguggagcuuauugggaugaaaaacauacugcaggccaaaaaaaaaaaaaagcguaaacacguaaacaugguguaauuuaaacuuuacaaaacaagaaauacacaugaaugccuggaaaccggccugaaagcaucgauagcacauuguuaccagugauuauguccagggaaagguauggaauggggaacuucauacucucaaugccuuuuuaaagccuuuuuaaggaaggcauuugugcauuacuguggaauuagaaauaaacuccaaacaaaaaauaucuaggagauauggaagaagacccuuccuguuaaauggaguugcucagcuuauaccagaagcucucagcccugggccagcaugcugcccacccugggccccaggcucccugcugcugcuucuacggggcuccugagccuuuccuugggugcucuguacuuacaucucccccuuuaaggacauccagugguuguacaauuaaaggagucaggagaucugauugguuuuucuuuguaaauuauaaauaaacuacucuggaggauaacugagcaauaaauuaaugaauuuuggagccucuggagcuguaaaacuucuuucaaccuaugguaauuaugauuguuaaauaaaacaaaaggucaagacacacaacuuaaguagcugaauagccuacacguuuuugauuauuugugaaauauaaucaucuuuagacaauaguaaauaaaagauauuucuuguuuacagauauuucaguguaaguuaauugugacuugguuguaagccuauguugaccaaaagguuaaaccacaggcaggagaacuuaaagaaauguaaugugaguuuuguuuugagccaagcuugagaacuacuagcccaguaaagagacuccacacaaacugagaaugcgucccagagugggccacacgagacacagcauuuauacauuucuguuauauagaaaaugggaaaagggggcagugaagcaacggugacuuucuuaauucagauuggugcucggugacauugaauauaagauaaaguaaauaugugguuaauguauuuuccucauuagccuuuuacccuaaugaguacauaggggucgcaguugcagggucaggagagggaugguugauuuugugcugccuuugugcuucauccaauaggcagguuguaaucggugccugucagugugauauuugacagacucuggccuugcaggugagguucagcuuucguucauaggcccgguuucuauuacccauauggccaagaugcagccauuuuagacaauuuuuuuuucuucagacuuuccuuauuuucugacaccuaucaagaaaguaaauuugaccaggcgugguggcucacgccuguaaucccaacacuuugggaggcugagguggguggaucaccugaggucaggaguuuaggaccagccuggccaacaugguggaaccccaucucuauuaaaaauacaaaaauuagccaggcaugguggugcacgccugugaucccagcuacuagggaggcuggggcaggagaaucgcuugaaccugagagauggauuuugcagugagcugagguugugccagugcacuccagccugggcaacagagugagacuccaucucaaaaaaaaaaaaaagaaagaaaaaaacaggaaguaaacuucaugacaaggaugagcuugucuucaagaagauuaaaacugguacuuuggguagcauuuucugugguuuaaggaccuuaguuauauaugaaggaagaauaugauuugccauacuuaagucucuuuuugucuccccuaucaacuauuugcauugaauuauuauuauuuuuuuuuuuuuuugagacggagucuugcucuuucguccaggcuggagugcaguggcgcaucuuggcucacugcaagcuccgccucccggguucacgccauucugccucagccucccuaguagcugggacuacaggcacccaccaccaugcccgacuaauuuuuuguauuucuuuaguagagacgggguuucacuuuguuagccaggauggucucgaucuccugaucucaugauccgcccaccuuggccucccaaagugcuuggauuacaggugugagccaccgugcccggccugcacugaauuuuuauguaguuuucagugaguccaggauguuccacaaaagccuuuuccuuugauuacuucaguguugccuuaucucuucugaaauucuuuaugccuuccaguguucuuuuauguuaaguucaaugguuuugcacuuuacuuaucucuuccuaacuaaaaauccccuugcucucuucuuucuucauucaucacauuuuaaaaucaugauuagcaauguccuuccuuaguuucccaaaucugccuuccuaacuugauuuaggcauugccucaaagcacacuuccucgugucauaugguaugauuuguaucuguacuauacuauaauagaucuuuaguuuuuucucaagcacuuguugauaagucacuugcugcaaaaaugccaugaauuccaggaaagucacaaaccucaguuuccuaguccccaaaucccugccucccugauaaggaagagaugagaaaugggcugaagugcuugcagacuuguauugaacacugaguugguauaaaacacugggacuguccaugaaaauauaguguauaguccuuucagaugaacagacaaacagaugugugcuagcuguuauauaaguuaggaagaaagucaaggaagggucaaguagagagauaaauauuaugcuuauucaacaaagcaacugacacuuaacugaagaggacagagaccgugggugacaucugcgugggggcccugcuugaaggauggggaggauuugcaccuacagacaucgagggcagcguggcauggaaguuugaaaguuugcagcgaccuuaaggaacagcagggaaaggaggagaugcauaugaguagagggauagaaugggguaucugcugagugucauuugcuucaugcaaggagugcugguuuggguugggagaggaccugauccagcagguguuuuguuuuagcaagacaacgcuggauaaugucuucuaguugaaauauaagaggagugaggcagagagagagacucauaaucgucugguggcagagauaaggaucugagggagggaggcauggggguugacagacacaaguagacagauacaggugaugugguggcgugaaguguccuguccacaagucccggguggugguguuuguugcuucucccuuuuggugcuaccuucacuauccuguccucucuuccuugaucacauuuagcugaagcccuaagaggaugguuugggcuuguucuguauauggccaugcuggucagacacacuuuuuuauuguuguggaugucauguacucuucuuuugguagaaaaaagagacugucucugaggcaccaccuuugcuguucagcgaugaagaagagaaggaggcacaacuuggagugaagucuguggauaagaagguugagagugccaaggagucauuaaaauuugggagaacugauguggcugagucagaaaagguggacuuuuuucucuuguauacuugaaugcauuugucucucguauguuguuucaaacacacacaaccccuuaaguuuuuugaccacagaaaauaaauggcccauuuguagacagauuugaaaacauagacaagcaggcuguguccccacagugcaggaagccucugcagggccuuuccucccggcccuucuccaagacaugugcgcacuguggugugccugcuccugucucugugguuacugucacgucauggcaucuuugcuuucuaacuuguucucuucugugcaguguuccuguuacccuugguccuccuuugguccccaagugcacuugaauuuaaaugucaguuuuaaggagauuuuaguuuagcauccuuuuacuuuuagaugauauuggcaaggauuacagaguagagugaaauuucuacucuuucuaaaacacuagcuuucaaguccuggacggucugccgucucuugcaggaggccuguggguaguucugcuggccacaccugggcauccagcuuugugguugccuucagucucuauaugccucuuuucuuucucuaacuuuucuuauacgcuguguguccagcugcuuaggucuaagaucucccagggccugugugaagagcguugcauuugcauuugcugcugaggcuccuuggagcuacagugauacaagcauuucauuuguaccuguguuccugugugaaauucucuuccuaguggcuguguguggaccccaguccuaucccaguccugguccacacuugacucugacugguugcuguacugcccucucccugaguguaagccccuugcggacuaggcccaguuuguuuugcucaccaucauaucuguaguacuggcauauuaccuugcacacaguaggcacuauguuauaaacuuuguauuucuuuaaagaagcauuuuuuuaauaguuugaguacucugaaaucgggauguaccucauaaucaaugguaucuuaccugaaaugugccauuuguugaaugaauaaauacugcauuuuagaauuauuucagagauucuucuucaauugccuauacaguguaagccuuuuacaauuugagggucugauuuuccugauuagauuucccccuuggggcuuauguauuaguuaaaugcuacgaauucaugguccacucccaaugauuggcacuuguauugguuaucuuugacacuuagaaguucuuccuaguucaugagcaaccagugugcaucaggauuauagccauccuaucacuugauaggagagagggacccauggucuuaaugcuuggaaaaguuaucuuuggcuacggaugauuguacaagacugucucuuggagcagccaaucaagaauugaccucaguguuuuguuacuugggcacagaugugauucacugugcccugagucaugcaaauguggcaguuacugaauuaacgagaagcuuggcaggcuccaugauaggauuuguauuuccagguguuacuuauuuuuucccccuauuauuuucauuuucaggaaggacuuuugacuagaucugcucaggaaacagucaagcauucugauuuauuuucuucaucauccccaugggacaaaggaaccaagccuagaaccaaaacuguucuuagcuuguuugaugaggaagaggauaaaauggaagaucaaaacauuauccaggcuccacagaaagaaguaggaaagguaagcaaaaagcaauagugguucaagucucuggaugagauaaaagacucucaucucaugguugucauucugucaugugaguuucugaaggaaucuuaaccuucaauguaguguguuaaugauucugugcagucauuuagauauuugggaaucuuaaucaggaacucuuaccucaaguagcaguguuaggauaggggauuagaauuucacccccccucuucugggauuuacagaccuuguuguuccuucuagcaaaacuuugccccuuggccaguugugggauguaaacagcaggaaagggaaguuaggcuggaguuguacaguuaaguauuucuaacauucaguuuaagaaaaaguguuguagaugaaccuuucauacugaucaggugucagcaaacuauuucuauaaaggaccauauaaugacuauucuagcuuuugcagccuauuugggcucugucauaacugccuagcucugccauuggcagcaugaaaacagcccuaggaaacaugaagauggaugggcaugacuguguuccaguaaguuuuauuaauaaaaauaggugauggucagcugggcaugguggcucacaccuguaaucccagcacuuuaggaggccaagguggguggaucacaaggucaagagaucgagaccauccuggccaacauaaugaaacccuguuucuacuaaaaauacaaaaaauagcuuggcgugaugacgcuugccuguaaucccagcuacuugggaggcugaggcagaagaauugcuugaaccaggaagucagagguuguagugagccgagaucgcaccacugcacuccaguguggcaacagaacgagacuccaucucaaaaaaaaaaaaaaaaaaaaauagaugauggucauucugugagguuaguaugacccugauauuaaaacuagacagugacaucaccagaaagcuagauauccuuuaugaauguagaggccaaaauccucaacaaaaauacuacuaaacccaauucagcaaaauauaaaaaggauugcacauuaugagaagugagauuuaccccuggaaugcaagguugguucaacaucuaaaauuaguugauauaaugcacuguaucaauaaaauacagaauuaaaaggcgcaugaucaucucaacagaugcagaaaaagcuuuuaauaaaauccaaaccuuuucaugguaaagcacucaauuaggcauaggaggaagcuuaaugaacuugauaaaggacaucuaugaaaucccucagcugacaucauacuuaauggugaaagacugcaugcuuuucaacccuaacaucaugaacaacacaacaauguccacucuugguaauucuaaucaaccuuguacuggggauucuaagcaggccauguaggugagaaaaugaaauaaaaggcauucagauuggaaaggaaaaagugaaaugaagcaaucuguauuugcagauggcaugaucuuuuauauagaaagucuuaaggaaucugcaaaaaacauccauuggaaauaauuaaagucauuaagauugaaggauguaagaucaauaugugaaaaccaauuguaguucuguaagcuaguaaugaacauuuacuaacuuacaaaaguuacuacuaguaacuuucuuuuuuuuuuuuuuugcaauggaguuucacucuugucccccaggcuggauugaaauggcacaaucuuggcucacugcaaccuuugccuccuggguucaagcgauucuccugccucagccuccugaguagcugggauuauaggcacccaccaccaugcccagcuaauuuuuguauuuuuaguagagacaggguuucaccguguuggccacgcugaccuugaacucuugaccucaggugauccaccugccuuagccucccgaagugcugggauuacaggcaugagccacugcacccaaccuacuaguaguaacuuucauaagcaauuaccagcuuaugaaugaaauuaagaaaucaguuucuuuuauaguaauaccaagaaggguaaaauacuuaggaguaaauuuagcaaaagaaguacaagacuuguaaacuaaaaucuacaaaacauugaaagaaauuaaagaccuaaaauugauggaaagacaucucguguuuauggaccagaaaccuuaauauugguaagguggcaauacuuccuucccaaauugauuuauuguaaucucuaucagaauuccagcuugcuuuuugcagaaauggacaagcugauccuaaaauuuuuauggaacuguaagagaccaagaauagccaacagucuugaaaaggaagaacaaaguuagaagacucacacuuccugauuucaaaacuuacuuuaagacaggaugguauuggcauaagguuaaaauauauagaucagugaaguagaauugagagucuagaaauaaacccucacauuuacagucaguugcuuaaggugccaagauauuucaguggggacagaauagucuucagcagaugugccaggaugcugauuaucuacaugcaaagggaugaaguuggacccauuaauaaauaaacucagauccaauguaagauccaaauguaagaacuaaaacuguacaacuccuagaaucuagagaguaugugaguaaauuaucaugaccuuggauuaggcaaagccuucuuagauaagacaccaaaagcacaagugacaaaaauagcuaaauuggacuuuauuuaaaugaaaaacauugugcuucaaagggcaccaucuggaaagucaaacgaccacccacaaaaugggagaaaagauuuacagaucauguauuugauaaaggacucagauccagaauauguaaaagacuuauaagucaauaauaaaaagacaaauagcccaguugaaagaagggauaggccaggcgucguggcucaugccuguaaucccagcacuuugggagaccaggacgggaggauugcuuuaggcugggaguucaagaccagccugggcaacauagcaagauccugucucuacaaaaaauuuuaaaaauuagccaggccugguugcgugcuccuauaguucuaucuccuugggaaguugaggcagaagaguccuuugagcccaggaguucaaggcuguagugggcuaugaucacaccauugcacucaggcugagugacagaacgagacccugucugaaaaaaaauagguaagacagacaucugaauagagauuuuacugaagaagauagacaaauggccaaaaaggauauagaaagaugcucagcaucagggaagccaaaaccacagugacauaccacuucauacccgggaagaggaccauaauaaaaaaaaaaaaaaagggaaguaacgaguguugguaaggauguggauaaauggaaauucucauuccuugcugcugcaaguguggaacaguacaaccacuuuggagaacaguuugcuguucuucaaauucuuauaacauaaagcuaccacacaauccggaauuuuauuccuggguacauauccaagagaaauaaaaacauguucacacaaaacuugaauaugauugcucccagcagcauuauucguaauagccaaaagauggaaacaauggcuaaacauaauauaguauauccauacaauggaauauuauuugguaauaaaaaaggcaaaguacugauacaugcugccacauggaugaaccuugaaaacauucuaaauaaaauaagccagucaugaaagaccacauauuaugugauuccauuuauaugaaauguccagaauaggcauaucaauggagacagaaaguagauuaguaguuacugggggcugggaguagcagugagcaggaauggauaauuacugcuaaugguuugggguuucuuuugggagugaugagaauauucuaaacuuagauugugguaguggauacacagaucugaauauaccaaaaaaucauuacauuuuauacguaaauggguagauuuuaugguauaugaauuugaucucaauggugauguuaugcaaaccagguuggcaggucauagauugccaauccuuuuuauagaucuaaccaaagaaauagucuauguuuauuucuacaaaaaauguuauaugaauuuuuuuguuauaccaauacuauaagcuuauuuauaaaugagagcugcacacagugaauaugauuaauuugauauauuuucucccagucucuuacuguguaugguuuuguaauauuuuuccauaguugugaaauauuuaacauuacuugcuguguuaaacucauuuuuauauauaacaauaauaauuauuguuaaugugauuuauuuuguuagaaguaaguuuuucauuaguuuuuuugguuuuuuuguuuuguuuuguuuuguuuuguuuugagauggaguccuacuguguugcccaggcuggagugcaguggcgugaucucggcccacugcagccucugccucccagguucaaggauucucccaccucagccucccaaguagcuggaaccacaggcacacgccaccacacccggcugaucuuuguauuuuuaguagaggugggguuucaccacauuggccaggcuggucucgaacuccuggccucugguaauccacccaccuuggccucccaaagugcugggauuacaggcaugagccaccacgccuggccuuuuuguuaaguuuuaaucuguggcugugauaaggaaauagggaugaauuuuagaaugucaggucuggagcauuguauuaucaaaccaauaauguugaugguaacuuuuaaauguuagauaucuaguaaacaaaaagggacucacucggagucugaaaguagggcagaagugauggacagccauaggaaggcuuguggucgcaccugugccaggucuuuggccugcagugcuuacaggugagggacacauacuugaccacucuguguaguuugugcuugauucagcugcugucucuucuucccuuuggaaaugagaugaagagaauucauucaguuuuauguuuuuuaccuucaaaauguuucucauuauggaacuaauggauugcuuuucuaauaaaaaauuuagauacuauacaaaguuuauauaauauauauaaccuggaaagauuaucucuaaagcuugugcauauauauauauguaaacuuuguauuuauaaauauauuuucugguauuuuuggaagcgccauagcauuccauuuugucaauguuucauuccccuacugaguggcuuuuaggcuguggccagccuuuugcuaauauaauacagcugcaggggacaucuuuguuguguccaucuuuacauauguaacuuccuugagauaaguucuuacagcucuaaucacacaugaccuucccuccuguucccagggccgcgauccugaugcccaccccaagagcacaggugucuuccaggaugaagagcugcuuuucagccacaagcuccaaaaggacaaugacccagauguugaccuuuuugcuggcaccaaaaaaaccaaggucaguuccaaaugguuccccacaguaugacuuguuauuguauugggugcugucucaacagcucaccuaguucucuuuguaaauuguuuugcuuuuggauauugaacuugggucuuguuuauucuagcuguuagagccaaguguugggagccuguuuggggaugaugaagaugaugaucuuuucagcucugccaagucccagccuuugguaccagccuuuuguucucaauacuggguugugugggaaagauucugggaaaggaaacuaacguccaguuagaucauuaaggaaaauccuaggagagucgugcugcuuccuacuaaaugaauggcaaauaacaugcugaggggagcguguguggaggaugcaaugcuuaguuucuguuguuccucauuuuauguucccuauacuaacauuaaaacauuaauaauccaggcucucugacuguacugcacaucugugugauguuuaaaugguugauugaaagaccauugcauacacuggggugacuaaauauucgugccuuucaggugcaaaguuuugagucugaguuuuagccuuucuaugucauuuucucccccagccccaguagguuuuuguaaguacucuguuuucuuuuuaucauagagaggacuccugugacagccacagucuucagaaugcuauuucugaaaugcuaccuuugaguugguucagcccucauuugagaaaguauuuuuaagacucagaagccaggauuguuuuuugcauuaugauuuuuccuuaaaauuucuaagauauuugauggcuuuuugguauuuuuuuucuuuugaagguacaagagaaaaagagaguagugaaaaaagaccacucuguugacucuuucaaaaaccagaaacauccugaauccauucaagguaguaaagaaaaaggcauauggaagccggaaacaccucagguuagaaauccucuuuaaggauuuucagcucuuguuugcaucccaguacagagaaauuccauuaugcagacccacaguuauucagacuugucugcauuaaggaggaaacagcaaccagggcuaccgcuuugucuucacugcacuccccccaagucaucuccccucuccucgcuccacacgccagaguuucaugaaucuauacuuuaauaguuaguguuuuuugaugccaugccagauuuaacucugaaguggaguuaagguaggaugaagaaucuucuucccacuaaagaauuuauuucucccucuggauuuccuuggaauagaauuaaaauagaaauaaauauaaauuacaucugauuuccugccugcucucaguguugccucucccaaggucauugcuguugggccguacucugcagcagucuucccagaacgcuguggagcuccuccugggaacagcccaggacuggagagcgagugccaguuccacgugcaggugucccagggugucucacugaagccuuaguguccugagccguaaaccugaggcacuuggacgaacacaucaccacugacccuuccuggggcucagaucuuuugcuuuuagagccagugcauuaggcuaugguugaauuuuugugugcuccuugaaauuucuauuugauaaccaacaugguaauuuugccugcuggucaguuuuaggugcucugauaaacugugacucuugggaaucuuacucaucuuguauuccuugacuccauaucugaucuggcagcuuuccacuuacgugacagaggaggaggcauacgugaaguagugcuagugaaacaucaggccccaggagagauuugaaugccuuucccauuaaagagcuacagaaagugacaguuuugcuccaucacagauuuauuuacaggcauaagaaacacuugucuuucuguuucccaaauggauuuuuaacuggauguaauuuuacacaggacucaucaggucucgcuccauuuaaaaccaaagaaccauccacucggaucgggaagauacaaguaauuaaaacacuggaaucuucauugccugcccuguggcaucuauaaacuuuuuuggguuuccuacuuuugucagcugcugccaagcaucuucucaucucuucccccgccuccccuccccugcaccuaguuguugucuccugugugcugcgucuuuaacaucuauuuuuugagcccaguggugggcauagguguaagacgcucuguuuuaauucugagacuagaucgggcgauuuuccuacguuucucuacuccucucguauuauacauuaugugcaccgaaucuugucaugugucacaauaaagauaauagacugcuguguugaagaacaaauacagaguuucauuuuucuucuuuaggcaaauuuagcgaucaacccagcggccuugcugcccacagcggcuucccagaucucugaaguaaagccuguuuugccagaauuggcuuuuccuucaucugaacacagaaggagccacggucuggaaagugugccuguccuucccgggaguggggaggccggugugaguuuugaucuuccagcucaggcagacaccuuacacagugcaaacaaggugaugaaaccaucuuugcuuccuugcucucuucuuuuaaccagaacaugcauaugcuucuuucuaguuuaucaguugcauacacagcagucuuugacucuccuuuugaaggaggugccucauccuuccuucagccacuccccacuccauucuccccaccccccucauccugcaccugcuuuuccguggccugcauuugguacauuugcauucugcucaguagccacaguaacgucucaccacuuuggcuggugucugacaccugcagguuuccagcacugccaccugggggucuucuaaccacagagcagaucaugccccuccugcuggcgcuuccucacuacuccaaggagagcauucgggcuccuggguuugguaugaaaccccuuugcaaucggugccagcccaugugugcagcuuccucacuagucacuucacacuuuccagccugacuccaggcacaccaggugccacucccugaacacacauggucuguucugcugcugcccaaggcuccugcugccuccucaccaggaaugcuccucucuguccacagcugugcuuccacauccccacuucugugacugugcccugcacuccccgcaccaaguucccacagcagcgacacuguuucaugggaucuccucaauggacugugaacccuuugaaguuuuccuuucauuguaguuggguuucuuguuucuauccagucucccuucucuagaaagcuuuagcugauuuccaaguaagcgacaggacacagaaugaccuaccccggcaaauagauucauuucaaauguuuccaaaccuguuuccuugugcaaaacaaaaccgccuuccuuuuaaagagaauuuucauuggcuuuuuuuuaguuaaguuuaaauuggcaacuaaaauugugacauuccccugaaguugacaacacaaucauacuuugcccaaaguagauuguagcuucucaaaauucuacuugauuguauauuuuggaaacuaucauaaauacugcaucauugcuacuaagugauucauguuuugagauuauaugaaaaguucugauuucuaagccauauuucuuauguggaauauuuaacguuugaauucaauguuuauugacuugaagaaaacagcaccuuagauuaccucucuuuauugugucauguuucuccccgcuccuggagccugaauuuagacuagcccccuaacaaagguuaguaccagaauuccccgauucuuucuuguuuugaaagauacccacguuucuauugaggguagaguaggggccaagggagggguugugagacagagagccaacauaccuacuuuccagguuuccagcaacagauaaaacuuuuugugugaaacugaacugaaacugcccugagaagauuaaaaaauggagaacucuaaaggauuaagaaugacuuagucuuggaguacuaggagcuauuaaacuccuuccuuggaaaucauuaagaaauaaccucuucuauguucuuagauaauaucuucauugaaguagaccagauaaccuuacaauauuuugagucacugauucuuugccaugguagcuuugaacacuuuauuuuaucgucagaucaauguguguuuuuuugccauugcagagccgugucaagaugagagggaagcguagaccgcagacccgugcagcuaggcggcuggcugcucaggaguccagcgagacugaggacaugagcguccccagaggacccauugcacagugggcugauggcgccauuuccccaaauggccaucggccacagcucagagcagccaguggagaagacagcacugaggaggcccuggcagcugccgcugcaccuugggaaggugguccugugccuggaguggacagaagccccuuugcaaagucucugggucauuccagaggggaggcugaccuuuuugauucuggggacaucuuuuccacgggcacuggaucucagucuguggagagaacaaaacccaaggcaaagauagcagagaauccugccaacccaccagugggugguaaagcaaagagccccauguuuccugcucuaggugaggccagcagugaugaugaucucuuucagucugcuaaaccaaaaccagcaaagaaaacaaaucccuuuccucuccuggaagaugaggaugaccucuuuacagaucagaaagucaagaagaaugagacaaaauccaauagucagcaggaugucauauuaacaacacaagauauuuuugagguaauaggacuuaacacguuuuugugucuguucuaaguuaaggaagguaucugauuggcuuauuugagccauagauuaugucuagcuuguugcgugcauaccccauagccacuugcuuaguaauuauaauuaggcucuuuuauuaauaaguuuaacauugauucagaagugguuuuuuguuuuguugcauguagauuguauuucuuggcuggccaugaucauugauacuggucuugguuucucuaguuuuuacaguuuuuuuauuuuuauagaauauuguaaucagcuuccugggcaugccacucggugacauggcauacagcuccacugguccagcuugggaguuuaaccucugguucuggggacauuggcccuggcuggagcugacaauguagugcaugcaggcaauaagacuuucaguggcauuugcucagcagauguuuauugagcaccuggggacugcaggcacgaggugaacucagagaagugcuaggcuccucagagcucucugggaagauaaucaaauacaaacagggcaauggauaauuaagauguuuucaaauaguacuaagugucaugaagaaaauaaccuggggcagagugguggguagggcugggaggugcuccuuuaggcaggacugguagagaaggugucacugcagugccggcauuugagccggggugagaugggcgggccaagcugugcagagaucugggguagugcaucccaggcagagugggcagucucgaggcuguuccacacacccuggccaauuguauuuccauagcucguuguuguguuugagcuuaaaaagaaaaauugauuuaacauuauuuuguauguauuuuuggcuuaacaaggaugauauauuugcuacggaagcaauuaaacccucucagaaaaccagagagaaggagaaaacauuggaaucuaauuuauuugaugauaacauugauaucuuugcugacuuaacuguaaaaccaaaagaaaaguccaaaaagaaaguggaagccaagucuauauuugaugaugauauggguaaguuugguuuucuacaucugaccuagagaauucuuaccuuucugucacuugguauuuuucuugcuaccuuuucuuggcccuuuucuggaaaaugcaccccagcggguucacuucaguguaauccugaguuaggcugaagauagguaagagauggacuaauuauuuuagugaaguaacucuuuccuaugauagucaucaaagaauuugaaggcacccagaguuugacguuuaaguauaauuuaacuuugaucucagugcaccucaccaaucaucugugacacaccccgguguuaugaaaggagguuugaucagaaaugaccucacgugcuaaaguaggcugaggggacugccuugggugugaugugguugguugagucagagcuccagauagacagggaguguccaugguucugugcgagaagagagcaagucuagaccuggguguaggcucuaccucaggcguugcauuucacugaggucuuugguguuugggaacaagcuugucuuccuuauauggcacaacuucugcuuuauuaguagacaaggcaaaugcccgagaacccuaaauauuggacuuuugauaaauccugugggcugaggccacauacacauuuccuacucuccccaucaaucuagaccuugagacuaacugggagacagcuggugcugcagagucacacacuggcucugugccuccagcaagccgugugcucugucuccccugcuucccgccacauggagugcagaagggaacucauucauuauuuuaaauacaaaaaaaguaauacaugcuuauuguaauagauucaugcaauucagaaaauguaagaagugaauaaccccuagagguaauaguaacaguuugguguguauccuuucagacacagugauauuaauauauguuuguguacacaucaauauauacccaccuuuuuaaaaaguaagaauauauuuaccuauucugcucugucuuuuaguuacuuaaugucuuuucaugucaguacauagagaucuccuuccuuguuuucaguggugugcacgauuucuuuguauuuagccauuagccuguugacggcaaucucaguuguuucuguuuucuuuauuacaaauaaugcuguggucuuuaccauuuguguacaccuaacuuuauguauacauguuaaaucaugguuggauaaaacccuagcaguaacauuacuggguaaguaccauaauuagauaagacaagcuuuugagucagugaaacacuaaaagaaugcagugacggaggcuuacagucuuacaucgagaugccucaaaucagugcauuuauucugaaagaaaacagguggguccuauguuggauuucccuuugcguauuuuuauugcucuuuuaaaacccaguaugaaaagaauaucuaaauaaguccauugucccugaugguaggggcgugggcugguuuggagaucaaguuacgcuucccuuuuuucuguccuacacacgcacauacauacacuuuuguagcugaagaaauugugcuccaagagaaaccugugugugaucauaaaauuuaaugaguaacaaacacagaaccagaaucuaagaggcuugaguucuagguuaguguuuuaggguacuccaugcuguuaccagagcugggucuuuggugguuugcuugcaugugucuuaaaaguaccuuucuccaccccucuucagcaaccguucuucuuuuuucuuucuaaagaugacaucuucuccucugguauccaggcuaagacaaccaaaccaaaaagccgaucugcacaggccgcaccugaaccaagauuugaacacaagguguccaacaucuuugaugauccccugaaugccuuuggaggccaguagagcacacaggguauccacauguuacccugcagcuacauuguugaguuagugaugauguuguauaugcugauggucuuaacuggauuacaaaaagcaaauacuagaacagcuagcucaucguucacccaauguacuugguauuuuucugcacugguuuaaucaugcuuaauacuacaaaacaaaaauaaauauuucacagugguugguuuguuuuguuuuuaaaccacaguuugauuuaguuagccuugcuggggccauaauaugcuucaggguguguaaaagaagaaaucucuuuguggcuuucaugggcagggaaucccagagauagcaaaugccaccugaccagaagucuuuguuauauggaugggaacccuaacuuagggccugggcaggggaaagagaaagaaggugagagauuauacuucaugagucuuagcaauaugggagcagguuuucacugaauucugagggugccucugcauguccuccaaggcaaaguuuggcaaacuguggcccccccacugucauauuuuguuaauaaaauuuuauuggaacacaaccaca

SEQ ID NO: 191679 - RNA, 4846 nt, Homo sapiens
gcggccgccaaggaaaugagcaggccuggccggcccgggccccgagggaggccagccgcgagcggagaggucggcgguccgcagagcagggucccguggaccggagagcgggaugccgagguucaggacgcagggcgggcccggugcccggggcccggggccugaggcgggagggcagcgucugcggagaggagcagggcccauggcgucggggcgugggagggggaggccgcggcaggcucacccggccuccgugcgggcuucagcgagugcgggaagccggugccggccuuccggggugggaggagaggcagccccugcgggggagaguaggaagccaggcagcgugugggaaaccacgcuacccacaagcuccuaaaccugaaacuggccccaggacauuuuccagaccgccaaguguaccccucuucucauccgcccuccagaggacgccggauuuuagaucuuaagucugguggucucgucugauacuccucuuguuugguucuuuccuucucauuguccuaccugauaggacaguguuaguaaccuguuuaauaaguggggaagcagagucagggcugcuggguuacucgcccaagaucauauccugggggagccacggcaagaagccaagacucacggacuacuucuaagcuuuuuccaaaggauauaguagccuuucuaauaggaaaaucaauguuuuuaauuauaaagccacuuuuacaaaaucuuggggaaacugcuuccucagaccugugaucuagggagaaaaauaugacaauuucucccuuacuaaucacggaggucccugauaggcggcggaguuguaacuugaagaccucacagcagguggagaggcagagcugugaauucuacucuaauuucuggaauccccggcgacagaguccaaccccaggcagcaggcgccauguaccccagggacuuuuaaugugugugcagcuguugagcaagaauaccuugaacuuccaaaugaugugcuggcaugcugguagggaauuccuuugcagcuuguguuccaaguuggaagugaguccuccaaauaaaaauuuaaaugauucuccuggucaucacagcauguagcagaaugugcaguugucaagaagaaccaggugcuuagguugacaaaacaaagaaugguagcaucauacuauuauuucauuaaaucagaaggccagcauuuugauaggacaaauuagagggaaacaaggaguaugcauugaaccacugcauuucuuaaaaguauaagaauucaguaauuaggauccugaaguaagaagaaauauuuuuuuuaaaaaauagaucaugugggccagguguaguagcucaugccuacaugucuugggaggccgaggcaggagggucacuucaggccaagaguuggagaccagccugggcaggauaaugagacccgaucucuacaaaaaaaaguuaaaauaauuuuuaaaaauuagccaggcuugguggugcuuaccuguaguccuaguuauuugggaggcugaagugggaggauccguugaguccaggaguucaaagucacagcaagcuguaauugagucacuguacuccagccugggcaacagagcaaaaucuugacucagaauuuuaaaaaaauuaaaaaauaauuuagagcacauacaagaggauuccuaggaucugaaagagcacuucaaucuggucaaacucucuuccuuucuguucaauuuuauaagcauucugaccagcucuuuagugauuaggaacuagacaacugucuaauguaagagcauacauuuuggauccagaaagucuuggauuugaaccuuugcuccacuuugacuccuuauuuucuguggguuucugggcaaguuacuuaaccuaguuggagugccuugggcuuggaguccagaguaggucuuucuuuuccaagaauugacaaguguuuacacuuggucagaacugguauucuuguaucuucaagagcaagagaaaggcgagucugggucuggagccuccuaagaauuguucagugguaacaaauggacucucuuguuaagucuuuguaacuacagauaacuggagagcugauuggcuccaaccaaucaugaaggcugaaauguuguuuucuuagauucugaauuccucuggggcuuggagggaagaaaguaguaggugguuagguggggaaccaaaauggaagaucccaauuacaugccaagaccaaaguguaaacaggagugacuauuaacuugggauuggcaggaagagauauauguuuauguguucucugcuuucccacauccugcuuccuccuagacucauuugugugugguccugguaccuuugggcccauuuugcagugauauuuuaguaacugacauuaugucaaacaaucuagguuucuuacauucacuuaugucucaacaacuguugacuuuuuccuucucacauaucaauuauucugcccuuuccuguuuguuucuguuuguuuuucucccucaggugcucaggaacagcccauggaagaaucauaugaagagguggugacugaggucguaagcaggaguggacauguuuggauuuccaacagcuacccugcuggacugucauggaagauaugcccagaauguagcguucuucagugagugagucaguugauggcuggaugcgcucagcucacagauauucagugucccuguucucagcacuggucggcagucugaggaagcagaggagaccuugcuuugguagagcuugcuguuccuaggguuauaagaaaagccugugagcuggaguuagaaguaauaguagaaacagagcaagagaaccaucuugauauggagguagcguugaaguagucucugagaaugaaugagcagcuuaaaucucagcacugucucugaauaaggcaagggaacaaggagaagauuacccuggagugacagacaccaagaaaacuguuaauggugaugaauggacccauauuuaaagugcaccaggaggcucagaugcagggcaguauucggaaaaaaaaaagucaauaucugcauagagaauaacuuccaaaccaaaauugauuucaguuuugccauagcuuaguagacugaaaauagcaaggauuuuaaugggaaaaauuccuuggaucagauucuauaauugccauggcuagaucugcaguaucagacagguuauuuaacuuccuuaagcuccagguucgucuguaaaauaggacaauaaguucuaucuuguaggguugcagggauuagcaaugauagauguaaaguacccaggauugugcuacauauuuucugaggucauggugcuuauucuauugucagaacagauuggacagagguggauuucugaagaagcaaaugcagcuucaguuuuaggaccccucacuuggauuggucucuccaagacccugugcuuaauuuuauacauuuucuuaaaagggugccucuaaaaugggaaaguuuuaggccuuauauagccuggauccacaccuguuuuggagucagauaaaaguuggguauggggcucugugugauucuguauaguuuucuaaauuuucugagccuguuuucugaccuguaaaauagagaaaaccaugucuaucuuacaagguuauuuguuggccuaaauuaaauuuagaggcaguacacugcuauggagaaugccuauuugagucagcucuaacuuaccuagcucugugaccuuugacaggcucccuuugcucccauuaucuguaucacucucauggcauuguuuucaggauugcauugucuaugcaaagaauaaggccuggcacaucauaagcacucaaaguauuauguuucuuuuucccuauucuaacucagcauuauuggugcuucuuauaugacuucccucucauuuuaucagaugugaugacugaagcccaccacaaauaugaccacucugaggcuacaggauccucaagcugggauauccaaaauucuuucagaagagagaagcuggaacaaaaauccccagauucgaagacacuacaggaagauucaccuggagugagacaaagggucuaugagugccaggaguguggaaaauccuuccggcaaaaagguagucuaacguuacaugagagaauccacacuggucaaaagccuuuugagugcacccacuguggaaaaagcuucagggccaaaggcaaucuuguuacacaucaacggauacacacgggagagaagccuuaucagugcaaggagugugggaaaagcuucagucaacgagguagucucgcuguccacgagagacuccacacuggacagaaacccuacgagugugcuauuugucagagaagcuucaggaaucagaguaaccuugcuguucacaggagaguucacaguggugagaagcccuauagaugugaucaguguggaaaagccuucagucagaaaggaagcuuaauuguucacaucagaguccacacaggccugaagcccuaugccuguacccagugcaggaagaguuuccacaccagggggaauuguauucugcauggcaaaauccacacaggagagacacccuaucugugcggccaguguggaaaaagcuucacccagagagggagucuggcugugcaccagcgaagcugcucacagaggcucacccuuugaccacuuuccugaagagaaguucucuuuaugaauuaagaguacaaaauccucugagaugaagcaaccuauccaguucuauggaaugaauggagaaucuuucagaaagaccaucauuggguagggcaaacugauuuuuuuccuuucccccaaaagaguaugaaaaauaaaugucuuguuuauuaucauuauca

SEQ ID NO: 191680 - RNA, 4846 nt, Homo sapiens
ugauaaugauaauaaacaagacauuuauuuuucauacucuuuugggggaaaggaaaaaaaucaguuugcccuacccaaugauggucuuucugaaagauucuccauucauuccauagaacuggauagguugcuucaucucagaggauuuuguacucuuaauucauaaagagaacuucucuucaggaaaguggucaaagggugagccucugugagcagcuucgcuggugcacagccagacucccucucugggugaagcuuuuuccacacuggccgcacagauagggugucucuccuguguggauuuugccaugcagaauacaauucccccugguguggaaacucuuccugcacuggguacaggcauagggcuucaggccuguguggacucugaugugaacaauuaagcuuccuuucugacugaaggcuuuuccacacugaucacaucuauagggcuucucaccacugugaacucuccugugaacagcaagguuacucugauuccugaagcuucucugacaaauagcacacucguaggguuucuguccaguguggagucucucguggacagcgagacuaccucguugacugaagcuuuucccacacuccuugcacugauaaggcuucucucccguguguauccguugauguguaacaagauugccuuuggcccugaagcuuuuuccacagugggugcacucaaaaggcuuuugaccaguguggauucucucauguaacguuagacuaccuuuuugccggaaggauuuuccacacuccuggcacucauagacccuuugucucacuccaggugaaucuuccuguagugucuucgaaucuggggauuuuuguuccagcuucucucuucugaaagaauuuuggauaucccagcuugaggauccuguagccucagaguggucauauuuguggugggcuucagucaucacaucugauaaaaugagagggaagucauauaagaagcaccaauaaugcugaguuagaauagggaaaaagaaacauaauacuuugagugcuuaugaugugccaggccuuauucuuugcauagacaaugcaauccugaaaacaaugccaugagagugauacagauaaugggagcaaagggagccugucaaaggucacagagcuagguaaguuagagcugacucaaauaggcauucuccauagcaguguacugccucuaaauuuaauuuaggccaacaaauaaccuuguaagauagacaugguuuucucuauuuuacaggucagaaaacaggcucagaaaauuuagaaaacuauacagaaucacacagagccccauacccaacuuuuaucugacuccaaaacagguguggauccaggcuauauaaggccuaaaacuuucccauuuuagaggcacccuuuuaagaaaauguauaaaauuaagcacagggucuuggagagaccaauccaagugagggguccuaaaacugaagcugcauuugcuucuucagaaauccaccucuguccaaucuguucugacaauagaauaagcaccaugaccucagaaaauauguagcacaauccuggguacuuuacaucuaucauugcuaaucccugcaacccuacaagauagaacuuauuguccuauuuuacagacgaaccuggagcuuaaggaaguuaaauaaccugucugauacugcagaucuagccauggcaauuauagaaucugauccaaggaauuuuucccauuaaaauccuugcuauuuucagucuacuaagcuauggcaaaacugaaaucaauuuugguuuggaaguuauucucuaugcagauauugacuuuuuuuuuuccgaauacugcccugcaucugagccuccuggugcacuuuaaauauggguccauucaucaccauuaacaguuuucuuggugucugucacuccaggguaaucuucuccuuguucccuugccuuauucagagacagugcugagauuuaagcugcucauucauucucagagacuacuucaacgcuaccuccauaucaagaugguucucuugcucuguuucuacuauuacuucuaacuccagcucacaggcuuuucuuauaacccuaggaacagcaagcucuaccaaagcaaggucuccucugcuuccucagacugccgaccagugcugagaacagggacacugaauaucugugagcugagcgcauccagccaucaacugacucacucacugaagaacgcuacauucugggcauaucuuccaugacaguccagcaggguagcuguuggaaauccaaacauguccacuccugcuuacgaccucagucaccaccucuucauaugauucuuccaugggcuguuccugagcaccugagggagaaaaacaaacagaaacaaacaggaaagggcagaauaauugauaugugagaaggaaaaagucaacaguuguugagacauaagugaauguaagaaaccuagauuguuugacauaaugucaguuacuaaaauaucacugcaaaaugggcccaaagguaccaggaccacacacaaaugagucuaggaggaagcaggaugugggaaagcagagaacacauaaacauauaucucuuccugccaaucccaaguuaauagucacuccuguuuacacuuuggucuuggcauguaauugggaucuuccauuuugguuccccaccuaaccaccuacuacuuucuucccuccaagccccagaggaauucagaaucuaagaaaacaacauuucagccuucaugauugguuggagccaaucagcucuccaguuaucuguaguuacaaagacuuaacaagagaguccauuuguuaccacugaacaauucuuaggaggcuccagacccagacucgccuuucucuugcucuugaagauacaagaauaccaguucugaccaaguguaaacacuugucaauucuuggaaaagaaagaccuacucuggacuccaagcccaaggcacuccaacuagguuaaguaacuugcccagaaacccacagaaaauaaggagucaaaguggagcaaagguucaaauccaagacuuucuggauccaaaauguaugcucuuacauuagacaguugucuaguuccuaaucacuaaagagcuggucagaaugcuuauaaaauugaacagaaaggaagagaguuugaccagauugaagugcucuuucagauccuaggaauccucuuguaugugcucuaaauuauuuuuuaauuuuuuuaaaauucugagucaagauuuugcucuguugcccaggcuggaguacagugacucaauuacagcuugcugugacuuugaacuccuggacucaacggauccucccacuucagccucccaaauaacuaggacuacagguaagcaccaccaagccuggcuaauuuuuaaaaauuauuuuaacuuuuuuuuguagagaucgggucucauuauccugcccaggcuggucuccaacucuuggccugaagugacccuccugccucggccucccaagacauguaggcaugagcuacuacaccuggcccacaugaucuauuuuuuaaaaaaaauauuucuucuuacuucaggauccuaauuacugaauucuuauacuuuuaagaaaugcagugguucaaugcauacuccuuguuucccucuaauuuguccuaucaaaaugcuggccuucugauuuaaugaaauaauaguaugaugcuaccauucuuuguuuugucaaccuaagcaccugguucuucuugacaacugcacauucugcuacaugcugugaugaccaggagaaucauuuaaauuuuuauuuggaggacucacuuccaacuuggaacacaagcugcaaaggaauucccuaccagcaugccagcacaucauuuggaaguucaagguauucuugcucaacagcugcacacacauuaaaagucccugggguacauggcgccugcugccugggguuggacucugucgccggggauuccagaaauuagaguagaauucacagcucugccucuccaccugcugugaggucuucaaguuacaacuccgccgccuaucagggaccuccgugauuaguaagggagaaauugucauauuuuucucccuagaucacaggucugaggaagcaguuuccccaagauuuuguaaaaguggcuuuauaauuaaaaacauugauuuuccuauuagaaaggcuacuauauccuuuggaaaaagcuuagaaguaguccgugagucuuggcuucuugccguggcucccccaggauaugaucuugggcgaguaacccagcagcccugacucugcuuccccacuuauuaaacagguuacuaacacuguccuaucagguaggacaaugagaaggaaagaaccaaacaagaggaguaucagacgagaccaccagacuuaagaucuaaaauccggcguccucuggagggcggaugagaagagggguacacuuggcggucuggaaaauguccuggggccaguuucagguuuaggagcuuguggguagcgugguuucccacacgcugccuggcuuccuacucucccccgcaggggcugccucuccucccaccccggaaggccggcaccggcuucccgcacucgcugaagcccgcacggaggccgggugagccugccgcggccucccccucccacgccccgacgccaugggcccugcuccucuccgcagacgcugcccucccgccucaggccccgggccccgggcaccgggcccgcccugcguccugaaccucggcaucccgcucuccgguccacgggacccugcucugcggaccgccgaccucuccgcucgcggcuggccucccucggggcccgggccggccaggccugcucauuuccuuggcggccgc

SEQ ID NO: 191681 - RNA, 96383 nt, Homo sapiens
acuugugucuagcgggaucgcuugcuugguaacccggagggagagauuggaaaccgcggaguuuccuuugggaggcugcggccagccggggcugacuuguuauguugggcuccggaggccguuaagagccgagagagacaugaggugucucugaagcccggucgccugggccaugaagaagauuuuuaguaagaagggcgagucgcccuugggcuccuucgcgcggcggcagaggagcagcgcgggaggcgggggcgagccgggggagggcgccuacucgcagcccggcuaccacguccgagaccgagaucucggcaagauccacaaagcugccagcgcggguaauguggcgaaagugcagcagauccuuuugcucaggaagaauggcuugaacgauagagacaagaugaacagguaauaggcgucgcaagcccggacugagugccacuggaguaggcgggcaggaagaggggccccuuuugugggagccacccagggccuggaucagccucccgcgggcuccguagccccugggacggugacaccuugcagggcuccagcgcccaggccgccuuucugagcagaaaaacaaaaacagaacucuagcugguuuccgauccccccgaaaucccuuagagagcacuuaagugacaauuuuaaagugaauuaacgaacaaaagcacguacagcguuuuauuuuuaauguacacauuuaagauacaaugucauacacuuauggaaaggugcauaaugagauaagcaguuuccauaauauagcaacuucuggguuaaaaauuauuucuauaaaaucuguuauucgucaggcgcgguggcucgcgccuguaaucacagcacuucgggaggcugaggcgggaggauugcuugaggccaggaguucaaggccagccugggcauuauagcgagacccccccccccaacucuaauagucucagcuacuuggaaggcugaggcaggagcaucacuugagcccaggaguucuaggcugcagugagguaugucagugacaacagagcaagacccuaucuuucaaaaagaaaaagaaauaaaaugccuuuaggaaauagauauacaaguaauuuguuuuucucagcauugcuuaagcaguguauuaaggagaacccauagaauggauuuugugaauaaaugucagugcaugauaauaugugaccauugaaaguggcaguagaggccaggcgugguggcucgcgccuguaaacccagcauuuuaggagaccaaggcaagcggauauccugaggucagaaguucgagaccagcuuggccaacauggugaaaccccgucucuacuaaaaauacaaaaauuagcuaggcaugguggugggagccuguaaucucagcuacuccgaagacugaggcaggagaaucgcuugaaccugggaggcagagguugcagugagccaagaucgugccauugcacuccagccugggcaacaagagcaaaacucugucucaaaaaaaagaaagaaagaaaagaaaguggcaauagauacagaaguguauuggcaugugaggauauacuuugguaucucaagugagaaaaaaaguuugauuauacauacagacuguggucuuguguuagcugaaaauauguacaaaacgugguaaaauuuggccaggcgcggugucucacgccuguaaucccagcacuucgggaggccgaggcgggcggaucacgaggucaggagaucgagaccauccuggcuaacacagugaaaccccguuucuacuaaaaauacaaaaaaaucagccgggcaugguggcgggcgccuguagucccagcuacuccggaggcugaggcaggagaauggcgugaacccgggaggcggagcuugcagugagcggagaucacgccacugcacuccagccugggcgacagagcaagacuccgucucaaaaaaaaaaaaaagugguaaaauuuguuauuucugggcauuuguauaauaagucaaacuuuuuucuuuaugauuucugcaaugaguauguauaaaaguucuagugaaaauuuauuauuaaugaaguaauccuugggaagagaggaauaugaaucuugcacagauaaaaaucauuucccacuuucuuuuuuuucuuuuuuugguggauugcuaucgucugacaacuuuuauccuuuucagaaguaaaggggaucuuggcugggcaccuguggcucaugacuguaaucccagcacuuugggaggcccaggcaggaggauugcuugacccaggaguucgaaacuagccugggcaacauagcaagacccugucucuauuaaaaaugaaagguaaagcagaucuuuguucuugccaccaaaaauuaagaagauaaaaaauaaaaauaaaaaaagaaaaaguaaaggguaucuuuuuaucuguauuuauagauuuuauguauacauuuuaucauauacauguuuuuauuauagauuuauuauauaugcaaacagguacaaucauuuuauuuuaguuguguccuuaugacaauaaaaauaccaaauauaaaugauaauuaggcuggaugcaauggcuuaggccuguaaucccagcacuuugggaggcugaggaggguggaucacuuaaguccaggaauucaagaccauccuggccaacguagugaaacccuucuguaguaaaaauacaaauauuagccagguguggugguacacaccuguagucucagguacuugggagacugaggcaggcaguagaauagcgugcaccugggaggcggaggguacagugagcugagauugcaccacugcaauccacccugggugacagagcgagacuccaucucaaaaaaacaaaacaaaacaaaacaaaaaaaagauaaauauuauugcaaaagaauaaaagaauuacucuacuuuauaagaauuuuauuuaaaaauauugaacucccuaaugauuuuuccauucuuucaauccauuuauucaucaaucauaaccugaauaccuguuauguagcagacauagucuacuaucucuuuuuucuuuuuuucuuagacagagucucccucuguugcccaggcuggagugcaguggccagaucucagcuuuacugcaaccucugcuuccuggguucaagcgauucuccugccucagucuccugaguagcugggacagcuaauuuuuuuuuuuuuuuguauuucuaguagagacaggguuucacuguguuagccaggguggucucgaucuccugaccuugugaucugcccaccucggccucccaaagugcugagauuacaggcuugagccaccgcgccuggccuuuuuuguuuuugaggugaagucucgcuucuucgcccaggcuggagugcaauggugugaucucggcucaaugcaacauccaucuccuggguucaagcaauucuccugccucagccucccuaguagcugagauuccaggcacgugccaccaugccuggcuaauuuuuguauuuuuaguauagaugggguucuacccuguuggccaggcuggucucaaacuccuaaccucaagugaucugccugccuuggccucccaaaguguugggauuacaggcgugaaccaccgcuaguuauaagcauauuaauguaagugcguaguauuuuaauaaaaugugguagaauauagacuugaucuuugaauuggaaacauaacaguaguggacaugaagauuugcagagcugauuuuuuuuucuuuuuuuuuuuuuuuugagauggagucucgcucugucuccugggcuggagugaguuggcaugaucuuggcucacuguaaccuucuccucccagguucaagcaauucucgugccucagccucccaaacagcugggauuccaggcacccaccaccaugccuggcuauuuuuuuuguauuuuuaguagagacgggguuucaccacguuggccaaguuggucucaaacuccugaccucaggugaucugccugccucagccucccaaagugcugggauuacaggcaugagccacugcaccaggccagaguugauaucuuugaagugaggauuuuacuucuaugcaaauucuuuucugucagaggugaaucccuauuuuagucaugaauaugauauuuauuccccuuucacaacaggaacuucauauauauguauauaagugcugugugguguucuaaacuauuucagucuugcauuagcauuguaauacauaauguagcuaaucugcuaugaauuugggaaugcauuuuaugacaaauuuacagagcugucagggaagauggaaaguugcugauuucucauauaaaacugucuucauagagcuugaugugaaucuccugcacuucuggaagcagguauuuaacucauccccaggaaaucaagccugagagaaguucuggugagcugcuuggcuccuguguugagacuggucuggucucuuagcauuuguuuuggcaaagaauguuuggauguuuauagaggacagaugagagcucuggucaaguaugagagcuguuggugggagggagaauccauuugggaucccauaugaaaaguccuguuaagggugugagcaggccuuagaagaggguaauccaaaguggaucuguggauuccuuaggagcuaagaggaaagaaaggccagaguggagugcauucauucaggucaaggcaauugcaggugaaaacauagucuacuaucucucaggaccuuuccaucuucaaaaccuuuauguuugcauaccugcccagccugagcaaguugagagauuuaaaauuagacuauuagggcaaucucaauugaagcuuuuccucccuccucuuauuuauuuauuuuuuugagaggagauuaugcucugacacccaggcuggaguaaaguggcaugaucucggcuuacuccaacucugccaccaggguucaagugauucuccugccucagcccccucgaguagcugggauuacaggcauguaccaccauguccggcuacuuuuuguauuuuuagcagagaugggguuuuaccauguuggucaggcugaucuugaauuccugaccucaagugaucugccugccuuggcuucccaaaguguugggauuacaggcgugagccacugcacccaaccccucuuuauaaacaaaaguguuucugaagguagaaaauuauaagaaauaaccuuuaauuacccuuuugaaaauuuaugucuuaaacacgaauauuagucauuggaaauaucugcauauauucuauaaaucuaaauauugaauaaaaugagccaaccuauucauuugaauccugaguuucuuuuguguugaaguuucuugaaaacacaauaagaauuacuuuguuuuaaaaaucuguuuuucaauuuuaaaaaugcuuccaauuauaguuguaauaaaucaugaauuacaaguggcauuccaaugucagagauauugaaaugugagaaaaugagcaucuuagaaucacugaaauacuguguuaucucuaauuuuuuuuuuuuuuuuguagacagggucucucucuguugcccaggcuagaguacaguggcacaaucacagcucacuacagccucaaccuccugggcucaagcgauucuuuggccuuagccuccugaguagcugggaccacagguguucaccaccaugccuggcuacuuuuuaaauuuuuauagagauggagucucacuauguugcccaggcuggucucaaacucuuggacucaagcagucauccuaccucagcuucccaaaguucugggauucaggcaugagccgccaugccuggccuuaucgcugaucuuuaaaacauacugucaacuagguauaauuguaucauuucauuuaauuaaaacaucuuuauuaaacaguaguaaugguaauuauaucuaacaauuauugagcuguuauuugugcuaggaacuguucuaaacauuuugcauagauucucauguaagcaucccagugguguccuaugagauagcuacuauuuugauccccauuuuauugaugaggaaacugaggcacuuacuaagccauaaugaguaagugacagcuuaaaguaggauucaaccccaaguugaacugaaucuaaaggucaagccuuuucuauucagauagguugcucuuucauuaauguggugaguaguaagagcuaauaaauauuguacuguuuucagaagaaaauuaaauacuuguuuugaaggcggaggauuaacauguguauuagucuguucucaugcugcuaauaaagacauacccuuuauuauauggguaauuuauaaaggaaagagguuuaauuaacucacaguucagccugguuggggaggccucaggaaacuuaacaauaagggcagaaggagaagcaaacauguccuugacauggugucagcaaggagaagugccaagcaaaagagggaaaagccccuuaagaaaccaucagauauugugagaacucacuaucacaagagcagcagcacgggggaaccauccucgugauucaguuaccucccacugagucccccucaccacacguagggaucaugggaacuacaauuugggauuugguuggggacacagccaagaugagauuuggguggggacacagccaaaccauaucaacaugcuauuuaauguuuauaauuuuaugaaccauuguauguuuugagacagugcacuacaguuuauaaaaaguccugucacucucauaggacggcucuacauuuggccugugccaauggucauccagaaguaguaacucuccugguggacagaaaaugccagcucaaugucugugacaacgaaaacaggacagcucugaugaagguauauaguagccagcucuuucagcaucagauggauuugacuuaaauacauagaaugaaaaugaauuuaucucauuaaaauauaacuaauuggugaaaccuguggaguguuuauuuugcauuccuagaauuuaugaucuguuucuuggucuaauacucccaggcuguacaaugccaggaagagaaaugugcaacuauucugcuagaacauggugcugauccaaaucuugcggauguccauggcaacacugcucuucacuaugcugucuauaaugaggacauaucaguagcaacaaagcugcuuuuguaugaugcaaauauugaagcaaaaaacaagguauagaucaaccaacuuuauuuuuacaguauuugaaaugcguuuguuucaacagugacauauguaaggguuaguuuucuguauuuggaagcgcaagcauucccugacugaaaguauuuuaaaauaacuuaauugucuaagauuuuacuuuaaauguugauacuuuuaaagaagcauuaggcaguacaccuuucuuuuaugcauuuauuguaaauacuugugaaaacacaauuuguuaaaggcaaaucuuuuuuuuuuuugagacagagucuugcucugucucccagucuaaagugcagaggcgcgaucucggcucacugcaaccucugccucugccucccggguucaagcaauucuccugccucagccuccugaguagcugggauuacagguacccaccaccaugcccagcuaauuuuuguauuuuuaguagagaugggguuuugccauguuggccaggcgggccucgaacuccugaccucaggugauccacccgccucagccucucaaagugcugauauuacaggugggagccacugugcucagccuagaagcucuugguuuugaugggaaacaauacaaugaauacaauaugccaugccaaaugaugugauagaagcaaauauucuuagaaccgguaaaaauuugaagugaguuuuggagaugaguggaguucauguggugaggcagaggagggguguuuccaagggaagcaaguguuuuuuauuuguuuucuauuuuauauguuucaguucaaaggaucugacauagaguuuucaguucagccgagaauuauguaauuuuaugcauuuuaacuuguuuuugcugucuuacaggaugaccucacaccacuuuuacuugcaguaaguggaaaaaagcagcaaaugguggaauuuuuaauaaagaaaaaagcaaauguaaaugcaguagauaaguuggaaagguacaguagcugguuuuguuuuggauuuuuaaacuuguauguuuaaaaguuuuuuuagaucuguguuuugcauguuacagguuuuuuaaaccugcuuguucuugaggggcaacagugauucguugguguuucucacucaagucagaaauauuaauuuaauaagaagguuaacauaauuauggggauauagugacaaauagcaacacaaaucaguuaggaagaaaagcaguugcuuggauugggcaauauaaaagaagacuauacaguaggauucaucuucucuuauaauauugacugauguuuguuauuuguaaacccauguuuuuggccaugugaucuguuagcuaaagagguuucuuaucaguuuuauuaguuuuauaaaaugcggacuuuaacuuuuaguuuacuuuuuuuuuuuuuuacauggagucucccccgucacucaggcuagagugcaguggcgcaaucucagcucacugcaaccuccaccuccuggguucaagcgauucuccugccucagcccccugaguagcugggauuacuggugcacaccaccacaccugacuaauuuuuguauuuuuaguagagaugggguuucaucauguuggucaggcuggucuugaacuccugaccucgugauccacccgccuuggccuuccaaaguacugggauuacaggcauuaagccacugcgcccggccacuuuuuaacucaauauugaacuucuucacccuuuuaugguauuguucuaaccucugcuuauguacuuuuccuucagaaaugcuguguuaaacaucaauagcaguuuuugucuuuugagugccucuuugcuuuaaguugcuuucuuugaagaguacggauguuagguuaucccuaggugauuguugaucgcuauugccagauacuauaguuucauuauuuuuuuccuuuucuauuucuaguauauuuugauguuuuuauuuuuaauugguaugggcaaagggaagaaagacagcuuuuauuggauaaacuuuuccuuuauugaagacaagccauagaugggugauaaagagaaaagaggcuuuaaauucacacgagacuggauuuaauuccuugcuuucccacuuguuaaguguguaagcuuggggaccuuacuuaucaccaaauauguuuucugauauaaaaagggggauacuaaauauaucucaaggugguuguauuuaaauaagauuauauagcauuugauucagugccuagcccacgcuuaucagcaucauuggcugaaacuacugugacuccuauuauuaccuuuauuauuauuauuauuauuauuugagacagggucuggcucugucacgggcuggagugcaauggugugauguuggcucccugcaaccucugucucuugggcucaagcaaucccccugccucagccuccugaguagcugggacuacaggcaugugccaccacauccagcuaauuuuugcauuuuuuguagagaugggauuuccccauauuacccaggcuggccucaaacuccuggacuguagugauccacccaucuuggccucccaaagugcuuagauuauaggcaugagcugcugcaccuggcuaccauuauuauuaauacuguuuuaagccugcagauagcucuuaucugaccccuagcugacugcaauuguaauauaucagacuagagaagaaauggagaauucuucauuuaaaucuuugccuacuuuagauaaguaaacucagcauagguuuuugccaugaaaggacuucuaguauguaauaccccagugagacaagaggccucuuuuuugucccuuccuuuuagccuuggugguaauuuacaaagaugagcacuugagcacccaagaugcuuaugucuauuaguagauguaaauaguuaauucuacacagacaggcaagauacuaaauugguaaaguauaucaaauuaucugugcacauaaccuuauuaaaguuccuggggugaaauuaccucuuauuuuauuuuuauuuauuuauuuuuugagauggagucuugcucuguugcccaggcuggagugcaguggcacagucggcucacugcaaccucuaccucccggguuuaagcauuuucuggcuaauuuuuguauuuuuaguagagaugggguuucacuguguuggccaggcuggucucgaacuccugacuucaagugauccacccgcuuuggccucccaaagugcuaggaucacaggcaugagccaccauggcuggccauaucucucuuauuuuagaacaccccucaugcccacuauauuuuaugaaucaucaaguauagucaggcuuuuuguucagcagaguuuugauguuuuuucuuaauaugucuagggauggacuacagaaaaauaugcuguuguuagugguuuaguauguaaauguuuacaauaaaaggcuaguuaacacuaaauagagguuuaaaauaauuaucaugauugcaucuuauacaucaguugagauuucauaguuugggucagguaauuuuagaauggcagugaauuagccuacuucaucagccagaaaucaagcaaaaggcuagacuaguuagaagcagcaaugcauguaggauucuuuuuguuuuguuuuguuucugagacagggucucacucugucaccugggcuggagugcaggggcacgaucacaggucaccacagcuucaagccgugggcuaaggagauucucccaccucagccucccaaguagcugggacuacaagcacauaccaccaugcccggcuaauuuuauguauuuuuuguagagaugaguuuugccauguugcuuaggguggucucaaacuccuaggcucaagcaauccaucaaccuuggcuuuccaaagugcuggaauuauaggcaugagccacuguguccaaccggguauagaauuuuuuuaucucaggacuuuuacgaacuuaauccauaggggucccaauaucauucauuucauuccaauuauaaccccuaugcaugggauaaaaaauacuaucacauguuuaauuuuucuaguugguuauuugagucuugaaauguccaguuuggcagauaaucuugaacugucccccugggggccaucugcuaugcccucugccuugaauuuuucaggaaccgaagggguuccuuaaguccaaggaagacaguccucuuuuauaaaucaggaggggacaaaggacauucuaaucauucuuuuguuaccagugauuuuguugcugcauuguugccacugagacugguccugcagucuggaaaugauugaccuuugcuacaaggaugcucuuacugauugagaucccucagccuucauggugauccauagguagacuucaaaguuaggacuuuuuuucaguucacauacaaguguuuauaugcccagccauuguuccuaaagcaccagcacccugcucuggcagcuggccuccuggaagcuuuagccacacacagagugagcaaauugacccuuccaccuacacucaaaaccuuauauggagaccauaucuuagccuugacuuagccuugaccuucaugguaaguuacccauggaggcuuuuguuugucuuuucucuagcaaauauuaguugggauuguucucaacugucagguucaaauaauguugcaggaagagaucagaguuucuuuuuuucuuugcuaccaggaauguacuccaaagccccuuuacauucuguguagcacauuuucuuagguagugaaagguuccauauuguccuucgcuggaguaguggccaccaacuugugguugaccccuaaagugaucuguuuuucauaaugaaaaucucccaagcugcuugcaucucuaccuuaaguuuuuaaaauauuuucagauuguaccucacaaggaagccauucaacagaauucucugagcguaaaguagguuaguuggauugaacagagcuaagccuguuccaugacucaucaguauccauguauaaaagucggguuuugugcuugcuucagcagcacauauacuaaaauuugaacaauguagagaagaucagcauggccccuguauaaagaugacacacacauucuugaagcguuccauauuuugcacagucccuggaaggccauuuuacuauuugcuaacagugugagucaaagcaaaaggguggcacccaguauugaaauugugauuuucaugacaaaaauauucauguaaggugaucugugaaaugagaauggagcuaacacaugggauguuacgugcaaauauguuguuaguagguaucacagaaaugagaaaaugucaauucacaucuccuucauggaacuuaaaauaaaagugaggccaggugcaguggcucacgucuuuaauuccagcacuuugggaggcacaggcaggagaauugcuugaggccaggaguucaagaccagccugggcaacauagcaagaccccauugguacaaaaaauaaugaagaaaaauuagccaggugugauggugugcaccuggaguccuagcuacucguggggcugaggcaggaggauugcuugagcccaggaguuccaggcggcaguggauuaugaccaugccacugcacuccaucuugggugauagaauaccuugucucuaaauaaaaguagaguuuuguuuuccacgucaguuggaaugaugaacaugaagauuaagcaccguucuaacaaagaucugcugguucagaguuugaggagguagagaagcaaaagucguugucuaaaccaggccuuaacaucuguuaguuuucugcccuugcugugaucaguuaguucaguaauaagggacaauuauguuaucuaauuuaaugagaugcuauauuuauaagugaauucaguuacaaauuaugaaauucacugggauuggaaaccacaaagaauagaauaacuaauaaccaaaauuaggacuuaguaacauuuucugaaaauggcaacauuugaauauuagaaccuuuggagaaacauuuaauuggguuuuauuugggauuccaaaauaguuuuagcaauaaaauucaggaacaaauuauuccauuucuuuacuauuucucugagcauuugaaaaguguuaucuuguuaaaucuuuauaacccuagugaaauaaggcaguaaaauccuuauguuuuagaagaagauguugagccuaagggaagccucuuguccaagaacaaauagcuguugguuacagagccaggacuucuucuggguucaggacacuuuccauuaugucaagcuaacucuaguuaauuugcugagcuccacugcccucacuucauaacuauuucacuuuaaucuuuuucuccuuuaauuugaagcuuaauaagaaguuugggcugggugcagugguucacgccuguaaucccagcacuuugggaggccaaggcaggcaaaucaugaggucaggaguucaagaccagccuggccaacauggugaaacccugucucuacuaaaaauacaaaaaaauuagcugagcguagugacggguaccuguaaucccagcuauucaggaggcugaggcaggagaaucacuugaacccgggaggcggagguugcagugugccaauaucauaccacuguacuccagccugggugacagaguaagacucugucucaaaaaaaaaaaaaaaaaaaaacaaaaaaguuuguagagcuuacauauuugaaguguaugggauaauuaaaauucugcuguuagcucugauaauggcugaaauacucaagauuuugagauauuugguaaauauuuuuuguaucaguauuaacauaauuuuguuacauuuuucuauacauagcagucaccaacuaauuucagaauauaaagaagaaaggauaccuaaacauucuucucaaaauaguaauucagguaagacuuccaauagugaauuucucuugguaauaguaccauggauaaaaaaguaaaaguaaggaaguguugaucacagaaaagcaguuuuaaaaaucaguguauaaggugcauguguauuuuuucuuaauuucucuugguaaucuagaauucagaauuauuuaagaaguuacauguagauauuuaugaugccaaaugguacuaucugaaaaaaauucauuuacuuaauuaucaucccuaaauuccuauaugaaauuuuuguauaaauaaaaaagguguuuaaguuaguauguuauguguuuccuuuauaauuacauuauaaugaacuagacuuguuauaaaaaauggaucuucuauuuaauuuuuauaauaaaugguuuguguuuauuaaaugaauauuaauuacaguugucccuugagcaacgugcauauuaggacuggugaucccugugcagcugaaaaucugcacuaacuuucaagucccccaaaacuuaacuacuaauugccuacuguugacugcaagccuuaugauaauauaaauagucaauuaacauguauuauguauauguauuauauaauguauuguaguaaaguaagcuacaagaaagaaauuaugauuaagaaaaucauuaaagaagaagaaauguauuuacuacucauugaguggaaguugauuaucauagaggucuucauccugguugucaucauguugaguaggcugagaaauaagaggaagaugagagguugguccugcugucuugggguggcagagaugaagaaaauccacauauagguggauuugugcaguucaaaccuauauuguucaagggucauuacauagugauuugggucacuaaaaauuaacuaucuuuaaaagggggaacucaacaguaccuuucugguaccauaaacaaauggcaauaagaacugcagaacuuagccagugugcaccaauaccaauaggaaauuauuuuuuaaagauacugaauacagaagucagaaaaacaauuccuuguugagaagcacaagucauguuacuuauucuuauaccaacaaaaucuuauuauuacugacuuuauucagccuaaguugaaauagaaugagauacauuuacuucguuagaacaagauguguucuucuggccaggugcgguggcucacgccuguaaucccagcacuuugagaggccgaggcggguggauuaugaggucaggaguucgagaccagccuggccaacauggugaaaccccgucucuacuaaaaauacaaaaauuagcugggcgugguggcgcacaccuguaaccccagcuacucaggaggcugaggcaggagaauggcuugaaccugggaggcagagguugcagugagccgagauugugucacugcacuccagccugggugacagagcgagacuccaucucaaaaaaaaaacaaacaaaaaaaacaaguguguucuucugucugcugaauaauugucaugauaacaguaaucuugcuagaaugaaacacucuguuaucauuagccaaaagauuaucauaaugaauauucaaauaucucaacucugcgcucaacaaauuauaaugaaaguacaaaaauguccaaugggagacucuaaaaaaaaacaggaaaaaaaaaguaaguacagaaauuuuuuuuuuuuuuuuuugaaauggaguuucacucuuguugcccaggcuggagugcaauaauggugcgaucucggcucacugcaacauccgccuccuggguucaagcaauucuuuugccucagccucccaaguagccaagauuacaggugcccgccaccaugcccagccaauuuuuauauuuuuaguugagauaggguuuuaccauguuggccaggcugaucuuggaacuccugaacucaggacaucugcccgccuuggccucccaaaguauugggauuacaggcuugagacaccgcaccuggccagaaauguuucgccauaacaaaaaugcuacuaugcuaccuggaugugacaccaaaugcauuuuauaaucugaacugcaugaagacacauuuaauuugguacauauuuaucaaagaacuuucauagguuagguuuugcaaguugcaagaaauaugaauauggaacagauuaguuuuggucuucaaaguuuucauaauagaauagagcuguucuauuucauuuguguuuuuucaaugaaaguauuuuaauugauuucuauaauuguuuacuuagcaaauaacugucaaguaucuuuuagauacuaagcauuuuucuaacguuacagaaugcaaacauuuuauuucuuuuuucuuuuuuuuuuuuuuuuugagauguaguuuugcucuuguugcccaggcuggagugcaguggugugaucuuggcuaggcucacugcaaccuccgccuucuggguucaagcgauucuccugccucagccuccugaguagcugggaucacaggugcgugcuaccaugccuggcuacuuuuuguacuuuuaguagagacgggguuucuccauguugcucaggcuggucuugaacuccuggccucauguucugcccgccucagccucccaaagugcugggauaacaggcaugggccacugcacccggccuaggugcuaugcaacuuaggucauagcuaugcaacccugccauuguaaugugaaagcagucauaaauaauauguaagugaauaacaugacugugcuuccguaaaccuuuauuuacaaaaccguauggcuggcuggauuuggcuuguggccucuaguuugcuggccucuuauauacaggauagauggaagguaaccauguaaagggauugggaaacaaggaagcuuuugcaguaguuaaagccauaguuuuuuugucacuaauccuuggacuaguauuuauccauuaugagguucucaccauccauggugaaauacauaaaguuaggaagcucaguuuauuaauuuuauuuuauuucauuuuauuuauucuuuuagagaugaggucucacuauguuaggccaggcuggucucaaacuccuggccugaagugauccuccugccuuggccucccaaagugcugggauuauaggcaugaggcaccauaccuggccaguuuauuuauuuuaaaauguuggucuuuuucuucauguuauaacuuuuuuauuaguuuugcuuaaauuuuuuuuuucauuuaagaaauaacauuaagagugcauggguuuuuuuuccuugugaaagcuaucaguuaagagugcauguuuaacuaggaaauauaaacauauuaaguaaauauuauauuaaguaaauaacacauuaaguaaauauguuuauauuuccaggaguaguggaaauguaaggcaaaggcagaagagagguacaguuaauaggauuuagugauuauugaguguaaaaaguuagggggcagagagaaaucucagcugauuccuagguuuccagguugugcacaagcauuuaaacuggacaugaggaguaggaaauugucaggugaguagagaagaguggcaggucugcagggaagauuaacuuuuuucuauacaugugaguauaauggaauauuuauagaggauauuaauucuauuauagucuccagauauggucccagagggauacuuuguaacaaacuaucagucuuaugcuuuaaauuuuauauauuuuucuauuguugauuuaaaguguguuuuacuuuucucuuuaauaguggaugaaagcucugaagacuccuuaagcagguaguauuuuacagauuuuuaaaaauauauuuaaaggaauacagagaaaagaaacuguugagugcccuacucuggguagacaccauauuaugugcuucuccauauagucgucccaacagcuuugcaaaguaucugugcuauauuacaacccaacugugugguucagagagguugauuaauuggcccaugaccucacagugagcaagcagcugacccaugauuugaccaucagccugcuuggcucccaaaucccuucucuugccccucagcauagauugauagagaccugugcggugcuggaucaagguacagguccaaaucagaucaauucagagaccuacauuuaguucuauguuaacucucagaguuuuucuuaggagccugguuaguccaacaauuuguccuaauaugcuugauaauugcagugguaauuaguacuuugacuuuaucaucaaagguuuuaggccagaucucacuuagcuguggccacagggccauacauuuuacauaagcagaccacacaaguccuauaaaggaauuauuuuacuguaagugaaaacuauuuaccuauagaccauauuguguuaauuauauuuagcauccaguuagaggauauuucugguuuauuucucuaccuacugacuucccaguuugguuuucccuuuaggcuaguacucuagcuccaucugaguugcuggaaaggauaugauuuuguuucucucucucccuuuuuuuuuuuuuuuuuuuuuuuuuaaauaacugcauagggcugggcgugguggcucacaacuguaaucccagcacuuugggaggccaaggugggcauaucacaaagucaggagaucgagaccagccuggcuaacacggugaaacccugucucuacuaaaaauacaaagaauuagccaggcgugguggcgcacgccuauagucccaguacucaggaggcugagaaaggagaauggcuugaacccgggaggcggagguugcagugagccgagauugcgccacugcacuccagccugggugacagagcgggacucugucucaaaaaaaaaaagcauaguauuccauggaauauuuauaccacauuuucuuuauccagccaacuguguuccuauuauuuuuuuccauuucugccagcuaaguauuccucauuuuccuaucaacagaaucaaaagcaccuagaauuucaggauuuuaaggaaucagacuaaucagaaugccaucuaguacuucaaucuguguuuaacaucuuggucaaaugguucagauggagaaccugaaacucaaagagauuaaggggauuuauuuggauaugauauucaaacuaauuucagagcccaguacucuuccuucuuuaucauccuacagguuaauauuuuaauaauagaaagggugaguggaucuagugaacccagcggaaaaggaaagaauggaauuagcagaggaaggccagguuugaagagaaacagcacuggguuggauaggaaccgggcuuuuggaaaagagaucagaauauugggguuuuugacaaguucgauaaugauaaauuacuggaaugaaggauacaggauguuuggaauuaucuagaaaggcauauuaaaauaggggguucaggggaguccugaacagguuguugcuuuuuuauauaauuggaggaacugacaaacucucaagguuucuacugaaaaauguuaaaauaauuugagccacugggaagagucucuacagccaguaggaauguacuauaacuacuucugccucaacuuaucgguggcuuugagccccucaaguacuuuggagcuggaggcugcugaacuacauagaucuguggcccagggcagguguccccucaccucugccuccuuucccaauucucugauguccuucucauggacauguaggguagggcagggguaggauuagcuggcaagucagucauggagcaacccaaaucauggaguuggguaguuguuaacaugccugugcugcuggcagaugacagagacuccauuuagcuuguuuuccaggagcagagauauagagagcuucuacucuugggcauuugagaccauccuuucaggaauuugugccuucauaggcugaagacuuaaagguuggagaugcuauggagcccugcagaagagggaucuguaagugggagcuuauaggaaggaagguguuuagauaguacuuagggaaauauagguacaacuaccaggacucuuucuccagcauucuuucucuuuagguaucugagugccuguaaagauuuuuaagggcuugcuaguuuaaggcaggaccucuauagggaaaauaauuggauuuuauaacuuuuaauguuuuaauauuucuggggugaguagucccaauaacagcauauacguauguguuuugacuuuugcccaucuagcuuucaaacauuucacacauuucaggggacuccuuauacuguuuuagggugaagggaagcaaugaggccuuaagugguuuucauguugaagaaccaagacugccauuuuugagugacacauauuagucuuugaaauggagauagauaguggagaaaggacaguguaucuuucuaccuuguuuuauguauuuauuuauuuauuuauuuuauuuuauuuuauuuuauuuuuuuugagacaaagucuugcacuguugcccaggcuggagugcuacagcaugaucucagcucacugcaaucucugcuuccuggguucacacaauucuucugccuccaccucccaaguagcugggaccacagguacacaccaccacacccagcuaauucuuuguauuuuuaguagagacagaguuucacuauguuggucagacuggccuugaacuccugaccucgugaucugcccgccucggccucccaaagugcugagauuacagggaugagccaccgugcccagccuauuuauuuauuuuuauuuuuuugagacagugucuugcugugucacccaggcuggagugcaguggcaugaucucggcucacugcaaucucugccucccggguucaagcaauucucuugccccagccuccuuaguagcugggauuacaggcacaugccaccacgccugguuaauuuuuguauuuuaguagagacaggguuucgccauguuggccaggcugaucucgaacuccugggcucaaguuaucuuccugccuccgccucccaaaguucugggauuacaggcacgagccaccgcaucugaucuccaccuuguuuuagauuaucagguuugugcugguucagguaacgaaaguuauaucagccauuaauuggauuuucaguucagccuucgggacaauuugugaagacaaaguauucccagguucugccauuaucuuggcugucacuauuaguuauagaacuaagguugagucuuuaucgaauauuuuauaguuucggagagguagaggcagcaauugguaacuaaaauauuuuucaaaaacaagaucaaauuuuaauuagaucaagaaacaucauuuaauaugcagacaguugaccuuucaccagguuuuuguuuuuuuggagggggcauccagauugaaaauuguaagcugguuuuuguuuuguuuuuaaagaaaugaauucacucauuuuucuauauuuuuguucuaaaggcuuucuggcaaaccggguguugaugauucauggccuaccucagaugacgaagaccucaauuuugauacuaagguaaagugcucucucaugaacuuaauuuucuuacucugaaucuaguuucguauaguauucucuuaaaauuuugcaguggucuacuuaucauuguuuucuguuuguaauggaaagguggucaggggaagccauuuuauagaaauauggccaguugaauucuuuuuuuuuuuuuuuuuuuacuuugguaaauaacaaaggauugauaaguacuuugagggaguggggauugcaaaaaaaagaauauacuggaaaauacauagugacaggaaaauuauauugggaaaaguuuuccuacaauagaggaaauaugaaauuuggucaaaguuuauauggauaagcacuccuacuaugauuuuaaaaucuuuuuccauuuuucucucucuguaguaagaauguuacagcuuucagguaguaguagaugaucauuuuuaacuaauuggaugacuuaaaauuaaacuguuuacuacagaaguauuuuuuaaaaaacugguuguaaauacuaaucaguauuaucagggauauccuaugaacaaaagucuguuacaggucuguguuucucagugugccuuaguauacuuaaagccuuuccuuuucuuccuugacuuaagcucacacucgaauggucaugccucuauuuuuuuucucccuacucuuucaucuuuuaaaaaugauuuaucucagccuaaauguuuccuugcagaauacauuucuucaguucuguuauuucaguccaugucugucuccauuugcagcauauuuaggugcagcuuucuauuuauguaguuauguguggcuuuuguucagcaaucauugccccacaaggauuauuuuuguuuuuuucucuguuucuuguaaggagcugaauuuauacaaucauuuauuuuuagcuuuuugacagaauagaagcagccuauacuauuugcagugccaacccacuuucauaaaauauacuaagaacaaaaugcucacaguuuuucucacaagagguaauucaugcaaauauaaaucaugcauacacauuucagaaaauaauauguaauuaauuuaaauguuuuaauguuugacuuuuauaauacucuaccuaggaaaaaauuuucauuuuaggcuacugugguuaagaaaauaaucgaacagauaucauaguauuuauauaauaaucaauuagggguaaggggaguaaccuuuggaggauaucuguaucaucucucauaauccuuaccccaugagaagauguagcaaagggcagaacugagguuuaaaucuacaucugagugacuccaaaaucuuuguucuuuguguuagaucauguaguaauggugacuaucuauuacgauuauuuuaucaaauuugauacuuguuuuuuuaaaacuuguuauucuuauuuuuguuuucuagaaugucccaaaaccaagcuuagcaaagcuaaugacugcuucucagcaauccaggaaaaauuguaagcuguuugaaaacugcuuauucuuguguuauucacugauucuuaauuacauauauuuucauuuacucuuuauuuuguuuuuacuguaguagaagcaacauauggcacugugagaacaggaaauagaacuuuguuugaggauagagauuccgauagucaagaugaaguugugguugaaagccuuccuacaacaucaaucaaaguccagugcuuuucucauccuaccuaucaaucaccugaccuucuuccaaaaccuucccacaagucguuagcaaacccuggucuuaugaagguaaguuguuuuuuaaaaaacuuuuuucauguacccuuccccugccccaacaauccucauaaugaugcaucuauugagaugaucauacaguuuuuguuucuaauuauguuuaugugaugaaucacauuuaagacuugcauauguugaaccaucccugcauccuugaaaugaaacccacuugaucauggugaauuauuacuuugugaugugcuguuggauucgguuugcuaguauuuucuugaggauuuuuguaucuauauucaucagagauauuggucugcaguuuucuuuuuuuguuauguccuuuucuggcuuugguauuagggugauacuggcuuuauagaaugaguuagggaggauuucccccuucucaaccuuuuggaguaguuucaguagaauuguuaucaguucuuuuuugaaugucugguagaauuuagcugugaauccguguggcccuggguuuuuuucuuguuggcgguuuuaaaauuacugauucaaucucacugcuuauuacuggucuguucaggauuucuauuuuuuccuaauucaagcuagaggaguuacguguuucccggaauuuuucaguuuccucuagauuuucuaguuugugugcauagagguuuuuauaguagucuugagcuaucuuuuguauuucggugguaucaguuauacugucuccacauucauuccuacuugagcuuauuugaaucuucucucuuuucuuaguuaauguagcuaguggucuaucaacuguguaucuuuuaaaaaaaagcuacugggcacgguggcucacaccuguaaucccagcacuuugggaggccuagacgggcagaucaccugaggucaggaguucgagaccagccuggccaacauggugaaacuccgucucuacuaaaaauacagaaaaauuagccaggcaugguggugggugccuguaaucccagcuacuugggaggcugaggcaggagaaucacuugaaccuaggagguggagguugcagugagccaagaucacgccauugcacuucagccugggugacaagagugaaauuccaucuaaaaaaaaaaaaaaaccaaacaaacaaaaaacaaacuuuuuguuucauugaucuuuuauauuguguuuuugguuauaaauacauuuagcucugcucugaucuuuguuauuucauuucuucugcuagcuuuggguuugguuuguccuuguuucucuaauuuccugaggugugauguuaguacugauuugcuguaagagguuuugauaauuuguagcacuguuauuuauuucaaaacauuuuaaaauuuccuucuugauuuuauuauuaacuccgaaaucaggagcagaucauuaaguuaaaugggaauuaccauauguuuguauaauuuugaggguuccuuuuggaauugauuucuauguauucugcuguggucugagaagauacuucauaugauuucaguuuuuuaaaauuuauuaagacuuguuuuguggccuaucauauggucuaucuuggagaauguuccauaugccuauuaaaagcauguauauucugcaguucucagguagaauguuugguaaauaucuguuagauucauuuguucuugagugcaguuuaaguccaauguuucuuuguuggcuuucuaccuugaugaccugucuagugcugucaguggaguguugaaguccuguacuauuauuguguggcuaucucuuuucuuagguuuucuuaggucuaguaguaauuguuuuauuaaucugggagcucugaagauaggugcguauauauuuaggauucuuagaucuucuuguugaaucgauccuuuuaucguuauauagugacaauuuuuaucuacuuuuacuguuguugcuuuaaacucuguuuuaucugauauaggaauagcuacuccugcucacuuuugguuucucuuugugugaaauaucuuuuuccaccccuuuaucuugagaguauaggaauccuuacaugauaggugugucuccugaaaacagcagagaauuuggcuugugauuuuuaaaaauccauucugccaaccugcaucuuuuaaguggagcauuuagaccauuuacuucaaugguaauauugagaucugagguacuguuccagucauuguguugauuguuaccuagugacuuuguuuccuccauuauguuauuguuuuauaaacuuugugaauuguaugcuuucagaaguuucuauucuguuauguaucaaccuuuuauuucaacauugagaacuuuuauaaauauuucuuguagggcuggucuaguauugacagauucccucagcauuugcuuguucaagaaagacuuuauuuuuccuucauuuaugaaacuuaguuuugcuugauacagaauucuuggcugaugauuuuuuuccuauuuaaggagacuauagauaggacuccagucccuccuggcuuguuaagguuucugcugagaagucugcuguuagucugauagguuuuccuuuacagguuauuuuuaaaaauucuuuuuauuuaaucuuauuuauuuauuuuauuuuauucuuuuuauuuuugucugauuggauuaauuugaaagccuugucuucaaacccuaaaguucuuacuucuauuuggcauagccuacuguuaaaacuucccacuacuuuuuuucuuuuccccccucgagacagagucucucugucacccaggcuggaguagugugaucucagcucacugcaaccuccacccccuggguucaagcacuucuccugcuucagccccccuaguagcuaggauuacagguauacgcuaccauguccagcuaauuuuuguauuuuuaguagagacaggguuucgccauguuggccaggguggucucaaacuccugaccucaagcgauccacccaccuuggccucccaaagugcugggauugcagccgugagccaccaugcccagccccccacuacauuuuguaguucccuaaaugugucuuucauuuccagaaguucugauugguuuuucuuuaaaauaucuuucucuuuagaaaauuuuucauuaagauccugaauuguuuuuaaaaauuucuuuauguugguuuuuaccuugcccuuguauauucuugaguaacuuaauaaucaaccuuuugaauucuuuaucugguauuucaaagauuucaucuuguuuuguauccauugcuggagaguuagugugaucuuuuagggggauuauagaaugcuguuuuuucauauuaccagaauuauuuuucugguuccuucuaauuuggguggacuauuucuuguaauuauuuuugaauuuauuuuugauuugacuggguuuuuuuuuauuuauuuuuccccccuugaggaugugacuugaaugucuauaguuuauugucaccuagcuucagcucugggugcuuucaguagugaagaccuuguaguagugagcuccuucguuacagagaaucuuugugugaugauuuucucagauguugguaguaauaacgauguacugggucugugagcagguuuacuguuuccugugggacuggaauggcagaagucucacgaaucuuaucucauucuccaguguugugcacuuaaaaauucagaugccuacucuguuuccuaaaacauuuuuuuccccaguauuuuauuuacuggauugaacauuucaggccucaggcugaaggagcccauggguaaaaacugguugcagcuaaagcagguggauaaaugcaguaccccaaguuuggccuugacaaauguggcagggggagcucucagugauaugcacuaaaguguuuucagggggaagggagggagccacaggaaagcagucugccucccagucacacucuugaccagguguuccagcuaaucagaucagacaggcaccuuuuuuaaucuucaggaauacugauguuccauauagagagggauugugguccucaugcaagccugaacguggagggcaguccugugggaugcagucacccugaagugcuucaggaaggcugucuacagaugcacgcacaucaugcugucgugggaaaagccccagcugugucugcaguggugggcaagagggagaaguucucuucuccaagacccuucacaugccccagggcuaccuguuaagggaaagccuuagauuuucuccacugagcccagcacugcaccugucccucugcugaaggaaacuucccacaagcggaaggccugcagucugguuucuuuuuuucccauggggugcccucucaauguggugcauuccuuccccugggaguagcagccccugagaaccuggcugcugugaauccugcugcuccucugggucuagccacccagugggcugccauacuccaggguggugcuggggaaugucugcaagggauccagugagaugaccuguccucgagucucccagcagcggguaccagcaccugcucugauagggugggaaggggaaugauguagacucugugagauuuccugcauuacaaauagccuuuguguguuuuuucaaaugccagcuguaguauuaaugugcugggcacauagacaguugcaggaccuccugguuagccagaaagaugcaggcaguggugauuaacugaagaugcacagaaguuuccuacuuccuuggugcugugucauugugcuugcagacguugugaugggcugugcuuguugaguuuuagccaggagguggcgcuugcaaaagagcgccaguugcagugguaguggugggauuugauugccuuagguuacccaagggaaauacucuggagucucagacaaugguuggggccauggaucucccaaaagucccuguccauuguguuaugcuaccauggcagguggagggcaaagccgggugggggcugggugaggccaguccacacucuggcuccccacaugugggugcaagcaguggagcggccccauuggggaucagagggcaguucccuggcugcuagaguaguguuccagggagaagcucagcugccucugcugcacaaaagaauccacagaaggagcuggggauaucaggcaacaguaugucucaugcagcacgggcuuggcaaggcaggucucacgccuauaggguucugcuggcagcagcaagcuggauuccagucagcuugugcuuggaacucaaaauugucccaggccauaagccuuccugagggacagaaaccgcacuuucaagccaugccccuccugauccgccuguggaacaaggggcauccagcuccugcagccugggcacacuucuuguucacccugugguucuggccgaugggguuauccccacucaagaugauauggcagcucucauuugggagcuucucuccaccugugauggcagccugggucagcuggcugacuuccggcaggacgccugugagguaggaucaagaauggcuucccucugucccuccuggagucagggaaugcaugcaauguauauggggaugccgcuuuuucuugugugcccccacugcucacucagucagcuccagcgcggggggaguuagggcuuccccguggccuggauugccgggcuucccaguggaaguguguuccagggaccaucucucccguucacacucuagaggcucacgauuuucuaccugguucaucguguacacugcugcccgccuguucuuucacagggucucugguuucuuuaaguuuuucuguuaagguccuguguugcuucuuggaaaaaaguuugcagcgcaaaucccuacacacuauuuugccuuuccaagagggagagucuuggucacagugccucccaucugucaucuugggaaaaaaauuagggaaaauuaauuuuaguauaagcauuguuagagaaaugaauguagucccggccgggugugguggcucaugccuguaaucccagcacuuuggcaagccgaggcgggcggaucacgaggucaggagaucgagaccauccuggccaacacggugaaaccccgucccuacuaaaaaaaaaaaaaauacaaaaaauuagccgggcuugguggcgggcgccuguagucccagcuccucgggaggcugaggcaggagaauggcgugaaccugggaggcagagcuugcagugagccgagaucgcgccacugcacuccagccugggcgacaaagcgagacucugucucaaaaaaaaaaaaaaaaaaaaaaaaugaauguagcaauuguuuauuucugcaauauucugauuuaucuugugcuaauaauuaauaucuguauguaauggacacauacgcauacaccaaaugaaagcggucaaaauuuauuauuguuuucuaaaauaaacuaccuauuauagaaucauaaggaaggaaagauugccaagggaguuuacaaaauuaucucuaggcuggacauggugguucacaccugcaaucccagcacuuugggaggccaaggcgggcagauuaugaggucaggaguucgagaccagccuggccaauauggugaaacccugucucuacuaaagauacaaaaaauuagccgggcgugguggcacgugccuauaaucccagcuacucagggggcugagucaagagaauugcuugaacccaggagguggagguugcagugagccaagaucgugccauuguacuccauucugggcgacagggcgagacuccaucucaaaaaaaaaaaaaaucucuagaagaugauuuuuuacuuuuaaaaguaccuccagcaaugaggacauuuuauauucucgucaggaagcuuuguuaacuuuaguauucauaguuguuaaaccuugcucauaaauucauucaucucuaaaacucagaauccuguugacuugauuuuuuaguccuuuucugugugugaauacuggucuugcuugauaaucauagauauauuugaagacuuuuaaaucuucaacuuggauaaucauagcuuucuuuucuuuuguuuuuugagacggagucuugcucugucgccuaggcuggagugcaguggcgggaucucagcuuguugcaaccucugcuuccuggguucaagcaguucuugugccucugcauucugaguagcugggacuacaaguguguacuaccaaacauggcuaauuuuuguauuuuuaguagagaugggguuuugcuauguuggcuggucuugaacaccuggccucaagugauccgcccaccucagccucccaaagugcugggauuacaggcaugagccaccacgccuggccuuuuuuuuuuuuuuuuuuuuuaaauacagagucucuguuacccaggcuggagugcaguggcaugaucaaggcucacugaagcuuaaaucuucugggucuggcuucagcuucccaaguagcugggaccaugggcaugcaccaccaugccuagcuauuuauuuauuuuuuguagagauggggucucgcuauauuauccaggcugguuuugaaccacugggcuuaagugauccuccaaccuugaccucccaaagugcuaagauugcagguggggcccacugcacccauccucaaauguugaaauauguaauugaaaccuuaaaucccauguuuuuuucccucuuugucuuuucauuuucaaaauuucagaguucuguguagguucauauuauuuaauucuaccaguuuaguguauuuuacaaauauuuaucuacuuaagaccauaugcuuuuccugaggucaucuacuucuacucuaaacguauuuauccaaaucugucuucuaaauccccuggguaggcgggguccaguggcucacgccuguaauuccagcacuugggaaggcgaaggcugguggaucacuugagcucagggguuggugaccagccugggcaacacagugaaaccuugucucugaaaaaaaaaccaccaaaaaccuaaguucccugggugccucaaauuuuauauuaauaugucccaaacuguggacauuguuccugacgcuuuccugauucuuuguaauuuacucaguccucugguuuccccauccuaguaaauaacaccuaggaaguagcacugaaacauugaagcaggagaaaucuugcacuccaguuuucccucaaauuacgaauccagucacucaccaaguucuuuauuuucuaccugcuuaucauuucucauauccuuuuuuuuuuuuuuuuuuuuuuuuuuuugagacgacgucucacucuguugcccaggucagagcgcaauggcgucaccucuguucaccgcaagcucugccuccuggguuuaagcaauucuccugcaucagccucccgaguagccaggauuacagggcaugugccaccacacccagcuaauuuuuguguuuuuaguagagacaggguuccaucauauuggccaggcuggucucgaacuccugacaucaugauccgcccacuucuuggccucccaaagugcugggauuacaggugugagccaccgcgcugcgcccgaccucguuucucauaucuuauuauugcaauucacuuuuuuuuuuuuuuuaggaugcccaaagaaaaugugacaguucacuuucugaccuguaauuuuggaauaaucuucucuauuuuuguccugaccacucccccaacccccauguuuaucuauguuuacauugcugccagggugaccuuucugaaauguaucugugaugcucuaacucaccugcuuacugacuggauccccaguacaugaaagggaaaguucacauucuagcauaacacagguccuuggugguuuggccugauuuuucuguuuuuucuccucauccuguucccucugacuguguuccaguuuuaccacauuacuuugguacccucauuugucguguuguuucaugccucauccuuuuguuuauggugcccugucuagaaaccuuuuacauucccacucugcauguauuacucuguugucacauugcuaaaaagaaauaccccagacuggguaauguauaacagaaagagguuuaauugacucucaguuccucauggcuggggaggccucaggaaacuuacaaucaugguggaaggcaaaagggaagcaggcaccuucuucacaaggccguaggaggugaauuaauguaugaggaacuaccaaacacuuguaaaaccaucagaucucaugagaauucacucacuaucaugagaacagcaugggggaaaccaccgcaugauccaguuaucuccucuggugucucccuugacacaugaggauuacaauucaagaugagauuuggguggggacacagagccaaaccauaucacugcacugggucuaccucauaguauggcccuaucuuugcaucauuuccugagcuucccagguggaacuuacuguucucuuuugugcccuuacuguccuuuauucaccucgguuguagaacuagugaauuauacuuuucuguucuuacuugguuuuauuuaucucuacccgcacuugaugaauauaggacagaaucugucuucuguuuauauuuuuaguuuuucccaggauagugccuaugaugugauagacacauaagugcuuauugucuuacugacugguauaguuuggaaguguguccugccccaaaucucauauugaaauguaauccccaguguuggaggugggaccuggugggaguugauuggaucacaggggcagauuucuagugaaugguuuagcaccauccccauugguccuguccuugagauagcaagugaguucucaugggaucugcuucuuuaaaagugugcagcaccuccccaccuugcucucuugcccuggcucugccaugugagacaccugcccccucuuugccuucugcugugauuauaagcuucccgaggccuccccagaagcagaagcugcuaugccuccuauacagccugcaaaaccaugagccagugaaaccucuuuucuucauaaauuaccccgucagguguuucuuuaaaaaaaaaaaacuaugcccccaucuuggaugaccagguauuucuuuaugguagugcaaguacggacuaauacagugauugaauggguaagugaauaaauacaguguuuucugaaguuuuuuguuuguuuguuuuuguuuuuaauaggaagaaccaacaaagccaggcauugcaaaaaaagaaaaugguauugauauuauugaaagugcuccacuagagcaaacaaauaaugacaauuugacuuauguugaugaagugcacaaaaauaauagaagugguaaguuaguggauaucucugaauauuuuucuauccuuaaguucuauucugggguccagauguggcucacaccugugaucccagcacuuugggaggcugaggcagguggaucaccugaggucaggaguucgagaccagccuagccaacaugaugaaaccccaucucuacuaaaaauacaaacauuagcugggugugguggugcgugccuauaaucccagguacucgggaggcugaggcagagaauugcuugaaccugggagacagaaguugcagugggcugagauugcgccacugcacuccagccugggcaucagagcaagacucugucucaaaaaaaaaaaaaaaucuauucuaagacaaccaauuaacauaugcagacccaaauauuauauucauuuuaaaaauauuuuucuuuugcugucuuucuucauauuaccaauuuuuuccugagacugcaucaaccuugugaaauucuuuuuuugcuauuauuuuuauuuuauugaaauauucaugaauggagauagacuuguauauguauuuaauuauguauuuaaaauuuacaauaguaaauguucucaugaauauaucuguguaucacauuugauagauaugauguccgcauuaggauuaggacaagaggaagauauagaaucaccuugggauucugagguacuuucuaugguuguuacuauuauuuuaaaauauaagcauugagugauguuaaaacauaaagagaugcuuugacuugacuuuuuuaccucugcauacauccauaaggaacuacuuucuuauauuuuucaguucauaauuaauaaaguaugugcuaaguauauuacugcugcauaguauaauucugcuaauuugcaggauucauuuaagaauccagugaaggauagugcaaaaaaaaaaagaaaagaaaaggcuuagaagucacauggaaucaguauggguucugaaguuaaguuuaucuaaaaacuaaagaauuauuucaggucggccaggcaagguggcucaugccuguaaucccagcacuuugggaggccgaggcuggcggaucaugaggucaggauauggagaccauccuggccaacauggugaagucccaucucuacaaaaauacaaaaaauuaguugggugugguggcgugugccuguagucacuacucgggaggcugaggcaggggaaucgcuugaacccgggaggcagagguuguagugagcugagaucgcgcugcugcacuccauccuggcaacagagcaagacugcaucucaaaaaaaaaaaaaaaaaaaaaaaaagaaagaauuauuucagguuagccuauggccaaguguaugauucuguguuauguauggaugaguaaacggccuaaugagauucagagagaaacaguuuggaauguaguuuuuuuuguuuuuuuuuuuuguuuuuugacaacuuagaacuugaaaagauaaugccugguacuuuaaaguauuaauauauauuuguauagaucugcagggaacauuucaggagaaagaagaauauggaaaauaauaacaauuugguugagugguaguguaauaaguagaaaugauuuucaaaaucauuuccagugacaauaaauauucaggguacuuuuuguaaacgugaaggcaguagugucaagaaaagaaagggaaaguuggaacaggaauguggauuucuaauuugggguauaaguuucaguagacaguuacuggagauauccuauaggaauauagugaauugacgcuugagaccuucccaaugagauuuuaaauguuugaacuugaauaaauuucuguuuauugaguaccaaccaugugcuaggcuguuagacaccgcauauacaaggugggggcuuaugcucuacuaguaggaacugaaaaacaaguaaaccacaaacacuuauaagucacuauaagugcuucauaugaagaaaacaaaguauuagguuagagaaaauugagggaguuuguaguuaggauggggaucaaaaugggagugaaauucuguagucagagaagaucuuucugagugugaccuuagauugccaacuaaaggaagagaaggagcagccauccgaaaggcuagaaggagggcauucugggcagagggcacaaucuucaaaucuguucaucauuuugcuuuuaacaucuuagaaugaccaagaagcaggaagcgggguaaccaucaucaccaucauuuuuauuauuauagggcauagaaaagaaaaugugcaaauaagugccuggcacauuucacaugcuuaauacauaaauguucuuauucuucuauuuuuaugaaggcuugcuauacuuuuuugaaauuauuucuuaauugggagaguuuguauucuguaucuuguauuuccuugcuuuucuuuagacauaacauaaagcaaaauuuuucuuacugcuuucucauuuuagucaaccauuuuccuaucaguaaaaguuguaucaaaaaguauuuagauuuuucuaagccauuguuuacuuaaaugaagcagcuucugcaguguucuauuuauacuuaacagggcauacuccagaguuucuuaucaugccacauaucuuaacacuaaauauuucuauaauuagaaauauuuuaaauguuuaacgcuguacuauagcaaguguauucuauuuuuuaaaauacacuuuuuuuucccucuuaaucaggcaucccccgaaccggaauaaguucagagaagcuccccucuuauuuuugguggggaauacaaaguagaguuaggucuuuugauauuaguuccuuguugaacugugcgcguaaguuaauauuuugucuguuaauauguguccuugggacuuccauguuugguuugcagagucaauagccaucugaagaugaaaagauaagcuuaaucuagugagcauauaugagguucuuuauugaaauguuuugguuuucaauacaugcuuaucuuauuuuuaagccuaauugcuuuuaaaauaggaaauucauauuauauuugaaagugauuagaaaaucuuuagcaauucauucuuuuuguaaaauugaaacucauuauugauacuaauuuuaacagaguaucucugagaauuuuccacagaaguauguugauccuuuagcuggggcugcagacggaaaagaaaaaaauauaggaaaugaacaagcagaagguaagagcuauauuucauuuuuaaaaagccauuggacagaguguuuauuuaaaaacaugacuguugauauauucuaauagccgaagaaaaucaccuauuaaaugcauaguaagaauaaagagagguaaaauugugauaaguuguauaucuuaggugucagcaacagauuaaauugcuagugccacuaagggaacugaauuauuagauccauuucaaaauacauuaagaccugagggagccaggaaauaaggaagaggagaggaguaaaagaggacaugagagugaggaaggcagagaguacagggagugaaugaagggcaaagaagcaaguguauguaauggagagugguaaaauaaaauaauucuagggccaggcgcguggcuuaugccuguaaucccaacacuuugggaggccgaggcgggcagaucacuugaggucaggaguccgagaccagccuggccaacauggugaaacccugucucuacuaaaaauacaaaaauuagcugggugugguggcacgcaccuguaauuccagcuacuugggaggcugaggcaagagauuuguuugaaccugggagguggagguggcagugagcugagaucacgucacugcacuccauccugggcaacagagcaagacuucaucucaaaaaaauaaaaauuaaaaaauaaaauaaaauaauucuuuagaaaauggaaaagcaggguauuagaaagguaggaagaguuuaaaaugagcuuccaguaccaaaacuugucagagaaauagagcaaaauuuacccacucuucccauccaccucacuguugggaaggcaaggauggagguacuggaccaucuauggcacauuucaucugcuguagaugaauacaggcauauguggucagccauacauaucuagaauuuaaugucauagaaaauguuacaucaggcugggcacgguggcucacgccuguaaucccagcacuuuggaagguagaucaccugaggucaggaguucgagaucagccuggccaacauggugaaaccccgucucuacuaaaaauacaaacauuagccaggcaugguggcauaugccuguaauccuagcuacuugggaggcucaaguaugagaaucacuugaacccaggagacggaaguugcagugagccgagauugugccacugcacuccagccugggcaacagagcaagauucugucucaaaaaaaaaaaaaaagaaagaaagaaaguguuacuucauaggauaguaucucaaaggccaaaagaaaagaauuggaaagaagagaguaggguugguuauggagagaucaaggaagccauacuaugauuaaaagcccacuagcaacuuuaugacuugcaauacaauuucaguuugggggacauaguagggaggagcuugacaccagauuccaagagggcaaucuaacauaaaagaauguggaagcaaacuaaguauggaccagagcuucuuaaaauuuaauaaaucagcuggggaucuuguuuaaaauguacauuuugauugagcaggccugggguucugcauuucuaguaaguucccacauaaugcugaugcuucugguccuuggaccacacucugaguaacaaggguauagacuuccuuuuugagaaaucugaaagaagcgucauuggacaauaauucaaggcauaacaggaucagaauaaagcauuauuuuucuuuuauuucugagcauguuucuuccagaggagaagaaacaaagagauggagaaauagaaauuguagauauaagauaacuauuguuaaaugaagaggaaagaagugcugagaauguuccauaaaaagaauauagaaugggaagaaucaagaccacagaucuggagauuacuuuugcaaaagaagagagaucgugaguggggaaagagaagaaagaaagaaguuagcuaagucaucuuggaguuaacgaugaggaaacuugagagaacucauuucagauggauucauugcauuuacacucaaacagacgauuagaucauuucugcuccagagauuauugcaagcaggagggcaugcuagaauugggguaaacuacagugauucauaucuccuuucuauaacuaucagacaucaaagauauauguugcuuuggacugaucuuggugguuugccugucacucagcacuuugggaggccaagguggguggguugcuggagcccaggaguuugagaccagccugggcaacauggcaagacugcaucucuacaaaaacauacaaaaauuaggcgugguggugcaugggccuguaguucggcuguucaggaggcuaaggcaggaggauugcuugagccugggagguugaggcugcagggagcaaugagccaugauuuugccacugcacuacaguccgggugacagagugagacucuguaucaaaaaaaaaaaaaaaaaauagauguugcauugauauuaaucaaaugaguuuaauuugaauauagaagcauuggcuuuuuucuuaaaguugcuuuuugauaacgauagcuguuucauaaaauccuuuagaggauaacauuuuagaaaugaaaaaauuacaguuaauaauuccuugaauacuaaaauuguuauuuuaaauaaacacugcauugauuuuaaaaaacugcacuaauuuugaaauauaaaauguuauuaauaucuaauucuguggcaauuaaauuuuuuccuuuugauaaauauuacaauauugaaagcuuauuauguauuauuucuuagauguguuuuauauaccuucuugcaugaguggaucaagaaacuuuaagauggcuaaacuagaggauacaagaaauguaggcaugccaguagcccacauggguauggaaaaaaaaugcguauuuuuguuaacuguuauucuacaaguguauauccaagcugaucaauucagaacacuuucucugaugagaaauaaguuauauauccaaguaaaguggcaucauaacugugugcuuccuaaauuacaggacaaguugaagaacaugauaaauacuuguaguauaaugguauaaaugauucugauguguugcauuaaagauaugcugucgcauuuuaccaucagccuugacauuucuccucucagggucaugauuugcuccucuaauuaaagauuacuuuucuccacaucgaccagcaugcucacauugguauaugugcacuuuucuauuuuaguuauagucacuuggaacauaaucuuacauucaaaucauaacugcauguuuuauuaaaccuauauuccuguuuuuuucuccaguauacuucugucauguugcuguccuaaccaaaauaaaaaacaucccaaaaauuaacauaaucauuuucaaaccaagcgugaugauucuggucauacuaacacugcaugaauuuaugauugacuuugucauauuuauguauaauugauuauaugucccuuuugguuuuuagagucuccugagagauaucuucacuugaagguaauaaguuuuauauuuuuaucuugaauuauuaagugcauauuguauaaaguauacauuauuuauuaaucauuuuguuucaaaacccauucagccuaccauugaaaugaaagauucuguuccaaauaaagcaggaggaaugaaggauguacaaacauccaaagcagguaaauguugcaauauauauuuaaucuuggaaggaaguacguuaaaauuuuugaaauauuugaaaugcucacaguuuucuuauuccuaauucuuuuuuucuccaaauuuguuggaaggauuuaaaaaaauuuuuuuuuaauugagaccgagucuugcucugucacccagacuagaaugcaguggcgugaucucggcucacugcaaccuccgccucccagguucaagugauucuccugccucagccuccugaaaaauagcugggauuacaggugugcaucacuacgccuggcaaauuuuuguauuuuaaguagagaugggguuucaccauguuggccagacuggucucaaacuccugaucucgggugauccacccgccucggccucccaaaauucugggauuacaggcaugagccaccaugcccggcuuuuuguuuuuuguuuuuuguuuugauacagagucucacucuguugcccaggcuagagugcaguggcaugaucucggcucacugcagccuccgccuccuggguuccagcaauucuccugccucaagcuccccgggcacacaccaccaugcccggcuaauuuuuguauuuuuuuagagacaggguuucaccauguuggccaggcuggucucgaacuccugaucucaggugauccgcccgcuuuagccucccaaagugcuagaauuacaggcaugagccaccaugcccggacaguaauuauuuuuaauuacuauuugguagacauagucuuuuaaaacaacaauucugaaacuuuuugacuuugggguccuuuuaugcuauuaaaaauuauugcauagagguaaccaacacgcugaauucgcuaucguucccauucccaugcucuuuuaaaacauuuuccuguguauguauacgucuauaaauaauacauagaauuuguuuacauguccuagaauuuuauauaaaugguuguacauuguacauaucauucuucaacuuucuuuuguuugccuagcauuauauuuuucagaucuacccguaucgacacaaguagcucugguuuaaguucuuuauaguauuccauuuuauuacuguacauuuaauuaaacucucuucauucggauaaacaauaauaaacauaaaaaucaggccagacaugguggcucacaccuguuagcccagcacuuugggaggcugaagcagguggaucacgaggucaggagaucgagaccaucccggcuaacacggugaaaccccaucuuuaccaaaaauacaaaaaauuagccaggcgugguggcaggcucccguagucccagcuacucaggaggcugaggcaggagaauggcaugaacccgggagguggaguuugcagugagccaagauugcaccacugcacuccagugugggugacagagcgagacaacgucugaaaaaaaaaacaaaaaaacaaaaaacaaacaaacaaaaaaacauaaaaaucacugugggcugggcgcggugccucacgccuauaauccuugcacuuugggaggcugaggcgggcagaucaugaggucaggagaucgagaccauccuggccaagauggugaaaccccgucucuacuaaaaaaauacaaaaauuagcugggcaugguggcacaugccuguaaccccagcuacucaggaggcugaggcaggagaauugcuugaaccagggaguuggagguugcagugagccgagauggcgccacuggacuccagccuggcgauagagugagacuggucugaaaaaaaaaaaaaucaugguggaguucauuuuugaaaugaaaaucaugcuuaccaaugaggagaaaagugauuuuuaagugguuuguagcuguugauauguauuauauuagaaauuaaaacugaaaaauagaaaauacaugcauguacagccacgcauuugaauagacuuuagagcuaugacccaugaaccauuagcuuaugauguuacgauacauccuagcuucgaaaaagucuacuguacacuucucagaaaaugagagugaaaaugucaaauauauuaugcauuaugugaccucuuguacccuugaauggauauuggauucuagggauucuuaaaucaaaauuuagaaccacaguuuuaaaccauauguaugguuuguagaugucaaauaauaaauggucccuugaugaugaaauggccuuuaaaguuucacuucuaugguuuuuacuuuuuucuuuugcuugucuuaaaauguuuaaauccaacaauuuuguuuauaaagaaaaaaggaaaauauuuuuguuauauacucauuucuuguuucauggcacuguguacucucuggaucaagugugcaccuagauuuauuuucacgugggaacaauuaggucacuuaaggccaucauuguuucuuucuuuuuucuuuuuuuuuuuuuuugagauggagucucgcucugucacccggcuggagugcgguggcacgaucucggcucacugcagccucugccuccuagguucaagcgauucuccugccucagccuccugaguagcuagggcuacaggcgcgcgccaacaaggccagcuaauuuuuguauuuuuaguagagaugggguuucaccauguuggccaggaugaucucgaucucuugaccucgugauccacccaucuuggccucccaaagugcugggauuacaggugugagccacugugccuggccaaggccaucauuuugucuauaaauuucugauguuuacccaaggcuuaaaaaguaaauucugaacauagugguacguugaggaaagagcauuucauuguaauaaguuuuuauuuaaaguuuauuuauuaaauguuuuugucuuuagaacacacacacaaacacacacacacaauacugucauccauauuuaaaccuaaaaugguuagacauaaaguuuguucauaaaaaaauucauaucccugaagaaucuuaauuauuaauaaacaaaucucuuauggaaaacaaaauagguaacagacauugcugagugaaucaaaguaaauaaguaauacugaaaaauaaaaacagaaaaaaauccgagagaugacagucaguuaaacuucugugagcaaauggcaaguaaaggacauguaaaauacaauucaccauggaggaguaguguguuuguagcauagagguugacaugggacuucuucuaugaagaaaguuagucaaaccuauauuauuuacauucuaauaagugaaaacuuuauuuucagaguuuucagauugggacucuacuaguuugacccucaguaauaagacuugccaaagaccugggacuuugaaaaucaaugauaaauaucuaucuguaucacagucagugaccaaaaaucagucagcauccgcagaacugggacaaacagcuaaaggaaagauuacuauuggagcuuaguuucuauuagagaauaauacucuccaugaccuuugugaaucacagcuaccagaaaacaaaaagcaaagaagguaacacagaagcacagagaauucaguccuagaguaccuuugcuuggcuucauaauaucauaguuaugacuuuuauuuuuuauuuuauuuuuugagacagaauuuuguucuugcugcccaagcuggagugcaauggcaugaucucagcucacuacaaccucugccucccggguucaagcgauucuccuuccucagccucccaaguagcugggauuacaggcaugcaccaucauaccuggcuaauuuuguauuuuuaguagagacaggguuucaccauguuggucaggcuggucuugaacuccugaccucagguaauccacccaccucagccccccaaauuguggggauuacaggcauguaaccuugcccagccuaguuauaacuuuaaaaaaaauuauuuuuggcugggucacaccuguaauuccagcacuuugggaggccaaggcggguggaucaucugaggucaggaguucaagaccagccuggcccacauggugaaaccccaucucuacugaaaauacaaaaauuagcugggugugguggcgggcgccuguaaucccagcugcucaggaggcugaggcaggagaaucacuugaaccuaggaggcgaagguugcagugagccaagaucacaccauugcccuccaaccugggcgacagagcaagacuccgucucaaaaaaagaaagaagaaaaagaaucauuuuuagcgaaaguacuuuguguuuauucuccuuauguaaccuacaaccggacaaaauaccuuuuagcagggcauuuguagucuuccucuaacaaaaacaaucuaugaaucacaaagagaauuaggagggacaguaauuuuguuuaggccaguauagagcauaaacuugagagucaguagcaggguuauauuuagaguuuugggacuggauggaaaacuagguagagaucuaaagauugccuacucaagcacaaugugguuuuuaugcuuuauuuuuacagcucugaauucacaaguguuaguuauaacuacauguaauguaacaaaaaagcaccauucaaaucaaauauuauuucuuauaauuucuauggcuuuagauauuauagaguggacugccccguauuagugggaaucauugagaauuugcucuauaguguauccccagcuguguacacauagucugucaccuuguuuuaaugaauaguuguucacuaggaauauuuguuuuaaggagugcucuaucauuuaaaaaagauauaugaaauucaauuuuauuaauaauucuuuuaggacacccagucuguugauuaacugcaucuaauguguuuuacuuuauguaccaguuuaacucggugcccuuaaucaugugaucuggucuacaguaauaaaucauauaauuuuuuuaucccaauaguuuuguuuucuuuuucccccuuacuuguagaauuaauguuguauuuuacagaagaugaucaguuauccccuagaguagugacugcaagcuauaaaucuaaaguuacucaccuauacauauauaugcuuguuugcucucauuucuucaugagcuuaguagauccaagaagcaggacuuuuaaaacaaaauaccuaaaugaaaucccuuaacacaggaagacaugaaacagaaaaaguaugaaguaaacaacuuaaacagugccuguagauuguuucacuucucauuuaauaccuuuuauaagguaaugaauagagucuagcucuccagggacccagauauauacaucuauucauuuaauaaaaauucacucuguauuggguacugauauucuauauccuaaauauuuuuggaaacauucccucaguuuaggccugcauuauccuuguucugcaauauugucuucuaauuaaucucccuuuauuuauucauaugccccugaaauucauucucuccacaguauuuagggugaucugucuccaaugcaaauaggaccuugagucccucuugaaagcauaaauguucaaacaucuuaagauuacauauaaggcuuucaucaucugacuucugccuaacucuccaucuuuagcccuuuccccuuucugcccuuuucucugggauuacucaacugcuggugaugcucucuucucuggugcuuguauuuuagacaaauauauaacgcuauuugaggcuucuuucccucucuuguugcugccuugcaugcuguuacccuuuccugcccuuuaccccuuuuagucuggcuaaccucacuuuuuaagucucaacucaggcaugaucucuagcaaagccaucuuugacacuuuuauuuacauucuuuuuuugugugugugauggagucucaguggagugcagcagcacgaucuuggcucuccgcaaccuccgccucccggguucaagugauuuuccugacucagccucccgaguagcugggaucacaggcacacaccaccacgcccagcucauuuuuauauuuuuaguagacagggcauuucaucauguuggccaggcuggucuggaacuccuggccucaagugauccacccaccucgaccucccaaagugcugggauuacagaugugagccaccguacccgguuuuauuuacauucuuuaaaccucaguguuuagaacuuagcaggaacucaguaaauaauuaucgaguaaaauagauaaagacuguuuauacaaagauaacuugaaagauuguccccuaccgucugggagcaagggcauaaacauauaaauaaauaauauacaguucagauggaaaagauacaguacaaagauaagguacuaaggcagccccaaggaaggagacaccuguuuaucugggggaagauagcucuaaucgaggaagacuucacauagcugucuuagucuuaaaagaugaaaaaaaauuugucaaaauagcagaaaacauuucagauguaaggagcgugauguacaaugauaaagauguaaaaaguagcaguaauuuuggaauucauuaauaaugaaaaacacucuuugugccuuguuaaaaagauacuguuauagagaacauuauacaauguuacuuuauauauuccuacuguaucauaaaauuuuguuuuguuucugacaguuuagcuuauuuauguugggugaaugaauuugugagugaauauuugagauguuuguauggguugaaccugguauugucuaguguuacuaguuuccccaagugguuuguugaaguuuuagauaaugguugaaauuuuaauuagauaccucauuaaguugauacuuagaaguauuucuuacugagaaguaaauauuccacuaaagauuaggcuucauugaaacuuugugauugcgccacugcacuccagcuagggcgacagaguaaggcccugucucauaaacaaauagaagaaaacccucucgauuuauaaaauaaaauaaauauuauuuucuauuucuguaaagacuauaccuuuuaccuaacuguucuaaguaguucauuaaacuaaauauuuggauuuuuucagcugaacaugacuuagaaguagcaucagaagaagagcaagaaagggaagggagugaaaauaaccagccacagguauuauauauuuuuaaaaauuucugguuuaauauuguuuucuuugcuuuaaugauguaacauaguccaaaugaaauuacuuuucagacuagccuuuuagaaucaauagaucaucauuuaauauuuaguauuaaaaacguuuugacuaguuaaaauguucuuagaauguguaguaaccuauagcuaaucuuuuguuuuuguuuuuguuuuuguuauaguuaaucuuuacccuuggaauugaagccagaaauuuccugaguauuguuuccucuuucauuuuuauaacuuccuuauaugauaaagaugguaacaucaaauauugaaucauauuauuaagcaguagaaauuaugaacauuuuaacacugauggccacugaguuggauucaucuuaaaggaguaaucauucccagugguucaggauuuacauucuuauauugcuggucacugauuccaagguuaaagauuuauucugccuugugaucccuguugauuucagugucuacauucagggaaagaaugaggucagaaaaucaacccaguuauuaagagaaucauuccuuucagaaugggaucuuuccauuguuaggauauacacaauaacuuucugauuauuucagucuaggaaaucaguaaauauuauagaauuuuuaaauccacuauuaaugaaccuuaggauauuuaagaauuagacuuaagucuuauauaguuuauacagaugcauaacaccauauuaugguauauaauuucaauuaaaauguaagaguuaacuuuucuuucugauugguguuuauuuuggcuccuaauaauuuaaacuuucccuacucuccaguuagaaaucuuuacaaaaaguacuuaaaugcacuguaggggcucaguauuugagguaugguaagguaaaaucuuuuaaaaugaggaugccuuuauaaugcuacaaaucaucugcuaauuuauuuuugguagauuuaacacauaaugaauuaaguuuaauccaaaggaacagugauaaacuuaacuuugcugguucauguuuuucuccuauuuuaggcuaaggcaaauuaguuuuuacuucuuaguuacaauccagugauuugggaguaacuaaacauagacuaaguuuaacaguugaauuuuaauuauuuccuaauuuuucuuuguccguacuugauuacucaaggauaaaguuauuuuaaaaacaugcacccugacagaaaagacaucugaaaaacaaaacaagcaaauuaaucguccacuuucaugucugcaaaagaugucucaagaaccagaacugaauaaggagugugauagagaggauguaucuguauauucaggacuuccuugugugcaaaaugaugaagaaauguggaccaaacaaggcaaauuagaguggaaaaauaacuuaaaacucaucacaaaugaguuaaagcagagcuguggugaaacuugugaaaaauacaaaauuacugcuucuccuggggaagagucacuacaugauaacucuaaaggaggcacaaacuuaaaggaaauaccuucuucuuugacaaauaauauacuugauugcgaugaaaaagauucuccugucucuguacuauuccaggcauugccugaacaaaaaguacucagucucgaaaauggcuuuucauuuccuucauacucuggguccccagaauaugcuugccagucaucuucuaagccuuauuuaaaugaaaauaaauuaggccaugaaaauguuaacaaaccagacacugaacauguuuuuaacacagaugagaauuuuuauaaugauacagaaaauaaaaaaguaaggaacccagaaguaguuacagguguaaugaaagaagaguuugauaagacaaaaaauaugaaccgaaauaccacuaacuggaaauuagacaucagacgugugccucaguauagugauccaaaaagaccuuuugauuugaucugcuccaaagaaaugaaucauauguuucacauaaaaaggcauaguauuucugcugguacagacgcuuacaagaaaacaaaaccaauacagaacuuguuccagaagccauuauaugaucauugcagugcuaauaacuauaaaagcauggaaccugaauuagaaaaugugaggucuucuccaccacguggugacagaacaucaaaaguaucucuaaaagaagaauuacagcaagauaugcaaagguuuaaaaaugagauaggcauguuaaaaguagaguuccaggcuuuggagaaagaaaaaguccaacuucaaaaagagguagagguuugcuugcugcuacucuuuguuuuuuucucuaucaauuauuugauccauucugauuuucugcuuaugaagagcucauguauaaaaugguguuaccuaaauauguaauuguguuuagaaauagauauuauucugcuaucuaaguaacaagaguuaaggaaaacauucucaaaaucuuuguuccuuaaucaaccuaagaagucuaucagucuuccaagugacauauggacugggaaacuaauuuagccauauaccgugugaccuugugaaccaguauaagcauaaaggaaauugccuuaugaaagguaauaagugcuaggguuuuuuucccuauuuucuuaaagaugaauuucuuuuauuuaaacaacaacauggcaauacagugggagagaagcagugacugagaagagauauaaaaauauaucuagcccugaguauuguuaacaaauauucccagccaaagggaucuuuuuaaugugcuuucguguguguaaagcuuaucuguuugacucaaacuguuggaacuuauaauuccauucugaucacuuuaaagauuuuugacaacaaauacauguacuuucacauauuuuuuaaaacaccagucaaauguuucuguugaaccagaccuuuacauuauguuguuuaauaaaguaugauaaguuugggcauguauacccuaucaguagcauaaauccucagccagaaauuuaguauuuaacuccaaaguagaaagcugaguucuguacauugaguuguaaagauaaacaauaaucugcagauauucuucuuuuucuuucuuucuuucuuuuuuuuuuuuuuuuuuuuuuuuuuuugagacagauucuuacucuauugcccaggcugcagugcaauggcaugaucuuggcucacugcaaccuccgccucccggguucaagcaauuauccugccacagccuccugaguagcugggauuacaggcgcccaccaccacacccggcuaauuuuuguauuuuaguagagaugggguuucaccauguuggccaggcuggucuuaaacuccugaccucaugauccacgcaccucggccucccaaagugcugggauuacaggcgugagccacugcgcccggccaauauucuucuuuaaaaguaaaagcagacgagacuucccacacccugcuauggcauuaaauuacuuugccagugucacacuuaauucaucugauuaauuugaugaauuuaucugguaauuuaucugauucagcauuauggaguuauaucaucucuuuuggugccauaaagugcuagauaaugccacuuuaggagcucuggauggaucauuuaaucuuucuuguuuuaaucuggauggaucauuuaaucaguagauaaugagguuaacuuagauaauuaauacuuauacuauauauccuccagcuauaaaauuuuaguuauugaaugugaaauucgggaagcaucucauucuccagaauuccacaccagcaacucagcaguuucacucuguuccuuauguuguggcaaaccuugguuucuguauuucagugagcaccuucacuuuguugauaucccaggauccaaacgaaaaaaagaauuauaaaagacacuggggaaaagaauaucuuagugcagaaagggggaagauuccuuucucuuccuggcugcguaguguaaaauccaggugguaaaaaggcagaagaagaugcaucuugugucuuugucuuuuuauuucucuguuucugccaguaaaauggggugaaaauucauaguagauagugaagauuggaugggaauaaaagcacaaaauuaagaagagccuuugaaauuuuggaaaauucuguuuuacccaaacagaaaugaagcagacuuuacaaaaauuucguugauaaaauuauaauaauagcugauaauuauauaacaauuauguauacaaugaucccauuagaguaagcagaaaauauuuuuauuggcuaaaguuaccauaguuaaacugagucaaaugauaaacucaaugaaaacaaagaaauuauuauugaauaaaguaauagcaauuccuuaguaucaaacuuucauuaaagguugaagaagaaaggaaaaaacacagaaauaaugaaauggaaguaucagcaaacauacaugauggugcuacugaugaugcugaagaugaugaugaugaugauggauuaauucaaaaaagaaagaguggagaaacugaucaucagcaauuucccaggaaggaaaauaaagaguaugcuagguaagcugauagcauauuuaacagcagauaauuguuauugugcuauaaaaauucuaauuuggacuaauauucaugauuaauaaauuuuauacuuuuacuaugcaagggauaugcaaccuugccuugcaauuagaaaaaugcaaauuagcaaacaaugagauaccaguuuuuucaaucauauugauauuuuauuuaaaaaauaauacccagugauggcaaaugugagaaaaaaggcauucucauacacuguugguaaaugaaauugguaaauccuuuuugaaggauaauuuaguauguaucaaaauuucaaauauuuccuaucuuuaaccuaacagcuucacuucugggacuagauucuacaggaaaauaugacuuacauaaaaaugcacacacacaaguuaaggacauuuauuauauauuauguguaauacacaguaagccuauguauaauauauguauaacauguuaaauaauguauguauuuuaaggauauuuauauaaacacauuacauauauacacauguugcuaaggauauuuauuauaguaucccaaauguugggcucucaaauuaauuugaauuuugccaagggauugcacagagagaucuguaguacauguaaacauuucaguauacuggguauuuuuaggggcucaugcucaacucuuaacacagugggaaauuucagucucuguaaauuauauagguauaugauagugauauccuugugcauguuuuuagaccguaaaaaaguaguuauggccaggugcgguggcucaugccuguaaucccagcacuuugggaggccgaggcaaguggaucacuugaggucagaguuccagaugagccuggaaaacauggugaaaccccaucuguacuaaaaauacaaaauuaggcaggcaugguggcaggcgccuguaaacccagcuacuggggaggcugaggcaggagaaucacuugaacccgggagucggaaguugcagugagccgagauugugccacugcacuccaaacugggugacagggcgagacuccaucuccaauaauaauaauaauaauaauuauuauuauuauuauuaguaguaguaguaguaguaguauuauuacaguuuuucuggugguaaauccaacuaggcuaaaagucuauaaaaguuaccaaauucuuuuauuuucuuucuuugagauggaguuuugcuuuuguugccuaggcuggagugcaguggugugaucucagcucacugcaaccucugucuccugggcucaagcaauucuccugccucaacuucccgaguagcugggauuacaggcccgcaccaccacaccaggcuaauuuuuuuguauuucuaguagagaugggguuucaccaucuuggccaggcuggucuugaacuccugaccucaugauccacccgccucagccucccaaagugcugguauuacaggugugagccuccgugaccagcccauuauuuuauuugcaaacaaaaucauaacuaaucagaauauugcuauuuuggaacugcauauaaugacauauagguauucuaaaaggauuuuucccccacccaggauauuuuccugauuucuucuuccauguuauauguguaucaugcuauuuuuaaaacuucauuuaaaauaaacuucauuuaaaugaaacauuaugauguuuaaaaacaaaacaaaaaauauagcccaaaucuaauugcuacuuccaugucuaaagaccauuguuuguaggcaaugagcuccagccuuuuacugucacauucaaguuuaguguagcauucaccugucucuaguuucuuucucuuuuucuuucaaguuccuaggaaacaucuagaugccgugugccuaaucugugcucaccuucuauucucuaaguagaaugguuuucucccauuuuuugucucaugaacuccucuauuuugucucuucuguuuuaaagcuguccuuguguucagauauaucuuuucauauaucaaccuuacauaucacauuuuaucauaaugguaugauaaaauuaugguuuuugaagcagggaauauacauuuucucuuauguuguugguaauucguguuuuuugaauuagugaaugaauugagaugggggaaauguuggaauuuuauaaaaaauuauuuuuauucuuuguuagaauuacuagaaaacauuggcuuuuuaauggauuuuuuauucuuucuuuuccuuaacucucuuucugcauguuguuucuuuuuuucuuuuuucuuauguaacugucauuucccauggauuuuuuaaaguagugguccugccuugcaaaugaaggaaguaaagagcacugaaaaagaaaaacggaccucgaaagaaucugugaauucaccaguguuugggaaggccaguuuacuaacugguggccugcuacaaguggaugaugacagcaguuuaagugaaauagaugaggaugaaggaagguaaaaucuaugauuucuuuauuuuucuauggaggaagguuaguaguaauuuuuuucugaaaauagaaugauguagucucccaaagcuagagaauaucgacuguuuccaugcugcugaaagauuaagaugaggacaagugacuuugacaagcagccauuucaauaaauggucaccauggagcccugacuauaguggaugggcacagacggcguuugagagaacuuggacugagaggcaauagguaaaugggugguaacugaagaagaaugugggauucaagggagccuucuuucuuuuuuauuuuaaaaugcaagcuuuuagaguuuauuugcaugcuuuugggagugacccaguagagaaggaaaugcuuaugaaauuuaguuuuguuugcaugucaaagccucagaaagcuugauccauuaucuuuuaaagauuuauaauaaacuaauuguccuuagaacuucuauuaauguaguuuuuugcuaagagguuguucauuuggaauuguuucaaaaauggaguauuguaauauaauugaaugugucaaugaugaucuuaaaguuaaacuaucauauauggauuuuaaaaaauuaucuaauaauaaacaugcaaacauauaggccauacugaauugaauuuaaacauuucuugauaauugaagauaucagaguacuuuugacaguagcaucaugaacagcuaugauuuuguaagacuaaaagaucagguguauuaacuuaauaguuguuuagauucuggggagaaggggaggauuuuguuuauguacaguagaaaauuaaacuauugacaaucuaucacagacuauuacuuuuagauuauaaaguucuaaaauauuaaaaaccauguugccuuaugcuaauagugucauugacauguaugcugaguaaggauuuuuuuuuuuuuuuuuuuaagucagagucuuguuccguugcccagacuggagugcagugacgugaucucagcucacugcaaccuccgucuccuggguucaagcaauucucaugccucagccucccaaguagcuagaacuacaggugcacaccaccaugcccggcuauuuuuuguauuuuuaguagagacaggguugcgccauguuggccaagcuggucuuaaacuccugaccucaagugaucugcccaccuuggccucccaaagugcugagauuacaggcgugagccagcacgcccagcuucaauaaggauuuuugaaugcaugaauaaagaguugaguagaugaaugaaugaacauugaugaauuucuuuagaaaaaauaaauguugagcuuauugaaaguagauuuccaaauuggcuagauuuaaggucuuuuuauuuuaaaaauauuugcaagauucagaaauuauuuauaauuauaaccagaaauagaaugaaaauauagauucaucugcuaucauaucacuuaaaaacacuugaaaauaaauauuacuuucacagcacagcaaaauauguuuuggagcuagaauuuuuggguuugaauuuugggucugcuacugaccagcuauaugugcuugggcaaguuacuugguuuuccugugccuacuuucuuccuuuauaaaauaccuaauauguuaucaaccucacagaauuauuguuaggauuaaaaugaguuuaauauauguacagugcuuaggauaaugcauaguaccugcauugugaguccugaaaaaagcuaacuaauaccgucauucaaaaaggguuuccaucauguaaggguguuaaguaauauauuccaaauagguuuuagugcccguaaaagcuuguuuuuauugaaaaggucgacagcaaaaaaaaaaaaccugguauauuucuuucuauugaauaaugcaaguaacacuauguuuucauuuugcuuugacugucaggaagcuugaucuaaauuuguuuguuaugauauuguuaguauauuuuucuugucccuuacuuuuacuuuuucuguauauaguuuaauaccccuuguagaaaguuauuaucuuuuauauuaccuguaaaaaagauuccuguaaacuuuaugaauaggguaaauaaauuacaaaugcagagcuuuuauuuaaaaaaacaauaguuuuagauauuccuugcauuuuacauguuuacuauuugccugaaagguauuuuuuuuuuuuaggccuacuaagaaaacaucuaaugaaaagaacaagguacuguaaaaaauaaauuaucaaaauuauuguuuaaaaaaauacauuauaaaagauaaagugggcugggcacaguggcucacaccuguaaucucagcacuuuggaaggcuaaagcgggaggauugcuugacuccaggaauuugagaccagccuaggcaacauggugggagcccugucucuacaagaauuaagaaaaaauuaaccaggcguggugagcaugccuguagucccagcuacuugggaggcugaggugagaggauugcuugagccugggaguuugaagcuucagagagcuauggucacgauacugcacuccagccugggugauagagcgagacccgaugucaaaaaaaaacaaaaacaaaaacaugaaauuaaaaaaaagagaaucuuuuguuguaaagacauuuacuuugaaaaagugauuaagaagcacuagcuguugauaaauaaauccuuuuaacaaaaaucaguucuuuuuaagaaauaccuguguuuuugcucauuuagaaagauggauaauuaccacuucuguaugugcuauaaauauucuggggacauuuugaaacaguguuauuuauuucauaggucaaaaaccaaauacagucuauggaugauguugaugacuuaacucagucaucugaaacagccucagaggauugugagcuaccccacucuaguuacaagaauuuuauguugcucauugaacaacuuggaauggaguguaaagguaggaccauugcauaaauuuaaggccuuuuuauguaucccauuguaauguauguaauguaauaaauguauguacauuuagcauacauuuugcagugcuucauugguggcuaugaugcugccacugugcaaagcugaagaguucuuuauaugauauauucuugauauuauuccuuuauuagcuauauuuuuugcagggauuuuuuucucccaguuuguggcuuaacuuuucauucucuuuuuuuuuuucauuuuaauuuuuuauuuuuuuguugacuuuucauuuuguuaaugguaucuuuugaagagcagaaguuuuuaauuuugaugaaguccaauuuaucuguuuaauuauggauuuugcuuuuuguaucgcauuuaagaagucuuugcauaacacagggucacaaagauuuccucuuaugcuuuuuuucuagaaauuuuauagauuuaggucuuuuuuuuuuuuuuuuugagacaaaauuucacucugucaaucaggcuggagugcacugucacugcaaccuccaccucccggguucaagcgauucuugugucucagccuccugaguagcugauaugauaggcgugugccaccacacccagcuuuuuuuuuuuuuuuuuuuuuguauuuuuuuguuuguuuuuuguguuuguuuguuuguuuguuuuuugagauggagucucgcucugucguccaggcuggagugcaguggcgcgaucuccgcucacugcaaggucugccuccuggguucacgcuauucuccugccucagccucccaaguagcuggaacuacaggugcccgccaccaagccuggcaaacuuuuuguauuuuuaguagagacaggguuucaccguguuagccaggauggucucaauugccugaccuccggauccacccgccuuggccucccaaagugcugggauuacaggcgugagccaccacgcccugccagcuuuuuuguauuuuuaauagaggcgggguuucaucauguuggccaggcuggucucaaacucccgaccucaagugaucugcccaccuuggccucccagagugcugggauuucgggcgugagccaccgugcccagccaguuuugcgucuuacauuuaggugugugauccauuuugaguucauauuuuuguauggauugaaguauggauucaaguucauuuuuuuggauauggacauauuguuccagcaucauacaucagaaaggcuagccuuuucccacugcauuugccauugugccuuugucaaaaauauguuggcugcguacaugugguucugcuucucgacucuguuguguuccauugaucuacagaugcuccugaguuuuaucucagguuuuuggguuuguuuuuuuuuugacuuauaagcuaugacucuuuguuuugcuaucuuagugguugcuuuaggauuuauaguauaugacuugaauuuaucacaguccaccuucaaauaauaucauaccacaucauauaugguauaauuuuguuauaguucugauauaugguauaauuauaauaguuugcuuucauuuuuuucucuccuggccauauccuuucugaaucugugggauuauaguuuuuauuaaguuuagaaaguuuuggccaauuuuucuucacauuuuuuuucugucucucuuccuuccucuuugggggcuuauauauuagcugcuuggauuuuuuuccguaguucauugaugucucaaaguuaugaaucuuuucuuuugugaugguuaaucuguguuuauuuucaucuaauuuaguuuucaucuuugacauuguaauuugcaucucuacaagugcaauuugguuuuuaaaaaauaucuuccaugccuccacuuaucuucuugagcuuuauuuugagguacaguugaguuacauauaaacagcuugacuuuuuccuauauugcuuuuaugauuugggcuaauuccccacuccugaggcaauaccuuucugauuauucauugucuugagaaguaugaguuuuuucagccugacugugggaaugaacacucuuccuggugcuguggaagcaccaggcaggauuuccucuccuuuuuuuaaugggguuuuuucuuugguuucagauaguuuccuagcauacaugcacuguuuauuacuuugcucaauacccaagaggggaucucuguagaucuccaggguucucuguaccucucgcuccucucuaguguccugugaucucugucuacuuugcguuuaccagacucucagcuucaucacuucaacucagggagucugcuggacuuuaugucaguuuuuccuccccgcaucaugaccuagaaacucugaaagcgggucucugggcauucauaagaccauaaaacuuacuuccuuuguuuguuuucuuuucuuuuuuuuuuuuuucugaggcagagucucgcucuguugcccaggcuggaguacaguggcgcaaucucagcucacugcaaccuccaccuccuggguucaagcgauucuccugccucggcccccccaaguagcugugauuacaggugccugccaccacgccccacuaauuuuuguauuuuuaguugagacaggguuucacuauguuggccagacuggucucgaacuccuaaccucaggugauccgcccaccucagccuccuaaagugcugggauuacaggugugacccacuacgcccggccacuuccuuuguuucuugucugucagggauccuuguguucauugccugaguccacucucuugaaacucguuguuucauguauuuugucuguuuugucuuuggucguuucaggaaagaaggaaaguuaguaccugaagcagacugcaguagagccucagcacacgcugcagacugccuggaaugcuuuucuuccccauuugcuuaacugcugccuucucguccuucauuucucaguguagccaccucucccucagggaaaucuucccuggacccaguauagaucaaauucucuuuuguggucauagaacucuguuuccuuacagcaucuaucugaauucauaauugucacuuuuuuuguauuuugucacuuuuuuugucuucacuauacuuuaagcuaagcaagugcagaggucuugccuguuuuaucuucagagcuuaguuuaaugucuuccacauuguaggcccucaauauguaauuggucagugucuuaaugagugaauguuauagugcacaguguguuauauggaaaaaugcucauauauuucuaucuuguuuucuuccugauacagauucuguuagccuauugaaaauccaggaugcagcucuuucaugugaaagauuauuagaacuuaaaaaaaaucacugugaacuacuuacaguaaaaauuaaaaaaauggaagacaagguuaauguacuacaaagggagcuaucugaaacaaaagaaauaaaaucacaguuagagcaucaaaaaguugaaugggaacgagaacugugcucuuugagguaugauagccuaguuuuaaagaaauguuuaacuauuuguacuaaagauauauagaauucuuguaauugcugacuuaucuucuggggcuuagcagggaagaaaacuucuuagucuuguggagugugaaauucuuggaaauaauauaacuaguucuuaacuaugaacuucuacuaaauauauauucuuuuaaaucacuuuaauggcuauguagaaguuugucguauggaagacucauuauuuaauacaguaaguuuuggguuuacaguuuuuuuguauuauaguuaaugcuggaaggaauaccuuuuuauaaaucuuuuucuacauuucuaauuauuuacuuugaauaaauucuucaauauagaauuauucguuuaaaguauaggaauuuuuuuuaaaaaggccuuugguccagauuuuuaaauuguucucaggaaaguuuaguuaauuuacguuucaaucaauagagaaugaaauggccauuuuuucaaccuaaauuuuuuuuuuuuuuuugagauggagucuugcucuguugcccaggcuggagugcaguggcgcaaucuuggcucacuguaaccuccgccucccagguuuaagcaauucucccaccucagccucacaagaagcugggauuacaggcgcacgccaccaugcccagcuaauuuuuguauuuuuuuaguagagacgggguuucaccauguuggccaggcuggucuugaacuccugaccuugugauccucccgccuuggccuccuaaagugcugugauuacaggcaugagccaccguucccggccagaacaauuuuauagcuuuacucuuaagaugcaugaauuaaaaaauaaaauggugagugauuacugaaagugaucucucucuaauacacagauaaaauucauucaaaguucuguguugaaaaugcauauuauucuuuacgguuuacuuaaauauuagauccuguuuuguuccaaaagagauuuuaaaauuguuuaugcaauauguaauaaucaagaagguaugucgaaaguguuaccagaaaaaagaaacauaaaaaguaugggguaaccaguauuaggcucguuagccuaaucuuuaauuaugcuauuauacagauauauguuguaugaaagcaucugaggguguuaucuuacacuguaauaauuuuuagggauacuugcaauauuucauaaaaacaaaaauauauuucuauuggauuuauaaacauuuuaguaaacuaacuucuuuuuaguuaguuuaaugaucuuuccuaauugaggaguaauuaugacuaauuaaaaaaagauuuuuuuuuuuuuuugagauggaaucucacucugucgcccaggcuggagugcaguggcacaaucucggcucacugcaacauccgccucccggguucaagcgguucucuugccucagucuccugaguagcugggauuacaggugucugccaccacaccugucuaauuuuuuguauuuuuaguagagaugugguuucacccuguuggccaggcuggucucgaacuccugacuucaagugaucugcgcgccucggccucccaaagugauaggauuacaggcaugaacuacuggcacccagccaaaaagauaauuuucaacuugcaucuuuacugaaucauuuccaauaucuuuuuccauaauauuuaucagagguacucauaacagaaacuuaccaguuagcagaauguucuuucaucacuaccuuucaaguauauauguccuuuggaaaagacugaagugagaaauuaaaaaucagagaacuagaaaggaaaaauauucaagaacauagaaauuguauuaggguaauaaaccaacauacaaagcggcauaucacacaaugaacuuuuuauuuuguaacaauacagauuuuaagauaaacauauuuaacugcagauuuagcuuaaaccaagaagaagagaagagaagaaaugcugauacguuguaugaaaaaauuagggaacaguuaagaagaaaagaagagcaauauaggaaagaaguugaagugaaacaacagcuugaacugagucuccaaacacuggagauggaauugaggacuguaaaaaguaauuugaaucagguaaauuaauuuuugauaaaaauuuuauauuuuuaacuuuauuucaucacuauuaucacauccuuuugauuuaauauauguuaucuagguuuaaaacaaaacuguuaucucaagcugaccugugaccuuuauaacuaaaauuauucaugauaaaucuuggcaccuaauagaugcuuagucucuguuuucugaaugaaggaauggaggguaaguugaguuuaaucacuaacauaaauguuaauuuaggcauuuaauguuaaaauacaggcuaaauagcucuaaaauuaugaugaaacuaguaaaauguuuugacauuuuauuucacaauucuauauuugccuguauuuauuaagaaccauuuuugcuuuuugauuaauuuagcugucacuuaggugauuaaaauuugaguaauucuugaguaauaaagguucuugcauuuuaaugugcuauuuccuuuuuauaaguuuuuuguuuuaaaauucugcucuuguuaaccuuuuagacuuuuacaaaaugcuaauagaccuaaaacuuaauguaucucuaggucguucaagagcgaaaugacgcucagaggcaacuuucucgagaacagaaugccagaauguuacaagauggaauucugaccaaucaccuuuccaaacaaaaggagauugaaauggcucaaaagaaaaugaauucugagguauuucuauuuccuuuagucauuuucaaauauguguguauauguauuuauauguguauauauuuuaaaaaccaacuauauaugcaucuuggaaagugucgaggauuuuuaaaccauauauguguaucuugggguagugguaguguuuuugguccauuggauaaagugauguucuuaauucagcuccacuugucugcagcagucaaguaaugacauucagaauggccucauccaaaggagaagcuuuuaauaauaucuuccguaagaauugauggucuuuccacaaucucaaaacccuugcuacuaacaauagaugcuugagauuuuggaagugauuucaucaccuugauauauuaauggagagguuaguuuauugcuucuacccauaggaaaggaggaaaaguacagccaguucagugacauauuuuggauguuauucuucucacuguugagaagaguaaugguuuacugcaaguaguaucuuauuuugguacaaagagcuuuugaaacaaugauaugccaugauauauaguuagugauaauuuagugauaaguauuuuguuccuaguaaaacaguucagcauauuucucccuguuucacauuauuacauuuucaaacauuaugaagaggaaacaaaaguuauugcgacaacaaauaaucucgugauuuuccaagaggaacucuacaaauuuuguccuauuuaccauuaguguuguaaaauaaaaggcuucuuuuguauuuaaauauuuauaccacagaaauaacugauuuagugaaagaacacuauaaauagagucagaagacccagggaaaaucauacagcugcuuuuuuuuuuuaacuuuuccuuuucaaaacugugauacuaaaugaguucauugauauauguagaagugcuuaguacaaugccuagauuuauuauucaucaauaaacguaauugauaacugacuauaaagaugugagaaaaguagaguaucuauagaauaugcucagaaaaaaggaacuugaaaaacuucaggaaauuucgucuguccaaauauauguagagccaaggcucuuacuauggguugguguauggguuagauaucagaguauaaacccaauuuuuuaauguggucaaauuauuaaucuuuuaugcuuuugaauuuguuguacuucaguaaaaggccuuuccaauucugugauucuuaaaaauuuucuagugguuucuuuuuuacuuucauggauuaauugucuucaaauaaauuuuugaacuuuugggaguuuaugcucuauacgguuugaguuuugauccaacuuuuuuuuuuucaauuggauauacacuuauugcaacccuuuauuguaaaauguacaguuuauucuuuaauuucagaggaaaucaugaucugucauuuucuugggugcuagcucaaaguuuccuuuguuuuacuuagaauucucauagucaugaagaagaaaaagaccuaucgcauaaaaauagcauguugcaggaagaaauugcuaugcuaagacuagaaauagacacaauaaaaaaucaaaaccaggaaaaagaaaagaaauguuuugaggaccuuaaaauuguaaaagaaaagaaugaagaccuucagaagacuauaaaacagaaugaggaaacauuaacacaaacaauaucccaguauaauggacggcuuaguguucugacagcugagaaugcaaugcuaaauucuaaacuggagaaugaaaagcaaagcaaggaaagacuggaagcagaaguugaaucauaccauucuagauuggcugcugcuauacaugaucgugaucaaagugagacaucaaaaagagaacuagaacuugcuuuccagagagcaagagaugaauguucucguuuacaggacaaaaugaauuuugaugugucuaaccuaaaagauaacaaugagauucuuucucaacaacuauuuaaaacugaaaguaaacucaauagccuagaaauugaguuccaucacacgagagaugcccucagagaaaagacuuuggguuuagaacggguacaaaaggaccuaagccaaacacagugucaaaugaaggaaauggaacaaaaguaucaaaaugaacaaguuaaagugaauaaauacauuggaaagcaggagucuguagaggagagauugucucaacuacaaagugagaauauguugcuucgacaacaacuggaugaugcccacaacaaggcugacaauaaagagaagacagugauuaauauccaagaccaguuucaugcuauugugcaaaaacuucaagcugagagugaaaagcaaagucuucugcuagaagaaagaaauaaggaguuaaucagugaauguaaucacuuaaaagaaagacaguaucaauaugaaaaugaaaaggcagaaagagaaguaaguaucaagaaagauaaauauuuuucaaaccuccugaaagaaaauuuaaaauaauauauaguuauguaguuaacuauaaaaauaaauagauaagcuuauuuacucuaucaguuuagaaacaucccuuguuuucagcaaauaaaagagcugagagaugcuuuacuuugaguaaagauauuguaucaucuaugaaauuuugaguuuuaaguuaugaauuguuauagacuaguaugaauaguaaacuaaugugaauaauguagucuuuuacugcugaaguaauaauuuuagugucuuuauguugccacaucuuaagaacauuuccauuugucugccaccaugaaacagauaaauggaaaugcuuauaccugaaaugaggauuuugaaguuaagguucaauuaaguguguuauuuugacaguuaauuccagauuuccagauaaacugaaguauauugcuauaucucuuaauacuuuucugucaguagcuuuuuauauauuucaguugaugugauuuuauuuuuauucuugucaauuugacuugucuaaaaauauuucaaucucaaauuacauauuguuaugaucucucaauucuuuaaagcauguacuuuuuauuaaaccauaauuugggacaaaugugaauuuuagcaaccauauuugacuuaaucuccccagugguauuuauaauuuacuuugaauauauuaugagcaaauaauuugcucauaauuuucauuucagugcccaaugacuaucauuuggguauaacuuuguucaguauaaagauaaguaaguguagcgauuugugauuuauuaguuuggcauuggaccaccauuuucacacuaaugagggguggcaggaugcacaggcagcaagaauggagugaguaggggagagucauagcagccgaggucagggaggcaaguggaggccagguuaccuagggccucuaaggccauuggaauuuaccuguauucugagauaggaaucuauuggaauaauuugagcaagcaauuaaguaucugaggagcucugaaguugauuugauguucuaauaaaaaagagcaaaaauguuucauaggguacaauuaaucacuaccaguuccacucacauaacuauuucgagacuucaguagauuguuaagcaguguaaauucauggggggaugaaugaauaaugggcugaaucuguuguuuaaguaacgucauaccuaauuggcaggaagauaacaccuguguccuuaacugaauucaguaauaaacagcaauguguacauaugaggacaagaaggugaaucaauguaugugguaauauuuuuuaaguuguauaugucauaguuaaauauuauuaacauaauuuauuuuuuaacauaacuuaauaauaaggugauuuauaaaaucaguaacaaaaugucuuaucagguuguugugagacaacuucaacaagaacuagcugauacccuaaaaaaacaaucuaugucagaggcuucacuggagguuacgucacguuaucguauuaauuuagaagaugagacacaggauuuaaagaagaaauuaggucaaaucagaaaucaaguauguaugaaauuuaacaugucaaacaguuaaucuauaacugguuaaauauauaguguuuuaucauacuaauuuaguggguagccuucuuuuguguuuucauuauaauuaauuuaaauuuuauuaucuuuuuuuuuuuuuugagauggagucucguucuauugcccaggcuggagugcaguggcacaguggcgcgaucucggcucaaugcaagccccaccucccgggcucacuccauucuccugccucagccucccgaguagcugggacuacaggcaccuaccgccacaccuggcuaauuuuuugugguuuuuuuuaguagagacgagguuucaccguguuagccaggauggucuaaauuuuauugucuuuauaauacacuugcuucuuuauuuauuuguuuuuuuuuugagacagagucucacucuguugcccaggcuggaguacaguggcacugucucagcucacugcaaccuucaccuccccgguucaagcgauucuuuugccucagccuccugaguagcuggcauuauaggugugugccagcaugcccagcuaauuuuuguuuuuuguuuuuuguuuuuuuuuugagacagagucucgcucuguagcccaggcuggcgugcaguggcauaauuuuggcucacugcaaccuccgccuccuggguucaagcaauucuccugccucagccucccgaguagcugggauuacaggugcccaccaccacgccuggcuaauuuuuguauuuacaguuagagauaggguuuugccauguuggccaggcuggucucaaacuccuaaccucaggugauccaccccccucggccucccagaguacugugauuacaggugugagccaccgcaccuggccuaauuuuuguauuuuuaauagagaugggguuucacccuguuggccaggcuggucucgaauuccugaccucagguguuccaccugccugggccucccaaagugcuaggauuacagaugugagccaccgcacccaucuuguuuauuaaacucuuucauucugccauuuuuuucuuauaauugcacauuuuuaaaaauaauauuuagucuuaggaaaguugagaauuauacaucauuccucauggaaguugagagaguuuuuuccuguuaaacaguauuuuauagugauuuuucuauugucauggcaagccagauuaaguuagaggauaauguuuaauggaauguuccagaaaauugucuuauuucuuauuuucacuuuugugaauggauacagagucuguguugauuuauuuuauggauuucaaauuaauuuguacagaaaggccauuaacuuuucuccaaaaugcaaauguuuuagguuaauuuauaaacuauuugaaauaggcauuuccuucauuuuccuuucauuuaaaauauauuauaaaaacauagaaauauuuagauuauguauagcauguacaucuaaacuagagaauuaagaaaauuaucuagaucccuccacuggauuuuuaaagaacauuauugagauauaauuuauauaccauacaguucacucauuuaagguguacaauucagugucucuuagauuauuuacagaguuguguaaccaucaccacagucaauuuuagaacauuguuaucacccugaaaagaaaccccacaucccuuagccaucaccaccaucccuguccaugucccuccaccuucuccaauccuaggcaaccaccaucuacuuuuugucuccuuaaauuugccuguucugaacauuucauauaaauagagucauacaauaugcagucuuuuaugaguggcuucuuuuacuuagcauguuuuugggguccaucuguguuguagcacauaucaguacuucauuucuuuuuauugucuaauaauauucuauuguauggcuauaccaguuauccauucaucagcggaugggccucuagauuguuucuacuuuuuggcuacuguaaauaaugcugcgaugaacauucauuuauaagacauauguuuuuauucuccugccacuggauuuuaucuucagaguuaaucaggcugcuuucaccaucucucugcuugacuccugcuguucuuccugccuuugcaguuucuguucaucuagccucauucauucagaccuggcacacaauucccccuccuuucggaagcuuucucugacuguucuggaucucauugaccucacauuuuagcacucuuugucuagucuguguagaacaauuugcccuuaauuuaacuucacuuuuauuuuuuuucauaagagagaaacuugucuaauuauaaauuugccuacgaggugaauaauaucugauaugccugucaccuauccuuguauaaauugaaaauauuuuagcuuagcaauuguuagguuaaaauuacuuuauauuauacuaagaauuucuucuuugagacauugauauaauaaagcuuuuauucuauuuuuauuauuuuauuuuuuuacaaggccacagcuaacauaggugguuauucuaaauauauuuuaaguaauuaaauauaaguagaaaccacuuaaucuaguaaaggaaaguuauucaaucaaaugcucauguuuuucacccugaaaagaaaucuacauuuccauuucuuuauuacguagccagagcugggauccguagauucauaccgcuuucccacccaaagagcuccagcuuuucuccuacaccguacgacauaaccuuagccuuaagcccaccagagugcucgcuaaagcagcucagcauagacaguuguugcaaaugacuugauuugggaaccuuguuucgcagcagaguccaguguuuucaguccagugcucugauggccauguaaguuauguauuacuuauuccaggaggugcuguuugcauuguggucauugcccacugaguaaagcagagagaaaguaaucuauaauuguuuaaaguacugucggcuuaguggaauuggcaaaaguucugugaaguacuagggguguauucugggccucaugcuccccauuugcuuucacuuucaguggugugaagaaugauucagugcagcuauaguagaccacuuccauuggcaugccaucugccuaaaauauacaauuuuauuagaacauaaaauacaguaaaaagaaucacacaaacagcaaauauuauauauagcucacuauaugccauguacucaucuaaguacuuuauguauauauuccuugacugaaucuucuuaccaucccagugaaguaauaguauuacugucucuguuucuauuuuaccacugaagaaauugagacacugaauguuaauuugcucaaggucacacagcugguaacugguggagcugggauucccacccggccauucccgcuucuguguggauacggccucucaguuucaugaauaucuaguugucaccuaacaugucaucauguuaauuuuuauaaucacuggcauugccauggucauucacaucuauaaauauuuaaacuuauaguucaugugguggugcuuggaaugcaaaaauauaaaugcuuaucguaagguaauuuccuaucuuucuacauuuuaccaaguuuguaaauuugaguauuuaucugauaaaauauaguuugaaaacaagaguaauauguuuuaguucuagaacgcagguugauaaacuuuucuguaaagggccagauaguauuauuuuaggcuuugggagccguagauaccaccugcugcaacagaucagcucuacagucacagcacaaaaguagccauaaacaauaugcauauugaagggguaugacuguguuccgauaagguuuaguuacaaaaacagguaauggacagauguguacuagauuauuaguaaaguggguuuuuuuuauucuuuguuuuaguugcaagaagcacaggaucgacauacagaagcugucagaugugcugagaagaugcaagaucacaagcaaaaguaaaauuuaaagcagcacacagaaaaacaugauuauuuauagagcaaauaagcaguguaguaugagaauuauaucagcuaugaucauaaguacaucugugugaagucaaggaaaaauuucagcauuaagcaauuuugaaaugcggauuuuuuuauauuauccuagaauuuugugcauuauccacaaaccacaacuagaaaaacgauagaguugccaaaucaccuacuuuugaaaucuuuaagaauuuauguaauuaugccuucagguguuugcuaagaaauuacacaguauuuuaaaaauuuaucugugagaauaauuauuuuaaaauauacauuucaggcuugaaaaagauaaugccaaguuaaaaguuacagucaaaaagcaaauggacaaaauugaggagcuucagaaaaaccuguuaaaugcaaauuugguaagucagccacuuaauuucugucguacugaaaaggaauuuuauugcuuuaguaggacaaguugaguaucccuuauuuaaaaugcuugagaccagaaguguuucagauuuuggauuuuuuuuuauuuuggaauauuuguacauacauaaugagauaucuuggagacaggacccaagccuaacaugaaauucauugauuuuucauauauaccuuauauauguagccugaaguuacuuuuauguaauuuuuuuuuuuuuuuuuuuuugagauggagucucacucugucgcccaggcuggagugcaguggugcgaucucagcucugccucccggguucacgccauucuccugccucagccucccgaguagcugggacuacaggagcccgccaccacacccgguuaauuuuuuuguauuuuuaguagagacaggguuucaccguguuagccaggauggucucgaucuccugaccucaugauccgcccgccucggccucccaaagugcugggauuacagguaugagccacagugcccggccacuuuuaugaauauuuuaaaaauaauuuuaugcaugaaacagaguuuugacuguguuuucacugugacaugucacaugaggucagguguggaauuuuccacuugugacauccuguccacacucaagaguuucagauuuuggaacauuuuggauuucaaauuuucagauguuccuccacuuaugaugggauuacauccucauaaacacauuguaaguugaaaauauuauaaggugaaauuuaauacaccuacugaacaucauagcuuagccuagccuaucuuaaaccugcucugaacacuuacauuagccuacaguuggacaaaaucaucuaacacaaagucuaucuuauaauaaguauuggauaucucauauaccacauauugcuagccugggaaaagauaaaauucaaaaucugaaguauguugaaauugugaugguuucacgccauuauaaagucaaaaaguuguauuaauaaguugacccaugguaaguaaauccaaauuguagugguuucacacacucuuaaaguugaaaaauuguaaguugggcuauuguaaguuggggacuaucuguauguaagaauauuuuagauaauaugaaaauccuuauugauaaaaauauuuauuguauucaugguaauacuacuugcuacuaguagugcaaguccucuugacuuuauagaaguugacugaauucauaacauuaaugaguuugguaguaagauuuuaauaaaaaagauuaugauagacuaaaaacaguguuuuuuauauacauuuuguuuguucacucauccauugauggacguucggauuauuucugccuuuugcuuauugugaauaaugcugcuauggauaugguguacaauugucugagucucugcuaauauuuguaauaucuuuugaaauucuaagaaauuugaguagugacuugaucuacaauucugaauuucuuuuauaaucuaaacccuucagugagaauuucagaaugaauugcuuuuaacaugguaguuuuuauuccucaucaagaauggauacuaugucauuauacaagcauucuuuucccccaaaguaauguguuuuucucuuuggauuuuaaaaaagaaaaaccugugaaaaaguagaaauggcugcuccagcaggacauuacagaauaacacagugcuccuagcauugcagauucagaaacuuuuuuucccauuuaucuguguucaucagucuuucaaaaccuuaacaguuccugucaggcgcaguggcucaugcccagcacuuugggaggccgaggcggguggaucaccugagguuaggaguuugagaccagccuggccaacauggcaaaacccugucucuacuguaaauacaaaaauuagccaggcgugauggcaggccccuguaauccuacuacucaggaggcugaaguaggagaauugcuugaacccagaagguggagguuacagugagacgagauugugcuauugggugacagagugagacuccaucucaaaaaaaaaaacuaaaaaaaaccaaaaccuuaacaguccagucucagaaaggauggccguguaauccacaauaccaauuuauugauguaccaauuuagugauuauuuauugauguucugcuugauguuuaacaagcagaacaggauucucuggucauucacacuuuccuguguagaaaugaagaucagaagguugcauuguaaauacuaaaguggagcaaugagguugaugcuucuacuaaugaguuucuuuaagucacaacaggaagauuuaugcuacucuccuauacagauacaccuaucagaagaaacauugacaaguuuuuuuucuagauuucauguguuaguccuacuuuauuggcauccuuuucacacaagugacaugacaauauauugauaugaagucuccugugaaugagagugugggggacauccccuuauauggaugucauccaggaauauaucaacaucucagaaauggaaaauuuaguaaaaguacucaaaaccugcuaagcuuauucaaaaauaaugggggauuuucuguagauucccauagaaaugaguuaggaauauggcauauaauuauuagucacuuugaaauguacacugugaaucaaaaauuuaauagagaccgcuuucaaccaacucaucaauagccccuaacuuuuccagaagguucucaucucaugucuuuauggaaaagggaauuagucaaaagaaagcaaaggcaaacaaucaauaaucugacccuuguggaaaaguuuugcauuaugaaagaaaaacaaagacaaaguaugcuggucaacauccuaagggugagugugcccacacaagaugagaaaauaacacuacacucaaaauaacaccaauaagaaucaacauaaaauguacaagauuagcuaccuacaaaaggaaucugcaccaaguaaugguuuaugagugugugguugagaauaugguuuaugagaagugaaacagaaggaagagaccucaggaaagaggucugggcuggaaaucuagauuagggaaucugggaugaagccuugagauuuaaggagcucuuagagaauuuaaaaaagaggaauggaaggggacaggacucagcaugaaggguugcugcauuuagaaaugaagugaggucagagacgccuaggggaggguauggucacugauaguaguugcugcugagaaguaaagcagauuaaagacuaaaaaauagggccuugaugacuuucagaauuuuaaaaugagaauuauaagacugaaaauuagauuuuaguauaaaagaagacaagugaugaagaaguagaucucuagaugagaccguguauuaaaaaauauuagagccugaugagcacaguggcugacaccuguaauuccagugcuuuaggaggcugaggcaggagaaucgcuucagacuaggaaucaagaccagccugggcagcauagcaaaacucugucucuaaaaaauaugaaauaaauuagccgaugugguggugcaugccuguuauccuagcuacugaggaggcugaggugggaggauugcuugagcccuggaguucaaggcugcagugaacuaugauugcaccauuacacuccagcuugguugacagagugagacccugucacagacaaacaaacaaacaaacaaaaaagagaguccaauggaaaaacagguugauuaaaaaagccacaagaaucaggcaaaaguuauguuuuuguuuauuguggagaagaaaaacuuuauuuaaagagaaaugguuaauagaacaggaaaaauugaaacccauagaagaauguuuauagagaaugagagauagcucaucuugaagucaggugaguauaaaaaauguaacgggaaccagaugaaaguuuucuaaaaauugucuuaguaagauuugauuuaacaaaaacuggaauaucuugaacuacugaugacaguguuucuagagcaacuucagaaaugagaacguacaucuaaaauaacuuuuuaaaaaggaauuuucauuaacacuuaguauuuuauauguaaaaacuucuauuuuuaacaaauuuugguaauuuaaauuccagaaaagagauaugagcuguuuuaagaaaagucauuuuuucaaauccguucuuauugccauuagguuuauaaacugcauuuuauaugccuaaacauauguuacucaugaacucauaagaaauaauaguuuuaagaaaaaaaguguuuccagaguuuuaaaaguaauugaaaauauuuuguuucaaagucugaagaugaaaaggaacaauuaaagaaacuuauggaauuaaaacagucacuggaauguaauuuggaucaagaaaugaagaaaaauguugaauuagaaagagagauaacuggguaagauuuuaauauuucagaucauuuuaaccauucauuaauugauuuaauauaauuuuacuuuguucaaaacuagauauaaauucauuuaauaucuacuuuuucuuaaugaaauuauucucuuuuaaaaugguuuuagaaaguugcagcacaaucugaaacuuuuggaaugccuaaauauuacacuuauucuuuaaugauuuugaaagcaguaacaaugccuuuggcauauaaugucaacugcacucuucaucuuuuacuuugaacuuuuauuucugaagauauuuucacuuucuuugguaaucuuucucucuuugguaguguccuucccuucaaagaagauauucaaaucuuuuaauaucuaaaaaccuaucugugucauccuuuggaagcaucaaaaauuaucuugauuuagcuuaugcuuucuuucugccucuuuguguguguguguguguguguguguguguaguaauaaaauauaucaugaaaauuuacucauuucccauggauaucccccauguauaccugagguauacauguuauuaaacuucuguuuguuuuaaaacauauaugccucauacauauacaaaaguauguaugauuuaagagugaaaugagcaaucauguuucuacuauccagauuuaaaaauggaauguuacccauugccuuggaagccccuaacauggcugcuuuucuguuuauuugcugaguacuuacguuuguucugauucuaauuacuauuuuucucucauugucuuucucuaacgugguuuggcaucccuuuuacuuuguuaacguugugcuaguaaagauuucuggaucucuucugaaagcagccuuugugucuuuauacaugcuuucucugcucauuuccuuucuucuaaaacucugccuguuuccuuuuccccuuaacucagacgucaaaaauguuucuuuccugucucuuaucuacuuugaaugaucuugauguuuuuuguguguacuuucuuuuuuuuuuuguacuuuucuucuuauaaacaguggucaacggauaucaaauguauuuuugugucuuuuucaaccauucauguauaaguauguguaugcuuuucuuuucuuuuuuuuuuucccuggaaucucucuguugcccaagcuggagugugguggugcagucucggcccacugcaaccuccaccuccuggguucaagccauucuccuggcuccgccucccaacucagccuccugaauagcugggauuacagacaugcaccaccacgccuggcuaauuuuuguauuuuuaguagagacaggguuucaccauguuggccaggcuggucuugaacuccugagcucaagugauccgccuggcucggucucccaaagugcuggaauuuuaggcaugagccacugguccagccuaaguaugauuuuccucuucaccuuggacucugaucucugguuuauagcuaauauuugauaauaaguuaauguuuuauauuaacauacuaaaauggauaggaauaauuuauuuauaaaaacuucaugugauuuuaauguuaacucuuuaucugccauauaugucauauaauuuuucuucacauuauuuaccuaagauuauaauuucauuagaguguuuucaaacuaugucagauugaaauaaacgagagaaucaugauucauuuguuuuucuuacaugcuaaaacauaauaucuguuuaaauaauuauuaaauguuugccuuuuuaaaacuugaguuacucauuuuguaccuuccugcagauuuaagaaccucuuaaaaaugacaagaaagaaguuaaaugaauaugaaaauggagaauuuaguuuccauggagauuuaaaaacuagucaauuugaaauggauauucagauuaauaagcuaaaacauaagguaauuuuuaauaaguuuugggaccaaaaaagucacuuaauuuugggaaauauagacuucucaaugcuuugaacagugaaauaaagauuuuuuuuuuuaacuuuagggacuugauacuaauaaaaaaacuuuuuuuaaacuuuuaaguucagagguacaugggcagguuuguuauguaguuaaacuugugucacggguguuuguuaaacagauuauuuugucacccaaguauuaagccuagugcucauuaguuauuuuucuugauuccucucccuucucucacccuccauccucuaggaggccccauugucuguuguuccccuccgugugucccuguguucucaucauuuagcucccacuuaguagugagaacuugcaguauuugguuuucucuuccuguguuaguuuacuaaggauaauggcuucuagcucuggacauaggaacagacaaagauuucauggccaagacaccaaaagcaauugcaacaaaagcaaaaauugauagaaucuaauuaaacuaaagagcuucuacagagcaaaggaaguaucaacagaguaaacagacaaccuacagaaugggagaaaauuuuugcaaacuaugcaucuaacaaaggucuuauauccggcaucuauaaggaacuuacacaaauuuacaaggaaaaaacaaccccauuaaaaagugggcaaaggagaugaauagacauuucucaaaagaagacauacaugcaacccaacaaacaugauaaaaagcucaacaucauugaucauuagagaaaugcaaaucaaaaccacaacaagauaccaucucauacuagccagaauggcuauuauuaaaaagucaaaaaaauaacaaacuauucaucugacaagggacuaauauccagaauauacaaggaacucaacucgacagcaaaaagaauauucuaauucaaaaguaggcaaaaaaucugaaacagacauuucucauaagaagacauacgaaugaccaaaagguauacggaaaaaaugcucaacaucacuaaucaucagggaagugcacaucaaaaccaccaagugauaugaucuuauuccaguuagaaucgcuacuaucaaaagacaaaaaauaacaaaugccagcaaggcugcagagaacagggaacucuuagacauuguuggugggaauguaaaguaguacagccauuauaaaaaacaauguggaguuucuucagaaaacuaaaaauagaacugccauaugauguagucguucuacuaccagguauuuauccaggagaaaggaaaucagcauaucaaagggauaucugcauucccauguuuauugcaguacuauucacaauagcuaagauguggaaucaaccuaaauguccauagacaauggaaaagaaaauaugguguauacagauacauaaaggugaaaacaacagacgcugagguuuccaagaaugcaggaucugugccaagaaauguguucagaaucugggugacaggaucaacagaaguccaaaccucggcauuuugcaguauaguaacaagccugcauauguacccuuucaaucuaaaauaaaaauggaauuuuuuuuuuuaaaggaaaagauuugguggcuggguacgguggcucaugccuguaauuccagcauuuuggaagccaagguaggcugaucaccugaagucaggaguuccgagaccagccuugacaaaauggcaaaaccccgucuccaccaaaaauacaaaaaaauuagcuggacauagcggcacacgccuguagucccagcuacucuggaggcugaggcaggagaauugcuugaacccuggaggcggagguugcagugagccaagauugcaccauugcacuccagccugggugacaagagugaaacucugucucaaaaaaaagaaagaugugguguauauacaggauggaauguuauucagccaaaagaaugaaaucaugucaguaacauuauguuaagugaaauaggucaggcaaggaagauaaauaucuaagguucucacucguaugcaagugcuaaaaagaaaaccgagcucauggaaguacagaguagaaucauggguauuagaggcugggaaaagcaggagggaggagaggcaggcaaaggggcggggaagggaggagguguugggugauggcuaccaaauuagagcuagcuaggaggaaugcauuccgguguucuauagcaccacagggcgaauacaguuaaauauaauuuauuguguauuuucaaaaagcuaaaaagaggauuuugaauguucacaagacaaauaaaugauaaauguuugaggugauggauaugcuaauucgcuuauacauuguauacaucuauuaaaauaucucucuagccauaaauauguacaauguugugugucaacuaaaaaggagaaaauaauucaucccaugauaaaauagaacaugggccaaacucagugacucauuucuaaugaauagaaugugguaaaggugacaacaugugacuucggcauuagauuagaagaggcuuccuaucucagacuccuugccguuggaacccagccccgaucuugugaggaagcucaggacacaaaggcagccuaggaguuccagucccucaggcuuugagcuguguccagggaaccugaggggaacagagacaagcuguccuggccgagauuuucccaaaccacagauuccugaacagaauaaauguuguuuuaagccauaaauuuuggguacuuuguuaggaagcaauaagcagaaaaaauguauuuuacaaaaagagacaauaagaaacauaacuuacacaggaaaaauuagucucauuuaaaguagaaucugauaaauguugagauuaauuuauucauggcaaacaauguuaagcagauagccaggagaaagacguaagagcuauugaggagaaaguuuuuucuccagauuuaaaggucuggaaucugaacucuccaaaauaaaaacuucucaagaagacuuuaauaaaacugaacuggaaaaauauaagcaacucuaucuagaagaauuaaagcuucuagauagagggggacuagaaucuucugguuugugcacuaaugugucugguugcugaugguggccauuggcuggaacuuugguuggggcaggaacccugagcaccuacucgaauaguuugcaaauagugucucccauucuacagauucucucuucacucuauuaauuauuuccuuugcugugcagaagcuuuucaguuuaauauugucccaucuuuauuuuuuauuacuauuuuuuaaaauuuuauuuuauuaauuucuuuuuuuuaacccaggcuggagugcaguggcgugaucucagcucacugcaagcuccgccuccuggguucaugccauuuuccugccucagccucccgaguagcugggacuacaggugcccaccaccaugccugucuaauuuuuuguauuuuuaguagagaugggguuucaccguguuagcuaggauggucucaaucuccugaccucgugauccacccgccuuguccucccaaagugcugggauuuacaggcucagugagccaccgcaccuggccaguauugucccauuuuucuauuuuuguuuuuuugccuacgguuuugaaaauagccauaaaaucuuugccuagaccaauguccugaagcaauuucccugucucuucuaguaguuuuauaguuucaaggucuuacuuuuuuacaucuuuauucaauuuugaguugauuuuaguauaugguguucgauaggggucuaguuucauucuucugcauguggauauccaguuuucccagcacuauuuauucaagaggauguccuuuccccaauguauguucuuagcaucuguuuaaaaucaguuggcuguaaauacacgaauuuauuucuagguucuuuauucuguggccuuaacaccaauaauuauuaccccuuggaaugcaagucaaauuagcauaaaacauuugcagcucagaaaaaggcuuauggcauuagaaucuauauuacaagauucauuaauuagagucuuauuuuaaaagucuuauucugggagccuuuuuuuuugaugaggccuaaauaacucaauaggauguccgaaaacuucuuuagaaauuauagggcauguuggggcugggagcaguggcucacaccuguaaucccagcacuucgggaggcugaggcaggcagaucaugaggucaggagauugagaccauccuggcuaacauggugaaacccugucucuacuaaaaauacaaaaaauuagccgggccugguggugggugccuguagucccagcuacugaggaggcugaggcaggagaauggcaugaacccgggaggcaaagcuugcagugaguggagaucacaccacugcacuccagccugggcgacagagcaagacuaaaaaaaaaaaaaaaaaauuauagggcauguuuaugggggaaguaguaagacuuucugcuaccccuuagagccauuuaaggaggaaagacaugaaacaaucauagaaaaauacaagucgaagaucaagugcaaauguuguguggcagagaugauaaaaauaaggaauauauuuuugugacuccugguggcuuugacuuuguucuugauuuucuggguaauuuaaggguccacauuugaagaaucuuuuaugguucaggugacauuuuauugcaacugaauuuauuucaaaauuuguucuugguuuuauguuaggcuauucucaggcuacuuccuucauuauuacacuauauuauugucuucauucagauugaugaucuuacagcagaacuggagacugcagguucaaaaugucuacaucuggauacaaagaaccaaauucuucaagaggaguuguuaucuaugaaaacaguacaaaagaaaugugaaaaacuacagaagaauaaaaagaaguuggaacaagaagugaucaaccugagaagucauauagaaaggaauaugguagaacuuggucaagucaaacaguauaaacaggagauugaagaaagagcaagacaggaaauagcagaaaaauuaaaagaagucaaucuauuuuuacagguuagcuuauguguagugugccuuuguucauuucacugcaaauuguauuuuggauauauacauuauauguguuuccucuacaucccuuauagcaauuuguucuguagauuucuagaaggaugauggcaucuguuucucccuuuagauauuccaguuuccaucauuauuauaacuaaauugaugauuuagaauaaugauuuucaucagagaauuauuugacuauuaagaccaguuggcauaaaacaaaaccaucaggaaaagaaaguauugugauuuagaaauuauaccauauucuugaauuguucuuaaauuacauugcucacuuuuuaaaauuuuuaauuaauuuuaucuuuaaauuaucagaguucaugaguacuaaugaaacaaugauucaaauguuuauaccucagccuuuggauagcugggacuacaggugcacaucacgaugccuggcuaaauuuuuaauucuuauuuuugguagaaacagagucuugcuuuguugcccaggcuggucucgaacucuuggcuucaagugauccuccugcuuaggucucccaaagugcugagauuacaggcaugagccaccaaaccuggcugauaaauauuuuaaacuucagcuuuuuuuucacauauuuaaaauuacucucugaaucacuaacucaaaaguaaaggaaaaaaauacacaauaauuacccagguuuuauauaaauuaaauuuuauuaagggauaauuuacaaauaauuaaacacaaccauuuuaacaguuugacccaaguauauacuugcuuaaccacccucucaacagagaacauuuccagaaaguucucucuugcccuuuugcaguuaauucccccuacuucaucccaggaaaccacugggacuuuaacacaacuuguguuguuuuugccuuaaaaaaaaaaaaacaaagcugggcacgguggcucaugccuguaaucccagcacuuugggaagccgagguggacggaucacgaggucaggaguuccagaccagccuggccaacauagugaaaacccauaucuacuaaaaaauuuaaaaaaauaaucagccaggcgugguggcacaugccuguagucccaguuacucgggagacugaggcaggagaacugcuugaaucugggaggcggagguugcagugaggcaagauggugagagcuagacuccgucucaaauacaaaacaaaacaaacaaauuaggcugggcaugguagcucacaccuguaauccuagcacuuugagggcugaggcgggaggaccacuugagcccaggaguucaagaccaaccuaggcaacaaagugagaccccaucucuacaaaaauuuaaaaaaguaauuagccaggcaugguggugcauggcuguagucccagguacuugggaggcugaggugagaggaucauguaagcccaggaguuuucaaggcugcggugagcuaugauugugccacugaacugaagcaugggcgacagacugagacccugucucuaaaauaaacaaagccaaaggaaugucuuuccucucuuacccacauggguauaugagugugugagugugugugugucugagugagugauaaaaaucuacuuaauaacaugaguuugugugucuaugagugauuaaaacucaauaauuuaacaaauuuguuuuaguugggauaaagagcgauugagaacugcgugggaccccugugcuuaugagagaggauggagggugcaaacugguggaaaggaugugaaaauuaacagagaaauuucaacugggccacuugaaaauauguagccguugugagaguagaaagucuucacuccucauucucagcucuuucccuucccucaggcuagugagagauaggagucuuggaacacaaucuacaaggccaaggugguaacaauccaugauaacacagauuucuucacaugguauuuaugauagucuuacaaagcucugcauguuagcucuuagagacauggaaugagaauaggaagaaaucuuagugauaagccaguguaguuucccauuuuacagaugaagagaccuagggaaagguuaaacagcagggcccaagccauagagcuagucaggcucaggaucacacuccacauuccuuuacuuguaguccaggugauuccauaaccuuaugcuccagcagguagaauuacuguaagagauccaacaccuugggcuuuuuucucagcauguauugaugcgcacagcauuuaucccuaagaagcucuaaguuccuguaucuuacauacagaugauugcuuuaauuuacuuugccagguguauucauaaaauggaauaucacaucaaaauuuuuaagcauauucaagucuuccccaugaauauauuuuaacacaaaaauaauuuuuauaagauuuuucauucgaaaauaucuccacauuuguagucauuuucuuucuuagguuuuccuuauguuaccaauuauaauuuuuuauuuucuauaugacauuuccccccaucguuagacaucuggguugccagucagccuuuauuguuuugauuacuucaucaaggaugaaaaugcuucucuaguagaaacucacuuucauuucuuuggaaguauuuggauucccuuuucaauuagaacccugggauguccucuuaucucuuugaccaaugccugcuggcacagagaucuuucucuuuuuggaguuuggguuaaaaacaaaacagcccuuagacaccgaguaggugaccauggucuuacucagguuauauauuuuuaaaacauaugcuuuuaauuuguuuuaggcacaagcagcaucucaagaaaacuuagagcaguuuagagagaauaauuuugcuucaaugaaaagucagauggaacucagaauuaaagaucuggaaucugaacucuccaaaauaaaaacuucucaagaagacuuuaauaaaaccgaacuggaaaaauauaagcaacucuaucuagaagaauuaaaaguuagaaaaucuuugucaaguaaacuaaccaaguaagucaaaauauagaaucauaggaaauaaauuaagcucauuaauuugccuugaaagcauaauucuuagguucaugagauuaaugggaagugaaagcuaaauagguaauauaauuuuggaaaauguuaguaaauuaacuuaccuuuaaaaugugaguccaggacaguuuaugucuuuccucuguuuuuuuuuuuuuaauuuuauauggcuuuuccguuaauauucuuagguaguuaacuggaucuaugucuuucagcuaugugcuuuuaaaacuuuguaauuuagacauugauauugucaucagauugcuuaucagcauugccauaaauauaauuauuaaugaguugggcuguuuuuuggaaaauuacaacuuaaaccagaagggucaaguaucacuacuacucugcacauucuggcacuccauaaaugaacuuuccuugauugugauaucugguauuaucacuacagggugccaugagacaaacuacccuguauaguuuuucuacuacuuaaaggcaugcuagugaaauagggaaugauuaacguagggaugaagggaaguauauuuuauaaagugguuaaaaauaacaccuuggucagccugagggaguguguggaaaacaggucaggccccaccucugaugccuuggggacaauguuaggagcuaacugccuuugagacucuuuaguucuuuuugaucaccaacucagcuaucuucuuuuccccuacaauuuuuugcucugaauuauuccuuggggccagaugccuaauauuuuuccagauaaugggugaaauaaauguaaaaggguggugaaagcaaaugcuugcacaugucuugaggaauuuuuuaaucucuaaacugguuuacuaaauacaaguauuuuuagcugggcuuuuuccuuuguuauuaguuuuauuaauuguauguaucaaaacaugauguuuuugauauauuuguacauggugaaaugguuauuauagucaagcaaauuaacauauuuaucaugucacauauuuacccuuuaaagacaaguauuuuuaauggcauccucaggaaucuuaccaguggagcauuccagaaggcagcagguguuaccugugaaguuauacaucauugguagccauuuucuucccuucccuacuuugcuugaauuacuuguuuguuggaaacuacccuagaaacauaugcacuucuuuagaacagucuaaaaauuauaauugcauacaguaggcauggucugacacauuuuucaguguuaaaauacugguuaaugggaaauuucauuuacuccuaugguaacuuuuuaaaaauugcaagucuuuuaggaaucauuuagggaaaaguaaaauacuaagcaugugucuucugcaaucuucacagaacuaaugagaggcuagcagaggucaacaccaaacuucuuguggaaaaacagcagagcagaucuuuguucaccacucucacuaccaggccagucauggagccaccuugugugggaaaucuuaauaauaguuuagaucucaacagaaaacuuauuccaagagaaaacuuagugaucucuaccucaaauccacgggcuucaaauaauagcauggagaacuacuugagcaagguuaguuauguugucuuuuuuccuuuggguuucaaauuucucauguaauucuuuuuuuguuuguuuuuuugagacagcguuuuacucuguuguccaggcuggagugcaguggugccaucuuggcucacugcaaccucuaugucuagguucaggcaauucuugugucuuagccucucagauagcugggauuacaggugugugccaccacacccagcuaauuuuuauauuucuaguagagacuggguuucacauauugccaggcuggucucaaacuucugguuucaaaugaucugccugccucacccucccgaagugcugggguuacaggugugagccaccaugcccagccucaaauuucugauauaauucuuguuuuuaauuuggugaaauaccgaguuguuuaauugacuuaugcuugauaaguaaaggucauaauuaucugugcuaauaaagugaggaaacagaaauuuuaguuuuuuuuuuuuuuagucccuagagcucucauuuucaagagguaccauuuguuaacuuuauucaauaaauguaacugaacugucacauuuuaaauuucuuuaaaagcugaauuuauuagaaauggaauauuauugccuauugccugauagcaaaagguauacguugagauacuuuggcuuuccuucuaauggauuugaguuuggcugugguugauagcacuuugauaguuuucuggcaccaucucaaguguuccacccuuaaucauaagugaaugaaugauuggcauccaaacacuuaaccacauauggaaauuuauuacuuaaagaacuccaagauaaauacuucuuaugaauuaaacaaacucuaacacugauuaauuuguauuuuuaaguuuugucauuuucuuacuuaggaguacauucuuaguugcuauuguuacagcauuuuucucucaauuuuuguaaaaugugucuauuacugggcaauugcacagugguuuuuaaauaguuaaagcaagcaaauaugugaauuuaaaaaaugcacuugugccauuacuugaaugauugaugucuaagauggcagugauaucaagaguguuuaguaaguaugaucaaacaauuauuuucuuccuacccagaauuucauguuaagcuucacaggguccucaucuccccuggauccuagcuuuacaguaacaagguccuagcuagccaauauuauguucauauuguuagcuuaguuuugucuugcucuucuagaacaauagaaaacccauugaagaggaaccuugcaauccagccuuacgauuucacucauaguacgacuucauuucuggggaucucaagaugaauucaacaaugacaaguuuuaucaauuguagacuugguagggaaaaaaaaaaucaacuaugcuugauccaguuuaagauacuugucuaacuuuugaccauuuuugacugggggaacaaauuacaaaagcugguugcaauggugaacacuuguaaucccagcuacuugggaggcuggggcaggaggauugcuugagcccaagaguuuaagguuguaauguguuuuuacugcaacugugaauagcagccgcacuccagccugggcagcauagcaagacccugucucuuaaaaaauuacaagaagcauaaaacauuuguuugaacaaaaauaaauaaauagcaacuaguuuuuguuguguaucauuaugaaaauauccauuuuaaucagugcacguuagcuuaagauuuaaugguauuuucaugaucuuaaugcagagaaaaaaaguguagacucauguuaaaugagaccucaaccuuguuucuuuaccaggccucauguccuaacaaaucauagaagaccaagucuaagguuucuuagacagcacugcagccaaguggcuuaacaaggaacaaaucaaaugauuguuuuaauacauaaauuauaagaucuauccagcuaauuuuuuucaucauuuuguuagcuuaguuuugucuuauuuuucugacaaugagaugaucagggucuaaaugcuucagagucaugaaauuuuccuacuggguacaaaaagaaaaugaaugucaaauacuuguguaggccgggugcaaugguucaugccuauaaucccaacacuuugggaggccgaagcaggaagaucaccugagcucaggaguucaagaccaggcugggaaacauagugaggcauagugagaucucauuucuacaaaaaauuaaaaaaaauuagcugggcaugguggugcacgcuuguagucccagcuucuugggaggcugaggcaggagaaucacuugagcucaggagcucaaggcuacagugagcuaugaucgugcuucugcacuccagccuggaugacagagugagacccugucucaaaaaauccaaaacaauaacaaaaaaccuucuguaacuuacuaagcaugaugcaaauauaaaauuuucucauuaguuccuaccagaaaacucagguaacaacauuuuauaagaugaugaaagaauauguagauacgcaauguaagggaagauuuuugaggaaauguuuuuccuuaauugauuuuuuuggggagcaaggagguguuuauuuuuaguauuucuagauaagcugaaaaauauuccauugguauacaugguuucuuuguggggcacugguuugccaaaccauguuagauuuaacaaaagagauuaaaaagaaccauucugucaggucaagugacuuucauacauuaaaaaaauuuuuuugaaagaauagaacuuuuaaaaaauggcaugaaacuauauuacauaaaacagauagaaguagagcucucuggcuaaaggacagguaggggcucugaagcugugacuuccuuaucccuuaauccugcaauauccucuguagaaccuuagauuucugugggacauaguuugaaaacuacugguuaugaaagaauccuucuaauuagccaaaacuuguugguacauuguucuuuuauaauuuucuccuauucuuauauuuuaaaaugaaaaaguauacaugaaguugcagaugugcucccuuuauuaauguuggaccucaggcugccuccgccaccugaagcauaacccccaccuggaaauaaacaaaguccacagagaaaggaggagcauuuuuauaaaacguaguuuauuuauuuuacuccauaauagcuuucgauuuuguauuaugcauuaaauuauuagcguaagagauuaguaauuuauuaagcuuuuuaauuuccucuagcaguguucaguuucuccuaagcuauugcucuauacauuucaaaaaccaucgauggcaccuugucuaccucaauaggacaguuauuaaugucaccaagacauuuuucucuccuuuuuucuuccauagucuguaucaggcacuguguuaaguuauuuaacuggagacaauaauuuuaaauuuguauuaagggaaauaugaggaaaaugugugauuuaaugggaaauuaggaauaaaaugaaagggacuuuuucaaagucauuuaauguuugccaguuuucacuuuuaauauagguaaaaccaucccaguuucccaccaaccaggacaaaaccagacuugucaacacagaagacccuuuuccuaagcuuucaagugucccucccagagcaccucccuccuggguucugggucugccccuuuucccuuugagccuuuaugucugaccugguguccuuuucucaaaaguaguugcccucagcugucauuuaugugguaaaauauucaaggguuggccaggcaugguggcuccugccuguaaucccagcacuuugggaggcccaggugggcggaucacgaggucaggaguuugagaccagccuguccaauauggugaaaccccgucucuacuaaaaaauacaaaaauuagcugggcgugguguugcgcgccuguagucccagcuacucaggaggcugaggcaggagaauugcuugaacccaggaggcagagguuacagugagccgagauuacuccacuacacucaagccugggcaacagagugagacuccaccucaaaagaaaaaaaauaaauucaagggucauugagaggcuggaagagacuuuauguagcgggaggccacuccagggcuggaauagaggcaacaacuuuauaccauauacccuuuaaguguuaggcgagaaaaauaaccuguauuuaaauuuguuaugcaggaaguuucucugucuagacaguuaagauuucuucaauauuagaguaagcaauuuguuaagaguauuucauuuuuaucuaagcaaaacguacauauuauggaaguauuuguaaauagaguauaaagaaauaauaaaauuuauuacacguaggaaguaaauauuuaggagaagugagaaacuacauuacauuaguaguuccuuaauacaagucauguaaaaauguauauuuuacgucauguuuauuaaugaauagcaauauaagauucguucaauaaagacuucuccuuuuauuugguauugaguuauuacuuuuacaggaccugucuacuaaugcuauugucacauuauucauuguauaaggccuaucuauaauguuauugucacagaaauauauggaaaacagucuuacaaaauauuggaaaaccuguuagucaaaaaauuuaaucuucauaccuaacauuuuuaaaggcauuggauaucauauuaucauuaucaccacaaaguaccuauuaugcucacuauauaguguacuauuucagaccauguucuggguauuuagugagagaauaccuuuuauaaaaaagauuuaaauaagagcacucuaaauaggccacuugcaauauaguuugaaauauucccacacauuucauaauuaaguauauaaauauaauuagauauuuaaaaaauugguacuaauuucugaaaucaaaauuacaauuaaagagcuauauauuuuuuguuuauaauucuaccaaguugugaaucaaagaaacuaagcuugaaaacuagcuccaacuuauauuuaucauuuuuugagcaaauuuuguguuuacaugaauaaagaaauguuauuuauaauauauagauaggauaauauuuauuuucacuuuuuugccaguagaauuuucacaugacauuauaauagcaucacuuucuucauguauauauugaugauucuguaccaaaaaauagcauagaacauacuuuaaaauuuuaauucucuaaaaguagacaauggaaagugguuuuuuuguuuguuuuuuugagacggagucucgcucugucauccaggcuggagugcaguggugcaaucucggcucacugcaaccuccaccuccuguguucaagcaauucuccugccuccgccucccaaguagcugggacuagagguacaaggcaccauaucuggcuaauuuuuuuuguauuuuaauagagacgggauuucacuauguugcccaggcuggucucgaacuccugagcucaggcaaucugccugucuuggccucccaaagugcuaggauuauaggcuugagccacugugccccaccagaaaguuuauuuuaaggaaaaauccacuaaagugaaaaaacugauuaagcuuuauaaaggucagaguuuugcuaagaauuacaaaguaaugcauucauuucaaacuaugacuucaguuguuugaacuuguacaaauaagagaaaauaucaccuuucugacauuauauauaugcaguagaccaauauuaauuguacuuuuuaucagauuaaacaacauuacacauuuuuuaaaucuaaacuuaaaacaaguaggaauuuuauuuaugugauuauuuuuauauuuaagcaaucaaguuaaguguagucuuuaagaguauuacaggccacauuuuguaagugauacaucauuucuauguuaaugucucuugucuaacuuaaacauuauaaauaacauuugacuuuuuucagaugcagcaggaguuggaaaaaaauauaacuagagaacucaaagaagguauguugccaaacuucaugaauuaaauuuagauuaauuaauugauuucugaaauaaauuguaaaucgugagugggaucccuuuccauuguuuggcuaauagauacuacauuaaauguucuuucuuacacacaucuaaugaaagaugugaaaacaugaauauucauagugaagaguauacuuacuuugucucauuaauucaucauguuccauagcuuuaaaaaaacucaagaaaucuuugcaccucuuuuuuuuccggcucuacacuuucuucacuucugccauccccauagaacuguagccagcaugcagaaauuauucuuagaaaacaaagacaucaucaacuucucaagguuaugguggugauuuaaggcccaaagaccccagacucacuaguaauaucuagucuggaauuacaguucauaagcaguugcuugacaggugacauuugaaaucuccagucauuuacuuugucauugguuucccuuugcccucaggagaaguuccaaauuccuuagcauggaauaaaaauacccacaucaaugugguccuugugacguuauucaaccuuauuucucaccccuugcuguucuucgggccccuuugcucuggcauccagccacccuagaccacguggaauuccacagggagcuuccucagcuccagcucuuggcauuugcuucuuccuuccgucuggcauauguuuuccuuguacuucagguaucagucuacauauugccuccaucaaaaagccuacguuauugacucagaacugggauaggugucccuucuguguguuccaguagugcccugucuuauaccugucaugauaucugugacuuuguauggaaauuguauguuugucuguuuuuuucagauuauagcauauguuuguuagagguggaucauaucaucuucaucuuguaauucuagugcuuacuuugcucaugguuguugaauaaaugaaugaagagugagaaagccagaagcucugauauuuaaccacaaggauaauuaauucagugugcaaccaugggcaaauuauauuuaauaguaauauuguauaauaguugugcauacauauuuuucuuucuuauuaauacugacaaaauucucaacucuuuuacugacuuccacuuaguuaacuaugaaaucuuuuagguaaggaauauaauucuuucuuuuucauucuagcugcugcugaauuggaaucuggaucaauagcuuccccucuagggucuacugaugagucaaaucuaaaucaagaucuaguuuggaaagcaucaagagaauauguacagguuuuaaagaaaaauuauaugaucugaaagauaagauuuuauuacugggcuguuuaugugacauuuuguuucucauuaaauauuaauauaugacauguaaaaauauuaaaggaacguauuuuuguaucauauaugucagaucaaaauuuauauaguauuuuaaacaauguuacuuggcuucuuuaacuuuuaaguggauuuugccaaugaaaaccaggaauauugaguuuuacauacucaaacugcccaaaugugagcuguuuaaacagccaaaccacuaaguugucauuaauacuuuagugcaguuaauugauggcuuauuuguauuuuguaauuuuuaucacuauauguagugguagaugucuaauuggacuuagacaucauuuuguugugcaggaacuguggucauuguucauguuuggauguauuacaauuguuacagugccaucaaauuuacauaauuuuaauuuuaagcacugauuuauauagcuguucucagggagaaacaagauuugccugauucaccuuuucuguuuguuuauuuauuuuuaauuaaccuuuuggaaauagccuucaguuuagagaaaauuucgaaguuuuaguacaaagacuuucuccuccgaacaauuugagaguaaauugcugacauuaugucaucaccccugauuacuuuagugggcauuccuacaagucaggacauucuacauaacuacagugcaaaccuugcaaucagaaagucaacauuaauacauucuaguuuguuacuucucuguaauguccuuuauagcaaaaggaucccauucuaauccauggcuuguauuuaguuguuguaucuguuagaucuuucagucuggaacaguuccucagucuuuccuugaccuucaugaccuugaauauuuugaagaguaaagucugguaauauaagaaugucccucaauuggguuucauggugauuagauuuagauuauaugauuuuuuggcaggaguaucacagaagugacccagugaucuucucauugcaucuuaccugugacccuacaguuuugauuugcccuguuacugguaauguuagcauugaucacuaacagugguaucugcugaauuucuccucuguaauguuauuuuuucaccuugugguuaauuaguauuuuacagggagguaauuugagacuauguacauaucucuacuccccaucgaacccucaauuuauucauuugcuuguaucaaauaaaccauggauucaugguuuauuuuauucagugaguuauaauucauuaauauuguuauuaaaaauuuguuuuucuuuuaagaaauguuauauuuugacaacuucagacuuacagaaagauuauaagagguaguacaaauaauuuuuggauauuauuccccaaauguuaacauuuuacugcauuuacuuuauccuuucucccccuucuccuccugucuuucuagaugaauaugaauauagguacuuaauacagauuuuuuuucuaaacuguu

SEQ ID NO: 191682 - RNA, 504696 nt, Homo sapiens
gugcuguggcggcggcggcggcgguaguggcggcggcggcggugccugggcggcagcagcagcaguagcggcagcccugaggacggugagacggccgcggcggcggcgacagcgcggaagucgcgcgggacccagagcuuccccccugucgcuagugcugaggcuuucgccuuuccuacccagcuucuugcucacggcccgggcugggcugggcagggcaacgcgcccccggggaggggcggagcuguaggugaggcuucgcgacccccucccccuccucggcagcccgggggguggggaggggcgggccccacccagaccaccggcgcccacccgcgggcuccacccagccgggcuccgggaucgggcgggagccgaggcgguagauguggggauccuggggcgggaggugggggaguggggacuggggcucugggcacuuggggagcggagggggggaggcuuaggacuagugaagccgcggacgagguaguggggagacggagaaauuggggagccaugagguuggggugcggucaggguggaucuuuggguuaggugagugauguaaaaugcugaagaugauucuuuucuuuucgaugaaauggugagauaaaagaugaaguguauuucaaaaggacgaugagcugugcauguugccuuugaggcaguugcagaaccuauuuuauugcacuagaucucacguuucuacuuuaggguucgauucuuuuucuucuggcgggguggguggggggucggagagggaagagaauccccuuacuuuggcucagguaaauugugagcguggauguaucugaaaguuuuacaccgaagaagagggagaucuucgguuuagacaacuucguuccggcagccaccauuugggucgcauuacgcuuagcuccuucaagguggugucuuccaguuuuuuuuccccccaaugccuaaaagaucucuuuauaccacccuuuuacaggcuuuauccuggccccuugagagaaggccccaaacucaggugguugcuuuggaaggcacauugcugaauaauaguugcaggugguugugguugacugcuuuggguggauaaagugaacaauuggaauaguucuguuggagcuaauuauaugaaaaaugcuuaaauguuuuaaaguacaaccgucuuuuauagcguguugcuugcucaguacaccuugacuuuuagacauuuuguguucagugcuaaauuguugaaauuuuauuucucauuugcaguuauguuucuugcagucuuuauuaaaacacuuuaaaaugaaauggaacucuuuuuuuuugguaggcuccucaauuucugagaaauguucuuggagucaagugcuuuaaaaacauuuugggggcaggugugucacuuuguauggaaauauuagaguaagcaguguucaauguucuucacaucacucuuucacaacuuagcacuguaaaucagaaucuucuuuucuggauucuugcucccuguuagauuacaguauucucuggcccuacuuaucaguuagugucauuuaagcuauuucuuguucagaaaacaggucccaugauggacauguauuauguaauggauggaaguagacauggcucucaauaauucauuuauggaggaagagaagcugucagaaagugggauuuaagcagugacuuucccaaggcuugccuaguuuauuugggaaaauagccagagaagugcuuucuuguaacccaaaagagaaauauacagauaagaauuucaguaguugcagaucguugcuuuuucuaagugccuacuuaaugagcagauuauugucuuccagcaaauacuucuacuuuauagagagguaugggaaacaggacauaauagguauuaagugagaaaguguguguuccaauuuuuaauuauaaauaaaagauuuaauuaacuguauucaguuaauucauuugguaaagugaacaguuuugacuuuggauuaguuagaaggaaaacaaaauugacauaucuaguuuucgcuuuuaaauuauacauagacuuaauuaauugggacaaaugugaacuaagauacuggguaaaacuuguguguacuccuaaaaugacauuugcauggcugguaguaagcugugauucuuguccuuguaggaaugaaaucacauaauuuggggaaagucuuaagguaaaaguaagcuauuucguuuagcauuucuugugccugaaauuaugccuacauuuuauuuuucaaaaaauguugcuugcuagucauuacuugugauauccuuguugagucuacugagguguuuuuuuuccuucauuaccugugucauagauaaguaugccagucuguuaauucaacauuaauacugcaaacuuaaaagugaagguucuuggccgggcgccguggcucaugccuguaaucccagcacuuugggaggccgaggcaggcggaucaugaggucaggaguucgagacuagccuggccaacauggugaaacccugucucuacuaaaaauauaagaauuagcugggcgugguggcacaugccuguaaucccagcuacucaggaggcugaggcagaagaauugcuugagccugggaggcagaggcugcagugagccgagaucaugccacugcacuccagucugggcuacagagcgagauuccaucucaaaaaauaaaaauaaaaauuggcugggugugguggugcacaccuguaaccccagcuacucaggaagcugaggcaggagaauugcuugaaccugggagguggagcuugcagugagccgagauugcaccacugcacuccagccugagucacggcaaaacuccgucucaaaaaaaaaaaaaaaaaaaaaaaaaaaaagugaagguuuucauagcaacagcugcucgguuuuacacuauguuuacauuuagaaguaugagaguuguuaaauguguauuuuacacauauuucaucagaaacauuaauggaaaaagaucaagaaaugaaguauuuugguuuaagaaucaguaguacauugauuaucaguuuucagagacauauaguaaaauaaacuuagcauacagauuauguggaauauaauuuguuuuuuuuucuuauuuauuuuuuguguguggaauguaauugaaaucuguugcucaccaagucuuucaguguacuagaguuuggguucuggggucagagugccugaguucaaauccuggcuuugccaugguaugauguagggcaaacugcuuaauguuguuuauuuccuaaccuuaaccuguaccuuaauuucuucaucugcaaaauagaaauaauaacaguaguaccuaaccucuuaagcuggucaaaugaauuaauucauguauuuagaacaguuugggcacauaauuagcugguucacuaacaucauuugaaguuuaacuguguauacuauuuuuacuuaauaaguauauauuaaauacauauuauguaccacauauucuagaugcugguaucauaguagugaacaguucucccagcacuuugggaggccgaggugggaggauggcugggcaacauagcgagaccaugucucuacaaaaauaaaaaaauuaggccgggugcgguggcucacgccuguaaucccagcacuuugggaggccaaggcgggcggaucaugaggucagggguucgagaccagccuggccagcauggugaaaccccgucucuacugaaaauacaaacaauuagcugggggugguggcgcgugccuggaauccuggcuacucgcaaggcuaaggcaggaaaaucucuugaacccaggaggcggagguugcagugaguggagaucgugcuauugcacuccagccugggugacagagcaagacucugucucaaaaaaaaaaaaaaaaauuagcauggcaguaugugccuauagucucagcuacucaggagacugaggcaggaggaucacuugaaccuagggguucgagguugcagugagcugucauuccgucguugcacuccagccugggcgacagagugagggaaggcuaucucaaauaaauaauaaauaaauaaaaguacgggcaguagucaggagcuuaugcuguauuguuccaggugaggguaucucugaccaaggugaaauggggaggagggguuggauuuuguauguauuuugaggguagaccuauagaauuuguuggugguuguuugcgggaugugggccaaacagaagaauaaagaauaagguuuuuggccugaauaacuggaagaauaaaguugccaguaacugaauuggagaugguaauucauggagcauguuuguggagaaaccagaaguucagggugauguccaggaagagugagaaauguggcuguuuucagcuucuuuguaguauuuaugauuaugagauaggugagaucaucaggggagugaauuuugguggagaagagauccaaacaucugagccuaggggacugauucauucacuuauucauucauaaguuacuuagugaguaugguucuucuagguaccuuuuuaggcauuggggauauaaaccugacaaaaguuuucaccuucauggaacuuaccuucuagauacgugaggggaaaucaagaggaaccaguaaaggagagugauaagaaaucauugaguuaggagggaaaccaggggaguaugauauucuagaagugaaggaaaggaagcuuucaagaaggagggaacggucagcggugucauuguuuaaaguugugucagaauguugaguaagagagaauucugcuugauuaugaugucuaauaacagggaaaugacuaaauaaguuuuagugugagauagaugagacaaauguaagagucuuuuaguuuuuuacuucucuguuuuuuuuguuuuuuuuuuugagauggagucucucuuuguugcccaggcuggagugcaguggcgcaaucucggcucacugcaaucuccgccuccuggguucacaccauucugccucagccuccggaguagcugggacuacaggugcccgccaccaugccuggcuuuuuuuuuuuuuuuuuuuuuuuuuuguauuuuuaguagagacaguguuucacuguguuagccaggauggucuugaucuccugaccucaugauccgcgcgccuuggccucucagagugcugggauuacaggcauaagcgaccacaccuggccucauucuccggguagauuuuuaagaaauauuucagccaggcacagugucacaugccuguaguuccagcugcucuggaggcugaggcaggaggauugcuugaguccaggagaucaaggcuguagugugcuaugauugcauauguguauagccacugcacuccagccugggcuacauagugagaccccaucuguaaauuaaaaaaaaucauucuuuucagaacaaaauaggcaaccugggagugcuaaggaaaggcacaugacuucuuauuguuguuguuaauuuuauguacacuuauuuuaagaaauagguaauauauguacuaaauuagaagguauaagagaauacacaguuaaaagucucuccuaucccaucuaguucuuucugaaggcaaucacuguuugcaguuucuuguuuuuucuuuuuagccagugaaauuuuguguaauaggacauuaccuauucuaaaauugcauacauauaagaaacauuuuaucuuccacucugacacugaacacuggcaauauuuuauacuuuuugagaagggucuuggucuguuacucagucugaaaugcgauggugcgguuauagcuuacugcaaccuugaauuccugggcucaagcgaucuucccaccucagccuccagaguagcugggacuguagccaugugccaccaugccuggcuaauuaaaaaaaauuuguagagagacaaggcgucauuauguugcccaggcacuauuuuagaauagcuuauuuaaaagauaguuuuagaagccugucaagggaaauagugacugcuaggaucaaacauggauucacuaagucacaucagacaguaguugccuagaauugacuugguuacuugacugauaaauaaaggaaaugcaguaguuggaauuuauguauacgucagcuaggcuuuuucaugucgucuuuguggaaaguacgaacauauguguccuagauuucuugaggacaggaacuaucuauuagauacuuauuaaauacuugaugaaugaauggaugcuagcauaauaaugugaauucacaaguugaauacccaggaaauaaagaggugcuuguugaggaucuuggguuugaggaacuugguguuagacucauccauacauuuauugaaaugacacaggaugguagcaagacugguggcauagaggauaauggcagcugugaacuaguugccagcauauccuuacugaguaugggggauguccagguggucauuagcugauagugaagagguagagguugaagacugugcugcugaauagcaugagaauuagacuaagauuuuacguaaggguuugggaauaguggucuggaacuggcacuggcaggaaggaagguaccagccucauuucccaguauuggguguggaguggaagagacugaguagcuuucacuuaaaaggacuauaugagaagagguguccugauuggaaagucagcuuucaguuaaggcagagagguagcaagaacauuucccaaggaaguugaagacuuuuagaggaguuucuugauaaaagaaugaaguuccaugagaguguauuuuuccacccuauuggcuuguuaucaucauuuaaacuuuaaaaugucucuucaucuuaauaaaaaacuccagauuuauacuuuauugcucuaaguugcucucugcuuuacacacuuaagaguuuucugcauuugcuguguaucuccauuucuucaccugugacuucucaaccuauuucugucuuguuucuaucgccauuauuucagugaaacugaaaauagcuagugaaaauauguaugaaaauagccaaugucuauuuuacuauccuguucuuauuuaaccucuuagcagcugugcuaguuucuauuggcuauauaacaaauuacccccuaacuuaagaaacauuuauuguuucacagauuuuguagaucaggaaugugggugcaguuggcaccuaugauucagggucucucacaaggcugcagucaucucaaagcgcuacuuggggaggcuguuuccaagcucacucaugcggcaauuggcaggccugagguccuuguuggcugcuugcuggagaggugagucccuugccauuuggguuucugcguacgacuacuuaaaauaugauaucucagugcuucugucuucaaaagaggacagauauuagccagaaucuuuuuguaaccuuaucuuggaagugaugugguaucacuuuuguuguauucuguuaucagccagucacuagguccagugcacucaaggcaggauuucacaauugcaugaaugcugggaggcagagaucacucauagccauuucaggacugucuaccacagcagcauuugacagagcggauaccccuccuuccuuuguaaagcucucucuucucuugaggucuucagagcacuuuucuguuuuucuugcugguucucugggcucuuucucugucacuuuuuuuuuuuuuuuuuuuuuuuugaggcagagucuugcucuaucgcccaggcuggggugcaguggcacaaucuuggcucacugcaaccuccgccuccuggguucaagugauucuccugccuuagccucuugaguagcugggauuacaggugugcaccaccacacccagcuaauuuuuguauuuuuaguagagaugggguuucaccauguuggccaggcuggucucgaacuccuggccucaggugaucugucugccuuggccucccaaaguguugggauuauaggcgugagccaccgugccuggccucucagucaccuuuugagucuuucugugcucauuuauuaaauguuugaauuucuuugggcuuucucaucgcuuucuauuucauuuuucaucugugugcugaguauucauuuuuaugucuucaguuuuuaccucucuccugagucugaggaccacucuaucgaauugcuacugaauguuuccauuuggaugccccuuaaaccgaacacauccagaacggaauguaugauuccuacacuuccucugguguuucuuaauuuguuaaaugacaccacugggugcuuaagccggaaaugugugugguguucuugauuucucccucuccuccaccuuccauuuuacuauugcuuuuuauuuuucuagagccauggcuguucagugauggugugaauguuucuaugagguagugcauccucugccagguugcaagcauugaaccuggugcuaggugauuuuuuuuuuuuuuuuuuuuugagauggaguuucacucugucgccaggcuggagugcaauggugcaaccuccgccucccggguucaaacgauuccccugccucagccucccgaguagaugggauuauaggcgugcaccaccacggccagcuaauuuuguauuuuuaguagagacgggauuucuccauguuggucaggcuggucucaaacuccugaccucaggugauccgccugucuuggccucccagagugcugggauuacaggcgugagccacugugcccagcccgcuaggugauuuuuaagauuccuuccaaucuugagauacugcguguguagcuauugaagauuucugaguaggagaugcaugaucagggcugugcuucagaaagguggcaacucuugaacagucauuuuuaguuguucaccaaagaaugaaacuaaacaccuguauucuuuuuaacuuuauuauggugugcuaagugaugaauagauaauuuuuaugugacagcccuuuuguauauauuaguuucauuuuuucucauuguuaaugcauuuauguuuggaagcccuuuugcauggaaauaagauaaucaggccaggcacaguggcucacgccuguaauccuagcacuuuggcagacugagguggguggaucacuugaggccaggaguucaagaccagccugagcaacguggcgaaaccccaucucuacuaaaaaauaaaaaaauuagcugggugugguggugcacgccuguaaucacagccacucuggaggcugaggcaugagaauuccuugaacccuggaggcggagguugcagugaacugggauuacaccacugcacuccagucuggaugacagagcgagacccugucucagaaaaaaaaaaaaaaauaacccaaugggaugaaaauuuugggaugaaaauuugugugaacuuaaauuaagugucucugccauccuggccaacauggugaaaccccgucucuacuaaaaauacaaaaauuagcugggugugguggugugugccuguaguccuagcuauuugggaagcugaggugagagaaucgcuugaaccugggacgcacagguugcagugagccaaaaucacgccauugcacccagccuggugacagagcaagauucugucuuaaaacaaaaaaaauuaagugucugaaauuguaaaaacuucucaagaaauaaaauucagaccuuaaacauaauuuuacuguaggaauauaacuuaccuuuugaaggaauucuuucuugaagccauuauuuguguauuuauuuauuuuuaauuaacuuuuuuguuuguuuguuuuuuugagauggaguuuugcccagacuggagugcagugaugcgaucucgucucacggcaccucccagguucaagcgauucuccugccucagccucccaaguagcugagauuacagguaugggcaaccacgccuggcuaauuuuuguuuuuaguagagauggaguuucaccauguuggcuaggcuggucucaaacuccugaccucaggugaucugcucaccucggccucccaaagugcugggauuacaggcgugagccacacugccggugcuugccaccuugccuggcuaauuuuaaaacuuauuuuuguggauauugaguuuugguuuuuugucuaggcuggcaucgaauucauagcuucaaaugauccuccugucuuggccucccaaaaugcugggauuacaggcaugagccacuguguccggccuugaagcccgucuugaauguaacacauauguagaaaaguauguaaaacaaaaguaaagcuuuacaauuuaugaaucagacacuuguauaaccaugauguaggucaagcacuaggaccuuacugacauuccacaagcuuuccuugaagcuucccaaucacaacccaguccuucucucauaaagguaaucucuguccugauuguaggagaaucaccuucuuuuuuuguguguguagaccuuuuuaguuuuggcuuaguuuugauuguuuugcaucuuuauaugcauggaaucauauuguauguauucaugucuggcuuugacucaacauuuuguuuguaagauuuagauuuguauguagcuguucguucauuuucauugcuaaauaguauuccauuguauaaauauacuacaguuuauuguauuauugauggauauuuagguuguuucuaguuuugggcuauuauggauuaugccacuaugacuauucuuguaaagucuuuuuuuuuuuuuuuuuuuuuuccugagacggagucucgcucuguugcccaggcuggagugcaguggcgcaaucucugcuuacugcaaccaccgucuccuggguucaagugauucuccugccccagccucccgaguagcugggauuacaggugcccaccaucacacccagcuguuuuuuuguauuuuaaguagagauggguguuugccauguugaccaggcuggucuggaacuccuggcuucaaaugauccaccugccucagccucucaaagugcugggaucacaggugugagccaccaugcccggcuuuuuuuuuuuuuuuuuuuuuuuuuuuuuuuuugagacaguuucacucugucgcccagacuggagugaaguguugugaucauggcucacugcagccuugaccuucugggcucaagugauccucccaccucggccucccaaguaacugggacuacaggugcauaccaccaugcuuggcuaauuuuuuuuuuuuuuuugguacuuuuuuguagagauggaguuuuacuaugcugcucaggcuggucuugaacuccugagcucaaguaaucugccugccuuggucucccaaagugcugggacuacaggugugagccacugcaccuugccuugugcaagucuuuuagugcauauguguauguaauucuuuuguguauuuggccaggagugaaaguccugggucauaggauaugcauauguagaauuuuagauaauugccaaacaguauuccuucuuugugguucuacaaauuacaugccccaaagaguguuugagaguucauuuuguuccauaucuuugccaauacuuaguauugucacuauuauuaacuuuagccguucugguggauuuguaguaguaucucuugguuuuaaucugcauuucacuuauuacuaaugagguugaauaauuuuauguugguuacuuaggaaaccuuuugugaaaugcuuauucacaugucuugcccaauuuuaucuuuuuuuucuuauuauaggaguuccuuauauauuuuggauaugaccccuucuuugguuauuuguguugcaaauauuuccaccuuacucuguggcuugccauuuaagacuucuuaaggaggccaggcaccguggcucaugccuguaaucccaacacuuugggaugcugaggaggguggauugcuugaguccaggaguucgagaccagccugggcaacauagugaaacccuaucucuaugaaaaaugcaaaaaaaaaaaaaaaaaagacucaaaaaaaaaaagagaaaagaaauguguuaggacccuaauuggacuuuaauuggauuuguagauuaauuuggguagaauuacuuuuuuguaaugaggaaucuuugacuaauucaauaugauaucccuguuauuuauguuguauuucauauaucucaguaauguuuuauaguuuucugugcaguauuacacaucuuuuguuaaauuuaguccuaguaucugaugguauuauaaauagaauucuaagaucaauguuauuuuccauuacuuguugguauauugaaauaaaacugaauuuugagugcugacucuguauuuugcuaaucaagccuuauaauaauuuuaucuguagauucuuuuggcuuuccaacuuacauaaccauaucauuugugaauaauuacuguuuucuguuuuucuucgcaauucuuacaccuuuuucuuuucuucacuggcugggauuucuggcauguuguugaauagagauaggagacgucauugucuuuucccaucucaaagggaaaucuuucaacuuuucauuguuaggcaugauguugucaagcacacuuacacaagacaaggcaaggcuaagaccuugccugucugauuugacuggcaaagacacagagagccucuuuagacucagacaguuuaucuguuacauagucggcagaaagaagaauaagccaaagguuccugcucccugugaucuuugucccacauaccaaaaaggauaacaccacaacaaaaggggcugaugccugcagugugagcugggggauacucuguugaugaggagccuauucuaggcugcugcuaagugguuuuguauucuacagcgcuguucuaaguuaggcagggcugaagguucaaugccuugucagaacccaggaugccaugagaaacugucucauggcagcuucuaaggaagauagggaagaggugaccugggagagcuccauauaggccuuccaccaucuccuguuaugggaggaucacagggcauuccuccaagacucagauaagcugcaggucaccagaacaccaugguggaacuguuucccuacagauguuuguuauaguugcuuuugcacauguccuuuauuagauuaagaaaguuuccuccuauaccuagauuuuuauucauuaguaaauguuaaaauguguccaguguguuucguaucuauuggaugcuucccccccuuucaacccauuauuauggccaguuacauggauuuaaaaauucauuucugcugguuaauaaauuucuuucuuuuuuucuuucucuuuuuuuuuuuuuuuuuuuuuuugagacggagucuugcccucucgcccaggcuggagugcagugacgugaucucggcucacugcaaccuccgccuccuggguucagacaauucuccugccucagccucccaaguagcugggauuacaggugcccaccaccacacccagcugauuuuuguauuuuuagcagagaugggguuucaccguguuggccaggcuggucucaaacuccugaccuugugauccaaccgccuuggccccccaaagugcugggauuacaggugugagccaccaugcucagcugguuaacacauuucuaagcauuuuuuuccuuugaaagauuuuacuuacuugaaaaaaaauugcuguugaugacuuucuuuucucuggcugccugccuuuuucuguguguguguguguguguguguguguguguguguguguguguauaaauuuuuuuuuucucauuguucauauagaauucagguauagaauucagguugcugaacuuuucaaggaagaaagaccguauuuaacuucugauucaucauuaagaaguuauuaauggucccagagacucauagggguuucuucugaaguaagaagaagccauguuuuacaucuucagaugccacguaggugacuuuucuaccuucaugguaguauucacuuuacuuucauuaaaggcaaguaauuuugaguacuucaaauuaguucccaucccuuuucuaaacuuuaaacauuuuuaaagaaaucuuuauuuauuuucaccugggguuucacucugucacccaggcuggagugcggcagugcuaucauggcuuacuacagccucgaccucccaggcucaagcgauccucuugcaucagccuucgaguagcugggacugcaggagugcaccaccacacccagcuaauuuuuuguagagaugggguuuugccauguugcccaggcuggucucaaauuccugagcuuaagucaucuacccaccuuggccuccgaguguugggauuacaggcaugagacaccauaccuggccccuuuucuaaacuuuuauaugaaauuuaggcugaaccuuugcuugacguuauucucccuugcauuuagauauaaaguuauuaaacagaaaaaguuacugaagguagauaauuauuggcuauuucaugugauuuuucuggugguuacuguagucaauuuuauaguauugccaaguuucugaauccauucugaauaaugugauuguuuauucuuaugcuuugggccugauaauuuuuguagagcagcaguucuuaucugguuuccuguuauuuuuaaaauaaauuaauugaaaaugggcauaaauuauuuguuaaguuugaacuugacaaaugcagguaaaguauaaugauauuauauuucuucuguacagcaaguauauacauguauauuuuaaaucaucaaucaggauuuccuuccaaaguucagaauuagguuuugauucuuaacaguuuauauuaaaauucuuauuauuauuacuuuuuuuuugagauucuuaacaguuuauauuaaaauucuuauuacuuuuuuuuuuuuuugagacagagucucgcucuaucgcccaggcuggagugcaguggcaugaucuuggcucacugcaaccucugcuucccggguucaagcaauucucugccucagccucccaaguagcugggaauacaggcgccugccaccacaccuggcucauuuuuguauuuuuaguagagacgggguuucaccaucuuggccaggcuggucuugaacuccugaccucaggugauccacccgccucggccucccaaagugcugggauuacaggcaugaaccacugcaccuggccaguauuauuacuauuuuuugagacagauuuuucucgcucaggcuggagcucauugcagccucgaauucuuaggcuuaaucaauccuucugcuucaaccuuccaaguagcugggacuguaggcaugcgccagcaugccuggcaaauuuuuuuuuguuuuugagacagaguguuacucugucaccuaggcgcaauuucagcucacuguagucuugaccuuccacuccuaagugaucuacccaccuugccuccugcauagcugggacuacaggggcgugccaccaugcccagcucauuuuuguaauuuuuuuuguuuuguuuuuaagagaugggguuuugccguguugcccaaguuggucucaaaacccugggcucaagugauccccucaccuuggccucccaaaguguugguauugcaggcauguaucacuguaucuggccuuuucuuuuuuuauuagagacagggucuugcaguccaggcuggucuugaacucuuuggccucaagugaucuucugucuuggccuccgaaagcccuaggaaacaauucuuguaaauaguauagcaaaaaugucugcuuuauaaauuuuucauuuuuauaguuguucaagaguacauauguauuuccuuuuuucuuuuucucguuccucauucaaaaaauauggaaaaucuaauauacaauauauauguguauauaguauauauaauauaguauauauaugguguauaguauauaguguauauauaguauaguguguauauauaugacucuguauuguguuccaucuuggcaguacaguguuugaggcacugucuccgcccucaggaugcuggugaccagggagggagacaguaaacaggcaauuacaguagagugugauaaguguuauugauacgugcaagaacuagaagguuuaaggaguggccaaagaggcuugaaauuggguuuggaucaugaagggcuuuguaaacccuguuaaaaucugacuuuuaccuuggagcaauggcaagacuuuggagacuuuugaguaaaggaaauaacaggaguauauuuguauuuuacaacaaaugguuaagaggaggcuaugugaggaagccaacuaggaggcuguggaccuguucccacuaaagccuaaaaacuaaaguagugacaguggggauagagacgcguacagaguuaaaagcuuuaacaggacuggguaauucauucucucucucucucucucucucucucucucucuuucucucucucucacuggguaauucucucucucucucucucucucucuguguguguguguguguguguguguguguacacacuuuguggggaaaggacaguuaguugauggggaggaagaagacuaaagugacucccagacuuucagauggaaccccuaggcuaggaacagugcuauuggguacaguagccacuagccauguauggccauuaagguaugucuaaacuaauuuaaauaaaauaagauuuaaaaugcaguuauucaguugcacuagccacacaaauauagaauuacagacucuuaaauucuguaaauuucauccagaguacuaugaaguuauaaauucaagaguaugcacagagauucaagcagaaaauaauaucuggcuacauguguuuaacagcaguaugggacugguggccucuguauuggacagugcagauauagaacauuucuguuacagaagguucagugggacagcaguggucugcaguuuuugguuucuacuuucuuuuccccgccagaggagagucagaauaacaggugguuuucucucgucuccuaagaacuuugguuccacaguauucuguugugugauauuguuacccagggauucugcuagauaccguucacuacugucaaccaccaucacccagucaucagguauaggacguuucuguaaucagagaagguucuuuuggacggcacugagcuagagagauggugaugucauucaucgagcuauugaugguuguggugggacaacaguagcugccagaaagcgcuguuuauuagaaauaugagccacauauguaauuaaaaaauuuuuaguagccacauuaaagaguaaaaagaaacaauuggauuuuauaacuuauuuaacacaguauguccaaaauaugauuuacaacacauuaaaacauuuaaaaauuauugaucuauuuacauaauuuuuuuuaauuuuuuugagacaggcucuugcuauguugcccaggcuggucucgaacuccugggcucaagugauccauccgcuucagccucccaaagugcugggauuacaggugugagccaccaugcccggccacauuauuuuuuaauacuagcucuuugaaaucaauuguauacuuucauaguauaucuuaauugaaauacuaauuuuuuuguucuuucguuauuuucaaaugcuuaguuuuaucagaaauauuucaucuguauuuauaucuguaaaucauaaaauuuacaguugaaaaaguagauuuauaugcccagguuauuccaaacaugcuuaaaacuuuuccaguaauggaauuaaguaucgguuuuuaaaguuucaauucccgugaaauaagaauaaaaauucaguuccucggucucacuagccaccuuucaagugcucagcacucagcagcugcauauggcuaguggcuaccauauuggacaacacagcucuggaauaacugcucacuggaugguuggaaauucaggucuggaguuuaggaaagagguagcaagacagaaguuagaagggaggagcugugaggaacauggggauuuaaaaaaagaaguuugugacuuugagcaaacuaauuuuaaccuuggugcuccauuuaaaacaaaaucgauaaaagcaucuuggugagaguauaauaguagaugaauaugcaguaucuuguggugguaaagauuuuuuuuuuuuuuugagacagagucucucucugucgcccaggcuggagugcagcggcacuaucucggcucacugcaagcuccgccucccggguucacgccauucuccugccucagccucccgaguagcugggacuacaggugcccgccaccacgcccggcuaauuuuuuguauuuuuaguagagacaggguuucaccguguuagccaggauggucuugaucuccugaccucgugauccgcccaccucggccucccaaagugcugggauuacaggcgugagccaccgcgcccagccaagauuuugacuuuagaguuugauagagcugugugaucuugggcaacuuacugggccuaauacaaucuuucuccuugaaagggguuugcuguugggauuaaaugaaauauugugacaaguguucacugcauauaauacguauuucuuuacuuuuaaguugccauuucuuuuuggugagguguacuaucaacuuaauaauucauucuuuuuagaaaaaaagaaacauaauuuaguuauacauguuaauuauaagcugcaucccaauucagaaacuuuaaaauaugaaaaacuguuuaucuuaaaauauuaauauugaugaguguucauuauaaacuagauacuguguuaaaugcuuuauauggugauguaaaagguuugauuuuuauaaauaugcaauguaauaugauauuuuuguuauaaaguuucauuuaaguagauucugcaauacaaaucucuucuggaaacuuuaaaaugcaugaugguauaacuccuuuuuucaguuauuucaggaaccacugaauucugcuugaaucucuuuggauacuucuaaauuuaugauuucuccaggcuaaaucugcagaauuugagucuguaauucuaccuuagugaguacacauauaaagaauuacuauuuaaaaaacugccuugguagaguuuauucagagaagcgugguaaccgaggggaggaaaauggacuuuuccaggucgaagagaaaggaaauauuggcugggugccauggcucaugccuguaaucccagcaauuugggaggcugaggugggcagaucacuugaggucaggaguucgagaccagccuggccaacaugguaaaaacucaucucuacuaaaaauacaaaaauuagcugggcgugguggcgggugccuguaaucccagcuauuugggaagcugaggcaggagaaucgcuugaacccgggaggagagguugcagugagccgagaucaugccacugcauuccagccugggugacagaggaagacucugucuccaaaaaaaaaaaaaagagaaaggaaauaugauuuuuuuuuuuuuuuuugacagagaguuucauucuuguugcccaggcuguagugcaauggcaugaucucaucucacugcaaccuccaccucccagguucaagugauucuccugccucagccuccugaguagcuggcauuacagguguguaccagcacaccuggcuaauuuuuuuuuauuauuauuagaaauggguuuuuaccauguuggccaggcuggccuugaacuccugaccucaggugauccguccuucuuggccuccgaaagugcugggauuaccgaacccggcuggcuauaugauuuuugaugcucugcaaauucuuuucugaggucuuuuucuuaagucucaucuucuggcagugugccauuccacccguuucuuggagaagaccagaaacauguuuauaaugcguacccaugcguuauauacacaguguguacuaggaaaccuuacugccuuauuugugguaguuucaguagacccacucaggucugaaauaauauuaggcauuuuacauccguauuauuggaaauaaugaaaaauuuuauaugugccaacugcauuuggugauagcaacugcaagugcuguguugaaaaugacuuugagacuagguacaaaaggaugaaguguucacccuggaauuacaguggcucuccuuuuguuucuguuuaagucuucuuaacauuuuuccuuuuuuuguuuuuugagacaaggucucacuccgucacccaggcuggagugcaguguugccaucaccgcucacucucacagcagccuugaccuuuugggcucaagcuauccuccuaccucagcucccaaguagcugggacuacaggcaugcaccaccaugcccggcuaauuaaaaaaauuuuuuuguagagacagggucucuccguauugcccagauuggucucaaacuccuaggcucaagcgaucugucuaccuuggccucccaaagugccaggauuacaggugugagccaccuuguuuggccaacauuuuccuuuuuaaauaaguaguguuuaccuguuuggaaaauuuugacaacuauuaggaaaaaacuagguuucagcucaucuuuuggcugugcuuauauuugcaaaauugagaguauacuguagauuaaaauauauucuugaaggcugggcacaguggcucaugccuguaauccuagcaguuuggaaggucaaguugggcggaucaccugaggucaguaguucaagaccagccuggcugguuagccuagcuaacauggugaaacccugucuccccuaaaaaugcaaaaauuaacuggauaugguugcaaaugccuguagucccagcugcuugggaggcugaggcaugagaauugcuugaacccaagaggcagagguugcaaugagcggagaucaccccacugcacuccagcaugggugacagagugagacucugaaaaaaaaaaaagcauauccuuuuucauuauuguguuauaaacguuuuuuaaauggcagacauugguuuguaaaugguuuuuguaggcuucauguuaagucauaaagauuucacuuaaacauuucucaaugaagugaguacuaauaaagcugguguaucuuuauaaacuuuucucuacauuuuggaucauuugaguagauugguuuuuccuguucauagaauuacuggaucaaaagauauguuuuuaagacccuuacuguaaccauuuucaaacuugcugcuucucagauacuuuuauuauuuuugggaagaaacaaauacuuacuggguuccuauaauuuuucacuuaaacccuuuuaaacuuaugauaugcuucagacaugcaaaaagauacagagaaugauguaauuaauaucuguguaucuaccaccuagcuuaagaaauaaacagucacagacuuaaaauuccugugcagcucuuccugauuauaaaugucuguauuuaccaacagugauguggauauuuaaucuuuuuuuuuuuuuuuuuuuugagacagagucuugcucugucaacaggcuggaguguuguggcgugaucuuggcucccugcaaccuccaccuccuggguucaagcuauucuucugccucagccucccaaguagcugggacuacaggcccagcuaauuguauuuuuaguagagacgggguuucaccauguuggcaaggauggucucgaucuccugaccucguggucugccugccuuggccuccugaaguguugggauuacaggcgugagccacugcucccggcugauauuuaaucuuaaccauuaauucaggucugcguccaagaucuuuuggaccagaauucagaauuuuuuucagauuuuuagagagaugacaugcauauauuauauauaagcuaacuuuucaaguauguuuugggaauggucccuaauuucuucauuaaacacuuugggauuacugacccaguccaggucugguuuuacuaucauauuaguuauaaauuuuuggauuuuuagacauuuuuguuauucagucuugugaauagacguuugugaacagguacaucuguuuuacuuuguucagcuuaaucacugguagaauuuguugaacuuuguguugagcugaucacgauguaguaugagauguauaaaaugcaagguaacauaauuuuauguccaaacaauuuaauauuuuaggauuuuaugaaaucagguuaucagugagcacuagagucguuggggaaggcuacacaaccuagaacuugacuuguuucaacuaaguggcgcagauugcuguuacaacuggagaacaacuaugauuaacaaccuuguguuuauuucuaaguaucuagcuugacaaaauauuugucaugaugagaacuuugagagaacuuauaauuaacuugauuaauugauaagaauuauuaaaaacugcaguuaacuugauuguaaacugaguuacccuuccauuaaaaaaaggcgaaauaguaacugacaaguguuaagauugcucguuuacaauugaugugucauugcugcuccaagcagagguggccuuucagauagguaugcucugaaacagugcugcuuuagccacacugucguguaguuuuagucucuagucaguauuggagaaucagauuaagguuauacaacuagaugcguaguguuagcagacuuaauacauuuuaguuacaugcugaguguagaggcagagaaaucugugccuucauuaacuuguagauuuauuuucuuucugucuuucugucugucugucuuugggucugucugucuuccuuugucacccaggcuggaguauagugaugugaucauaggucgcugcagccuugaacuccugggcucaagcugucuuacugcuacagccucccaaguagcuagggcuaaagaugugugccaccacaccuggcuaauuaaaaaaaaaguuuuuuguggagacgaggucuugccguguugcccaggcugaucugaagugauccuuucgccuuggcuucccgaaguguugggauuauaggcauaagccaugugccuggugauuuuuuuuuuuuuuaaacuuccugcuacuuacagagauauuagcaaucugucuaugccuagcccauuaauugcuguguaaauuagugccgaaugguuguggaggucuuuauuuaaaccuguaguuuauaaugagacuuaaaaaaauguaaguuuuuuuuuuuguuuguuuuugagacaggguuucacucuguuucccaugcugggaugcagugguguguucuuggcucacuguagccucugccucuggaguucaagcaauucuuaugacucagccuccugaguagcugagaucauaggcgugugccaucaugccuggcuaauguugguauuuuugguagagacgggguuucaccauguugcccaggcuggucucgaacuccugagcucaggagauccacccaucuuggccucucaaaguguugggauuacaggccugagccaccacaccaggccaaaaaaaguaaaguaauacacacucacuauaaaaagaaaauggaacagagaagaaaaguauguaaguaaggaaaaaggugauuccaucuggucuuucagaaauaggcuuuuaccguacaaaucauuucuguguauauacaaacauacguguauauauccuuuguacacaaaugagauugccucguaagcauucuucuguaaccugguuuuuuucccacuucacaauauguuuuugcaugucagaucuauaucuuagauauagauauuuacuuaauuuuuuuuuguuuuuguuucuuuuuccuuuuuuugaaaugaaaucucacugucacccaggcuggagugcaguggugcaaucucagcucacugcaaccuccgucucccagguugaagugauucuccugccucagccucccaaguagcugggaucacaggugugcgccaccaugccuggcuaauuuuuguauuuuuaguagagaugggguuucaccauguuggcuaggcuggucccgaacuccugaucucaagugaucugcccuccuuggccucccaaaguguugggauuacaggcaugaccuacugugcccugccucuuuuucuuucuuuuuuuuuuuuugagacagucuugcucuguugcccaggcuggagugcaguggcaugaucuuggcucacugcaaccucugccuccggaguucaggcaauccucucaccugaguaacugguacuacaggcacacaccaccuugcccagguaaguuuuguauuuugguagagacaggaauucaccauguuguccaggcuggucuugaacuccugaccucaagugaucugcccaccucagccuuuuaaagugcugggauuacaaguaugagccaccaugccuggccauuguuuuucuuuucuuuuuuuuaaauuaggauugccugaaagaaauuuuuuuuaaacagcagcauugucuuuuguaguugagagauacauaaauuuauucaacuaaucucuuuggaaauuuaagcggucuccuugcugguacaaacaaugcaauaauugaauaucauugcacauuauguccuugaaccugugaaaauauauuuuauggagaauauuuuuuaaagugaaacuucuaguucaacaaugugcacauuuuaaauuuugauagauugugccaaauuguaccucagugggauuuuaaauuuuugguuuauuguucaucuuuucacagggagccuaggauagcagcauauuucucgucccuaguaauauuuauaacccuuuaagaaaaugaacaggaucuuuaaacauguugaaauacaguauuaaaaauauuugacucguugaugagcauaaccccauuacaucagguuguacuaguaauuuugagauuuaugugagaauuucacauauaauuauuuaaauagcuaaugggugguauauuacaucagguuacaucagguuggacuaguaauuuugagauuuaugucagaauuucacauauaauauuuaaauagcuaaugggugguauauuacaucagguuggacuaguaauuuugagauuuaugucagaauuucacauauaauuauuuaaauagcuaaugggugguauauuacaucagguuggacuaguaauuuugagauuuaugucagaauuucacauauaauuauuuaaauagcuaaugggugguauauuacaucagguuggacuagugauuuugagauuuaugucagaauuucacauauaauuauuuaaauagcuaaugggugguauauuacauuuucugguucaacuuacaaauauagcacaucuguguuagccuaguccauuauaguuaguuugaaguaaacugcuguguugcuauuaaagaauuuuuuugcuuucauuugucuuaaugauauuugguguuccuuuggagacucaguucauaaagagcuauuauuauuuuucuaaucuaugaggagagugagagauugcugucugcaguugcauguuaugcucguagcuauuugugggaagagugagaauuaaaggcuaacauauaaucauuguggguagaaguauuuuuauuuuuagacuucugaguauaauggauuucuguggggugaggcgagacuggggcuguuuuucucucacaguauguauauaaccauugggaucagugcuuuucuuuucuuuuuuuuuuuuuuuuugauuuuuuuggauacacuguuucacucugucacccaggcuggagugcaguggugcgaucucgaucucggcucacugcaaccuccgccuccuggguucaggcaauucuccugccucagccucccaaguagcuggguuuacaggcguguaccaccaugccuggcuaaguuuuguauuauuaguagagauggggcuucaccauguuagccaggcuggucucaaacuccugaccucaagugaucugccugccuuggccucccaaauuauugggauuauaggcgugagccaccgugcccggcuucagugcuuuucuuagggaaaaaugauucuggaauuuuugaauauuuuuauuuauuauuuuuuugagauggaaucuugcucugucacccaggcuggagugcaguggcaugaucucggcucacugcagccuccacauccuggguucaagugauucuccugccucagccuccugaguagcugggguuacagguaugugccaccacgcccagcuaauuuuuguauuuuuaguagagacgggguuucaccaugcuggucaggcugaucucaaacuccugaccucaggugauccacccgccucagccucccaaagugcugggauuacaggcaugacccaccaugcucguccugaauauucuuuguguuuuuuucugacaggcuuugugaugugaauaguagugaauugauagugaaacuguauuguuaauaaacacauaauuuaagauaagccagauuucugguaauauucuucucagaauuagauuuuaggaaauuucucuaaauguaaauccuggaaagcuugcagagauuuaaauguuguucugguauuuuuuuuuuuuuuuuuuuugagacggugucuugcucugucaccuaggcuuggaguacaguggcacaguaucugcucacugcaaccuccaccucccggguucaagcgauucucaugccucagccucccaaguagcugggacuagaggcgugcgcuaucacaccccgcuaauuuuuguauuuuucguagagauggaguuucaccauauuggccaggcuggccucgagcuccuggucucaggugaucugcccgccucagccucccaaagugcuaggauuacaggcgugagccaccaugcccagcccaucugguauuuuuaaaaaacucaaaauauaggguacaaaauucaucuuaagugcuugguacaucuuuagcuugguaggucucugacauagaguuuaauagagauuuuuuuaguauugagaacccauuuguccccacagacauauuuucugcgugugauugcucuguguguaugugaauuuuuaauuucuuucuuagaugagaggcauuagucuguuuuugagcuuaugccaucuucuuggaauuaagauuuagcuacagaaguuuguauucuuauuaaugcaggaagaacaguuuuuuaaaaaauugaaaucuugcccauuuaguuaauuauuuucaggggauagaugacaaaaguaaauugcaagacauguacagaaggagguugucaguucauggaauuuguuuuauuuauuuauuuuuauucagagucucacucuguugcccaggcuggagugcaguggcauggucucagcucacugcaacuuccaccucccggcuucaagcgauucuccaaguugauucuccucccucagccuguggagcugcugggaguacaggugugcgccaccaugccuggcuaauuuuuguauuuuuaguagagacgggguuucgccauguuggccaggcuggucucgaacuccugaccucaagugauccgccugccucggccucccaaagugcugggguuacaggcgugagccaccacacccagccuaauucauaaaauuuggauacuguuuaaagauagagaaaacuuucuuaacuugaggaaaauguuaaaaauugcuuucauuauauuuguuuuagauuacauuuaguugcagguuccauaaacuacauucaagauuaguacugcuuuuuaaauguauaugaacuaucuaaugguuuuuacguggauuuagguuaauuguggcguuggcaaacacuuacugccugcuugauuuguauuagacacugugcuagguuuuggagauggaguaagacauuccuuuacuuuuaaggaggugauuaacuaaaacaauaauuacauuauuuuaaaagccccugguuaccucagaggagcaccuaaauuagacugaggggcaugaagguuuguguaggauugugacuguugaacuuaguuuggaaaaaugagcaguaguuagccaguugauggggcagaagaaggucauggaaaccagagacagcuugguauuucagggaauugcauagaccugauuaugguugucacguggagaaggacaguggauaaguaguaguuucagagagauaggcagggccaaaugaugaaaaaucucauaugcacuaccaaggaauucagauuaaaaaaaaauauuuuuugagacaacgucuggcucugucucccaggcuggagugcaguggcaugaucucugcucacugcaaccuccgccucuugggcugaaguuaccuucccaccucagccucccaaguaguugggauuacagguguauaccaccuggcccagcuaauuuuuuguauuuuuaguagaaacgggauuuugccauguugcccaggccagucuugaacuccuuagcucaagugaucauccugccucggguucccgaagugcugggguuauagguaugagccaccgugcccagccaagacauuuuuaaaaugugagaauacacaagcacacauuccauuagcugucagugggauauuaucacaugucauguagcucuggaaaacacuaucaugcacuugugagagaaucacggugaaaaaggccaaugacaucauccuuuuauggaaauaguuuugcccucauggaccuccugcaagggggucuugagcaccccuggaaucccuuacccaucuggagaaucauauuagaagaucauuauggcacugguguugagaauuguuuagaaccuauaaaaagaaucacauuuauuuuugcuuuuuugagacagggucuugccaugucauccacgcuguagugcaguggaacuaucguggcucgcuguagugcaguggcacuaucauggcucacuguagccaugaacucuuggguucaagcaaucuuccugccucagcuuccugaguagcugggacugcaggcaugagccacuaugcugggcuauuuuuuuuuuuauuuuuaaauuuuuuuugcagagauaggaucuugccguguuguccaggcuggucuugaacuccuagacucaagcaauucuccugccuugucucccaaagugcuaggauuacaggcaugggccacugugucaggccaagaaggacauuucauauugugauccaauaugcgcacuuuaaacaucgcagaaaacaagacuguauuaucucuugcugcuuuacaaauuacuucaaaacuuacuggauuuaaagaacaucuggcuggacacaguggcucaugcuuguaaccccagcacuuugagagaccaaggcagauggaucgccugauaucaggaguuugagaccagccuggccaauauggcgaaaccccaucucuacuaaaaauacagaaauuagcagggccugguggcacaugccuguaaucccagcuacuugggaggcugaggcaggagaaucgcuugaaccugggagacggagguugcagugagccaagauugugcuacugcacuccagcuugggcaacagagugagacuccuucucaacaaaacaaaacaaaaagaaacaaacaucucagauuuuaugaagaguauguauugggugauucugacucaggguaucuagugagguugcagucaagauguugacugcugaguuuacacucauuucaauucuugacugggauuggaggaucuuugaagcuaucucacguggcuguuggcaggagaccucaguuucugaauaugugacucucuucacaggguaguuugaaguuugaguauccucacgacauggcagcuggauuccugagagagagugauuugagagagugacgaagacagaagccccagugucuuuuaagaguuagucaugaaaguacaucauuggaagcaagucauuaaguccaguccacacucaaggagaggaaauuuagucucccucuugaagggaggagcauuaaauaauuuaugaacauacuuuaaaacuaccacaaauaauugucaggagaaugaaucuuccaugagcuucuuauuucuuuuguuugagauggaguccugcucuuucacccaggcaggagugcaguggcgcagucugggcucacugcagccuccaccucccggguucaagcgauucuucugccucagccuccugaguagcugggauuacaggcacauggccaccaugccuggcuaauuuuuguauuuuuaguagagacgggguuucaccauguuggccaaacuggucucaaacuccugaccucaagugaucugccugucucagccucccaaagugcugggguuacaggcaugagccacugcauccagccgagacucuuauuucauauacacccuguugagugugccaggaaugcaagcaaggccuugacuguuccuaggccaggccauuuuucaggauuguguuugcagcgggccacuuugcgggaggagguaaugucuuccauugggacaaagagcaggccuacuuacuacuuacuauaaaagugguggauuccggccgggcgcgguggcucaugccuguaaucccagcacuuugggaggccgaggugggcggucaggagaucgagaccauccuggcuaacauggugaaaccccguaucuacuaaaaauacaaaaaauuagccgggcgugguggcacgcaccuguagucccagcuacucgggaggcugaggcagaagaauggcaugaacccgggaggcggagcuugcagugagcccagaucgcaccacugcacuccagccugggcgacagaacaagacuccgucucaaaaaaaaaaaaaaaaagugguggauucccuaagcccaauguuccuuagcugugaugcaaacccacugccuguguagcauccaucugagccccuccaugucaccuuaugggacuuggggauaacagggagacagugcaaacauguucaugcuugcugcgcugugaguaauaaaaguucuuuguguuugacccaggagacucauguauucugucaguauccaugaaauggucauaggcuaauguauuaaccuguaaguaggguuaaauaaaauccuaguuccuucacaguucucaacauuacuuauguuuacuuuagugugauacacugugaaaauaagcuauacauuuuauuuucuguucuauuuaucuguuuauuuuagagauccuaucucuauucuccuauagauaggaucuugcuauguuguccaggcuggucuugaauuccuggacucaagcaauccuacuuccuuggucucccaaagugcugggauuacaggcacaggcuauugugccuggccaagaaguacauuuuauauugugauccaguaugcacaugugcaugcauaugcacaccugaaacauugcagaaaacaauacuguuaucucuuguugcauuacaauuacuucagaacuuacuggauuugaaaaacaaacaucucagauuucaugaagaguguguugggugauucuggcucaggguauguagugauuuuauuucauuuaaaacaaacaagaaaacaagcuugguugcagcuuaucaagcugauuucacaaccuacuauugggucauaauucuaaguuugaaaaacacugacuggggacuguuaccguuuggcuguguccccagcaaucucaucuugaauuguaguucccauaaucccuacauguuguggagggaccuggugguagcugaaucguggggucgguuaccccaugcuguucugauagugagugcucacgagaucgauuuuauuuuuucuuuuuugagacagagucuugcucugucacccaggcuugagugcaguggcauaaucuugggucacugaaaccuuugccuccuggguucaagugagcacgucuggguaauauuuguauuuuuaguagagauaggguuucaccauguuggccaggcuggucuugaacuccugaccucaagugauccacugaccuuggccucccaaaguguugggauuacaggcguuagccaccgcgcccagccuagaucugaugguuuuguaaggggcucuucccccuuugcuuggcacuucuuccugccgccaugugaagaaggauguguuugcuuccccuucugccaugauuguaagcuucuugaggccuccccagcccugcagaacugugagucaauuaaaccucuuucuuuuauaaauuacccagucuuauggguaguucuacauagagcuugagaauggacuaauacaggacucugaggcuagaggcaggcagucagguuagaaaguuguuuuaauucagguaggauaggauggcauaaaccaagguaauaauugugggaauggaggaagaggaucaauuuaagagguaccuagaaaucaaagcaacaggaauuguauuguuuugauaauauguguguauauggaguaugaagauuuugggaggacucucaggcucuggcuugagcagcugauguuauucaugugaauagauguuguccacuaccauguucuuuuuuugauuuuuuuuuuuuccccugcagcagcagguuugguuuuggaauggggagaccuugauacggaguucaguuugggggcaugguguauuugaggugcaugugaggaguauaagugaagauguccagaagugggauacauaguuuugauucucaaaggagaaguaaaaaaguacuggagaaguagugaauuuggagucuuuguuguacauauguuauuuuaagcugguggaggcagggagaaaggauuucuuaaggaugauauuguagugugagaauaacauagggaugaagaucagaaacauuuaagggaggaacgaacaaagaaggaggaggguuagaagaaaagagcauaugauauaaagaaaccaagagaggagagugucaaaaaauugggagugcuuaagaaacaagauguauuauagacagaaguuaaaaaggcauuagagaggaaaaguguucauuaacuaagguuucucuggagaagccagagggaauggggacuaaaguacccuguggaaggauuagcuguagcccacuuccaucagaauagaggaaguuaaggaugguuguugcugucaaugaacauguggagagagaaaguugagauaguuccuguuugauuucuuuguuucucucuuauguaggagaugagauacguaaauuugauagggcugcuguaagaaaguaccaucagcugggcacgguggcucacgccuguaaucccaguacuuugggaggcugaggcaggcgaauccguugggcccaggaguucgagaccagacugggcaacauggugaaaccccaccucuaccaaaaauacaaaaauuagcugggugugcugaugcucgccuguagucucagcuacucggguggcugaggugggagaagugcuugagccugggagguugaggccacggugagcugugauuguaccacugcacuccagccugggugacagaggagaccuugucucaacaaacaaaaacacaaaacaucucccgccucuccaccccgcuccccccacagguuugaaaccaccugccuguuauuucaaaccaccuguguguucacauuuuugaggacuuuuaaccuguuugaccagaauagauacugucuuuagaaucucauuuuugacaauaugauuuacuugguacuguuuucaaugaagaaacacuuauaagaaucaauuuacauaacaauggauuuugggaaaauauuguuuaauaugcugaagccuguuguuacuugaccuaagccaaugcuuugaaaugaugcuaggaaaucagagagaucuaguuuagaucuauauugucuuugaaagaagucuauaaaguugauagcuauaguuuaguggguucugcauccacagcucaaaccaccuguggaccaaaaauauuugggaaagaaucuuaaagucaccuugaaaaaaaaaguggaaaaaaaaaaaaaaagaaaauacuugggaaaaaauaauacaacauggaaaaauaauacaaauaaaaaacacaauaaguauaacaacgauuuacauagcaucuacauuuuauuaaguauuauaaguaauuuagagaugauuuaaaguaugcuggaggauauccauagguuuuaugcaauuacugugucauuuugaaucagggacuugagcauccugggauuuuuguugucuggggcagucuuggauaucuggauacguucuacuggagccaguccccagcagauaccaagggacaacugccugugguuuuaaaauuuguuuuaguuauacuuguagaguaugaacauguuuucuuuuuugaaaaaaaaauucaggugcuuuaugguaguuugaguguaaagcuuucuaaguugagcuaaagccuccacaaacauuuuuccccuuuauaacacaaguuuccuucccucuaauuaucgcuguuucaaaauuggcauuucccguguaggaauucuuuacauacucuguuuacagaucauuauacuuauguucacuguauuuuucaccuagcuuuugguuuaucuuuuaauuuuauuuacagcauuuuuugguauaauacuuugucauuuugacauaauuaaguguguugguuguuuuucuuuaugguuuuugcuucugguuuuuuauuuaagaagccuuuuccuaacucaaguucacaaggauauucuucaaaauuuucuucuaguacuuuuaauggcuuaaaaaauuuauaucuuuaauguauauggaauuuauuuugguguacuaugugaagacgaguauacguuauguuucucaaagagcaacaaguauuuaaacuucauuuauugagugauuuuucauuuccucacuguauuagucuguucucauguugcuaauacagacauacccgagacuagguaauuuaaaaaggaaaguuuuuuuuuuuuuuuuuuuuugagacggagucucgcucuugucacccaggcuggagugcaguggcgcgaucucggcucacugcaaugucugccgccuggguucaagcuucuuaugccucagccuccugaguggcugggauuacaggcaccugccaccaugcuugguuaauuuuuguacuuuuagugagauuggguuuugccguguuggucaggcuggucucgaacucuugaugucaggugauccacccgccuuggucucccaaauugcuggaauuacagauguaagccacugcacccugccaggaaagagguuuaauggacucucaguuccacauggcuggggagaccucacaaucauggcagaaggcgaaugaggagcaaaauuaugucuuacauggcgacaggcaagagaacuugugcaggggaacuccaauuuauaaaacuaucagaucccaugagacgcacucacuaccaccagaacaguagaggggaaacugcgcccaugauucaguuaaguacaccuggccccacccuugauacaugaagaugauugcaauucaaggugagauuugaguggggacacagccaaaccauaucacucacuguuuggaaacguuacuuuuaacauauauuaaauucccauauauaauuuagacccuguucuugggcuaguacuauacaguuuucguuauuauaguuuuacaaggcuacaauacuuuguaagaaaccuugcaggucagaugugguuuuguugucaggaauuuuuuccaguaauacuuaguggacauuauguaguauccaguaaucacacacauuguuuucuuaaugaaauauaugaagucacacuaugugggauacauauaaacaguaaguaagcucagaucaggucaagguuugcugcuagaugaguuaaaaggaaaaucuuauuuucagagguuuuuggauuuuugcaguacaaaugaagaauuauggauuuguaauuuauguugcuguugagggcugucuuccuuccuuguucaucuauuuuaaauuguuugguuacucuuguaucuuuacucuccauuugaauuuuagagucagcuuguugaguuacuugaaaaauccuucaacaccugugaaaggaagggaucuauagcugguuagcaaaauccuguagagauuuuucacugggauugugcuaaguaguuggggaagaacuaaaucuuagcaguguuugucuucucauccaugaacacagauaacuuuguuuagguguucuuucaugucuuucaguaaaauguuauaguuuuuuucccccaaaauucuugcacauuucuguugauuuacaucaaaguacuuuuaugguuuuguugcuguugugaaugggauuuaaaauuuccuuuaaauuaaaaacugcauuuucuaguuguuacuacugauguauacauugauacuuauauauugauauugaguuugaccaguuuguugaguucuguuauucuaauaacuugucaguugauuaucuuggguuuucaguuagcaagucagauauucagacauugaguuuaaucuuuuccuugucaaucuuuauacuucuuguuuuuuuuucuuuuucuuuuuuguagacagggucuugcuauguaucccagguuggucuugaacuccuggccucaagcgaucuuccuaccuuggccucccagagcgcugggauuauaggcaugagccauugcacuuggcacuuuuuuuguuuguuuuccaguugcaugguauguuuucagcguucaguuuugagacaucuaaaauaucucuaaaauauuguuuacuaugaguacauuaugcuguaaucacauucugaaugcgugaguacauacaugguagaagggcuagaucuucuuuaaguggggguaauggaaagucucugagaagggaaauauuuauuauuggaggauuuaaugugugaucuuuucauuacagauaugguguaagauacuucuucaagauuggacagcuggggaccuucuucugauuaaccuuaaaccaacuuguagccauagagacaccucacaagguucccauuuuuguuguuguuguuguugauuuucugcucacaccuuuccugaccuugcaaccauguauggaagugcccgcucuguugggaagguggagccgagcagccagagcccugggcguucacccaggcuuccacguuccccucgcuugggucaccgucgaaccaacaguacgggagggaguucgggaagcaguguuggagguggcagugggaaaacccuuucaauggaaaauauacaaucuuuaaaugcugccuaugccaccucuggcccuauguaucuaagugaccaugaaaauguggguucagaaacaccuaaaagcaccaugacacuuggccguucugggggacgucugccuuacgguguucggaugacugcuauggguaguagccccaauauagcuagcagugggguugcuagugacaccauagcauuuggagagcaucaccucccuccugugaguauggcauccacuguaccucacucccuucgucaggcgagagauaacacaaucauggaucugcagacacagcugaaggaaguauuaagagaaaaugaucucuugcggaaggauguggaaguaaaggagagcaaauugaguucuucaaugaauagcaucaagaccuucuggagcccagagcugaagaaggaacgagcccugagaaaagaugaagcuuccaaaaucaccauuuggaaggaacaguacagaguuguacaggaggaaaaccagguaaguucuacguguguuuaccuuuauuggcugaauucauguauauaaaugaaauagccuuuuuuuccccuuuccuagauuuuucccuucguaguauauguaucuuccuuuuuccuauugauuuuacuguuuuguguccuccauuucucagcccuuuccaaauuugguccuguacccuguuuucuucuagcugcccaugucuccuugcucccauucuugcuugguucuuuucucugguuucucuuucucuucgugucuuuccuuucagcauauguuaucuuuuuuuuuuuuuuccaauucuucugagaguauaauuuugccacacucucuaauaucuauuaccaaauguauuuuagaguagguaacuuaaauguaagguauaccauuaagauuugucauaaugucaaaaagucauucuuaaaaacaaaacaaaaugacuaucacaggauaagucaguguugucagcugagaacagaaauuacuuuuaaaaaguuaauguuggccgggugcaauggcucacaccuguaaucccagcacuugggaggccgaggugggcggaucauugaggucaggaguucgagaccagccuggcgacguggugaaacccugacucuacuaaaaauacaaaaauuagccaggugugauggcgugugccuguaaucccagcuucuaaggaggcugaggcaggagaaucacguaaaccugggaggcggagguugcagugagcugagaucccgccacugcacuccagucuggagugagacucugucucaaaaaagaaaaaaaaguuaauguugaugauguauuuauuaaguacaaacaauaaguaccuguucuuuuuguugccauucauggaaguuuaacuucaggaugcuuuuguagcuuuucguucuguaauucuuuacauuuaagguggaggaaaggcaacuuggugugauuguuuacuuguagaaaauaaaugagaugacugggcauuauaauuaugggcuuugcaauuugagagcuaagugcugucacauuagcuacaggaaauauucacuuauuuuucugugcuccuccagguuauaguugauguuugaugauagccaugccacauucagugaggaagcugaugacuccaaagaugugaacaaaucauauucaggcucuacuaguuaaaauguuaaacauacuuuuuuuuuuuuuuuuuuuuugagacggagucuugcucugucucccaggcugaaguacagugacgcaaucucaguucgcugcaaccuccaccucccagguucaagugauucuccugucucagccuccugaguagcugggauuacaggugcccgccaccacgccuggcuaauauuuguauuuuuaguagagacgggguuucaccguguuggccaggcuggucucaaacuccugaccucaggugguccaccugccuuggccucccgaagugcugggauuauaggcgcgagccaccgccaggcccauacuuuuuguuuaaaagacuuuuagaauuuuucucuuuucacauuuuuuucccccauggcccaaguugucuguacuuuuagaaguuuucuuaaacuugcaagcuugaguuuuuuuccuccuuaaaaaagcugucuuauacucuuaaaggagaauauguaauuagcuaccucauuguugguauuacacuuuauuuuuggauuagguuaauaaaaauuauaaagaaagcaacugauaucaauuucugcaguguucuuaaaugauacuaagaaguaaagaagcaaucagaaaugaucugugucucugaugaagaagucaucugccacacaaagauguuuaggucaaugauggaccucauguaucacuguggucccauaagauuacaauauaguguuagccaggugugguagcucgcaccuguacucccagcacuuugugaggcugagagggugcggauugguuaaggccaggaguuugagacuagccugggcaaaauggugaaacccugucuuugcaaaaaaauagaaaaaaaauuagcaggguuuugugauggacgccuguacuacuugggagacugaggcaggaggaucaccugagccugggaggucgaggccacagucagccgagauugggccacuguacuccagccugggugagagugagacccugucucuaaaaacaaaacaaaaaacaaagauuauaauacaguguuuucacuguaucuuuucuaugcuuagauguguuuagauacacagauauuuaccauuguguuacaguugccuacaguauucaauacaguaacaugcuguacagguuuguagccuagaagcaguaggcuauauccuauauccuaggugugugguaggccguaccagguggauuuguauaaguccacuugaugaucuuugcacagugaugaaaucgccuuucucagaacauaucucugucauuaagcaacauaugacuguaaaucuaauuuaagauuucgguugauugucuuaccauucuuacuauuaugcaguccagauauucagaucuacuguuuuggcuacuugaagaucucuaguuacauuacauuuuguauguuaaagcuccagacacauuuucagcuauaaaaauagcucaauuuuucuguucauaaauauaaaacagaaaagcauagauaugaaagcaaaauauauuccagauccucccaucuacugacaacuuugcuauuccacuguuaacauuuugacauuucucuuuacugaaauaucucuaugcauauacacguaacggauuuaccugaauggaauacuguugguauuaugcugugaccuucuuuuagcuaacaacauuucuacuguauauuagaggccucuaauauauaucuaaaucguuauuuuuaaugccuccuaccauucuauuguaucuauucuaguuaauaucacagggccaaaauucuucagauuuacuugguaguacaacgcaaauuaaaaaccuugaauucauuugaaucagauuucuaaguaauuagaaauuaugauaauuuuauucuuucucagauacauuauaacuucaaacuacuuugcuuuuacuuuuuaaucaauuauuaaguugucacuacucaaaauuugaauguuuuaauauacuuaaaucucuuucuuagagacuuagcuucuuuaaagaagagaaauuguccuuuaaaaaauauuccuuagaaaguucuuugaguuugagucauuaagacuuuaagaauguguaaagaaagaaaaaaagcuaaaauagaccccacugauggggucuaaaauuaaggacaggguucuuaaaugcuggcucagaaacaucagcaucaacaggcauauuugguuaaaacauagauugccaggccucccuucauaccagcuaaguacaaucucuggagaugggguccaggaacuuauguuucgaacaagcuucucuggugguucugaugagaaaccacucuugggaucuuuagaauuuaguaaaucuaaucuaauucuuuuuuuuuuuuuuuugagauggagucucgcucuguagcccaggcuggagugcagcgaugcgaucuuggcucacugcaaccucugccuccuggguccugguucaagcaguucuccugccucagccuccuuaguagcugggauuacaggugccccccaccacaccuggcuaauuuuuguauuuuaguaaagaugagguuucaccauguuggccaggcuggucuugaacuccugaccucgugauccgccugccuuggccucccaaagugcugggauuauaggcaggagccacugcgccggguguaaaucuaagucuuaaacuugucuguugccuguuugucaauuugugaugguucuguuguggcacuuuugagcucaaccaugaaaggaaaagaaacaagggaccauuugcucagugugucucauccuuuauucuaccacuuuauaucucagggaugugaccuacucuuguucguaaugaucauuaacugugacagggacccucaguggauggggcauguguaggggaaaaggguguuuaaaauuuuagauauguuuaguuacaaagagcccuccaggugauuuugaugucucuucaccuugugaaucauugaugcaccagauaaauguucaaaugauauaugacagcagagcagagaaguacauuuucuucaguugacauuuuugaguugucaguacaauacugacuuuaguuuuuaauuugcauugcacuaccaaguaaauuaguugaauuugucaguugaaguacaacaccaaaaagaauaauuccuaaauauaaaaugauaguacauucucagguuuuuuuuuuuaauuguuguuguuuugagacagagccucucuaugucacccaggcuggagugcaguggcguaaccuuggcucacugcaaccuccaucuccaggguucaagugacucuccugucucagccucuggaguagcugggauuacaggugugugccaccaugccuggcuaauuuuuuuuuuuuuugaaacaagagucucgcucuguugcucaggcuggagugugguggcgugaucucggcucacugcaagcuccaccucccggguuaaugccauucuccugccucagccuccugaguagcugggacuacaggcgccugccaccacgcccagcuaauuuuuuguauuuucaguagagauggaguuucacuguguuagccaggauggucucaauuuccugaccucaugauccgcccaccucagccucccaaagugcugggauuauagguaugagccaccgugccuggccaauuuuuuguauuuuuaguagagacgaguuucaccacauugaccagacuggucuugaacucucaaccucagguaauccaccugccuuggccucccaaaguguugggaucacagucaugagccaccgcacccagccuuuuuuuuuuuuugagcuggagucucaguguugcccaggcuggagcgcaauggcacaaucucggcuuacuggaagcucugccucccggguucaagcgauucuucugccucacccucccgaguggccaggauuacaggcgugugccaccaugcccggcuaauuuuuguauuuuuuuuuuugagacggagucuugcucugucgccagcuggagugcagugacacgaucucagcucacugcaaccuccgccuccugaguucaagcgauucuccugccucagccucccaaguagcugggauuucaggcaugugccaccacgccuggcuaauuuuuuguauuuuaguagagacgggauuuugccauuuuggccaggcuggucucgaacuccugaccucaggugaucugcccgccucaaccucccaaaguguugggauuacaggcaugagucaccaugcccagcuuaaauucuguuuuuauaguuugguauugaauuguaaauaucaggagaaaaaaaugaguuugcuuucuuuaguuuugugguuaaguaucaauauaaccuaggucuuggaaacuguaucuguauuuuuagggguuguauuggguucuuuuucuuuuucuugguaaaaaugagauugguaaauuuggaguauguaaugguguauacuagugcccaaauaugagauucuuuauauguauuuagauaauuaucauaguguaucauauuugaauauuauacaauuucaaauguauuguuaauaaaaaaucacaguuugauuuaauugaaaaguggcugagacauaauuuuuuauuauaagaaauauugugagcuggguaugguaauauaugcauguagucuuagcuacucaggaggcugaggcaggagaaucccucgaguccaggaguuugaguccagccugggcaacauagugagaccuugucucuuaaaaauaaauaaaaaaauaaauaaaaauuuaaaauaauuaagaaauauuguggaaaaauugcaugugaauaaacacuucuuuuuaaaggcucuacuuuucaagaauggauugacaguauaugugugugucagauuauacguguguguguguaucaaauuuagaguagauuugaaguuacuggauuuaucaccauuauaccuggaauuagcuagucaccguuauaccuuguugaugaugcugaaacuaugccccucacuaagauaguuuuuauuaugaagugacucagaaaugucaauuuuaaugaaaaaaguuauuggcguacuuguucauuuuggaauaauugaagcaauuguuuaugccuguacuucagaagcuguguggaaaauacguaauauccuuucuaaguaucagucugcauucaaagacaaaauauuugaaucuucugaauacuucaguuccagugaaacaguccacaggauuuucaugccaaaaaacccauaugugcugaagaauggugaacaccgccuuaucuagauuccaccccuugcccuaauuaaacaccagugcuggcagcgaugcauucuccguauacccacuguaauuacuacacaauccuaaaauuguauaacuuugguccaaaaaacgaagggugcaauuuuaaaguaaagugaaacacugcaaugagauacagagacagagaaugcuaauuaauagauuauagucagccagcaguggggccuaauuaaacucugcauucauuauacccuccauagcccucagaggucaggcaucuuccacuugauaaagaagauugguuuaauaggauuuacaguaauuaaaugguuuccccauuucaguuugagacuggggauuuagguccauucuaaauauuggaucugauuggaccauagagaucuuguucuaggauccuauuagauguaaagacgcauuugcuuagaauuacuugauaugugugguucuuuauuauggaguucuuuuagaagauguuucugauauaaauacucagcaauuuuuaugucucauccuuuuguuacugaacuuucaaauacugcugguuggagaguuagaauaguauguaacagggaaggcuuuuucuuuuucuuuuuuaaaauugggagucaggaagguuuuugguguauguuugacaaagaaugaaaaucuagcugugagcuugguggaacugcagagcuacuaagacuuuggauggggccgggcucaguggcucaugccuauaaucccagcacuuugggaggcugaggugggcggaucacgaggucaggagaucgagaccauccuggcuaacacggugaaaccccgucucuacuaaaaauacaaaaaauuagcugagugugguggcgggcaccuguagucccagcuacucgggaggcugaggcaggagaauggcgugaacccgagaggcggagcuugcagugagcugagaucgcaccacugcacuccagccugggagacagagcaugacuccgucucagaaaaaaaaaaauacuuuggaugauuuuuuuuuuaaauucuaaacagcauuuaaccagauuaucaucauacuuuuuaaauuaugccuugaaauaauucuguauguuaaauuuaguuggaagcuuauuuuaaaaauguuuauuuaaagcacugucauugaaauauuucaugaacaaaauacuguuuaauauuauaggacggcaggugaauuuaauguuuuuugccuuguguguuguguuucuucucuuuuuggagucugauuuuuauguugcucauuuacuuaggaaucgagaauuucuaguucagaacugcaaaaagauaaccuuguguaauucuuugucauuuuuuuuucucauuauuuggagacuuuugacuauuaacauuuauauaauuuuagguuguaucuugauuugccgcaugauaaaagccauuauuauuugccauuaaauaaacuuuuuuuuuuuuuuuuugagacagaguuuugcucuuguugcccagccuggagugcaauggugcgaucucggcucagugcagccuccaccucccagguucaagugauucuccugccucagccuccugaguagcuggaacugcaggugcacgccaccacgcccggcuaauuuuuuguauuuuuaguagagaugguguuucgccauguugggcaggcuggucucaaacuccuggccucaggugaucugucaaccucggccucccaaaguguugggauuacaggugugagccacugcuccuggccuuaaauaaacuuugucaugagguugcuaguuguuucacugucauuuaaagucugaucuuaaaauuugggaucuaugucuuagauuauuguuuuaauuuucuuuuugauaauucuguuuuaacaaggagauguagauaaauugguauccuuguuuauugcccagauaaguuuaaucuuuuuuguuguuucagaaggggaauguguuaaaggcacuaugcagagugccaugagaaaaugaaaucaaauguaaaauggauaauguuccuuuuggggaguuaacaaucauuucgagaagcaaaauuuguacauguauggcuuacagaaauuugaacuaugcauuuaucaggucuugaucauaggugaagguauuuaaaucagugugggaaauuugcuucuuuuacaguugguaaguuugcuuaucuggaauguagugaaguaugaaaaauaauuaagcagagcuaauaaaaauguugcacaaauaugagauagggcuuauaugaagaaauaagggcagaguuugccagauaauugcaguuucucucucacuuuuuauuuuccucugucuuuuuggaucucauagugcaguguagugugugaucucaucucagugaaauaaaauuguuuuuagagauuugcuaauuuacagcaaauuugcagauagcaucuuaaauauaauuuggggguccucuuuauugugcaaaagaaaucagaaaauggguuuaguuuuuaguuacauuaauguuaaucaguggaggucauaguuucauuuuuuaacauuuaaaaccguaccacccucuggaacuugccaucuguuaugagugcacuguuaugcccagaagaguauaggaggugcuuagaaaccauacuuuauaagaaauggcugaaggaacucaagaagagaagacuugcaacauuuuaauuauacucuuaaguauuugguggacagccauguugaaggagauuuuuccuuuuuucuuucuuuguuaguauuguuuuuggagaacaaacacuggaaaaaugagcacaaauauuaagguuuuaaauuuuggcugcaaggaggaauggauuuuugaaaaaagcuauauccggccuggcgcaguggcucacguuuguaagcccagcacuuugggaggccgaggcgggcagaucaugaggucaggagauccagagcauccuggcuaacauggugaaacccugucucuacuaaaaaugcaaaaaauuagcugggcuugguggcgggcaccuauagucccagcuacucgggaggcugaggcaggagaauagcgugaacccgggaggcggcucuugcagugagcccgagauugcgccacugcacuccagccugggcgacagagcaagacuccgucucaaaaaaaaaaaaagaaaaagaaaaaaacuauuuccauuugaugaaagaacaguuucacaaaguaaugcuucaucaucacuagaaguggucacugggaggucagauugccuucugacagcugcgugggugcccuaagucauugaacucuucacaacgcccaaggggguauggcaucaagugguacuuuguggagaaacauuuagggaguuuaccccauccucccagguccuuuuguccuuuuucucccuccccaucuccuuuccuucuuuuaugacaauuuuguugagauauaauugaauucacccuuuaaaguauaguuuuuucuuuuuuuuuuugagacggagucucgcucuguugcccaggcuggagugcaguggugggaucucggcucacugcaaccuccgccucccagguucaagcaguucucugccucagccucccaagcagcugggauuacaggcacacgccaccaugcccugcuaauuuuuguauuuuuaguagagacaggguuucaccaucuuggccagacuggucuugaauuccugaccuggugaucuaccugcuucggccucccaaagugcuaagauuacaggcgugagccacugugcccagccuuuucuuuccuaaucugauuuacucaaugaagauuuugaagaaaguaauaguaaguugcccuagggaguucuugaacgagggcauaaaugauguaauaaaaaauacuguucaggagcagcuuuuacugcugucagcagaguggauugaagaaaagguggggaaaggaaaugaguuucuuguagaagaccuggauuaaacaggguaauaggaauggagaagaaggugcacauccaugagauuuucaaagaaauauuuggauauaggcagggaacgauggcucgugccuguagucccagcacuuugggaggccaaggugggcagguuacuugagcccaggaguucaagaccagccucggcaaaauagugagaccccaucucuuaaaaaacaaaauuagggccaggcacgguggcucacgccuguaaucccagcacuuugggaggccgaggcuggcggaucacgaggucaggagaucgagaccauccuggcuaacauggugaaacccugucucuacuaaaaauacaaaaaaauuagcugggcgugguggugggcgccuguagucccagcuacucgggaggcugaggcaggagaauggcgugaacccgggaggcggaguuugcagucagccgaaaucgcaccacugcacuccagcccugggugacagagcgagacguugucucaaaaaaaaaaaaaaauaaaaauaaauaaauaaauaaauaaaaaauuagcuggcauggugguaugugccuguagccccagcuacuugggaggcuagggcaggaggauaguuugaccgcaggagguggaagcugcagugagcugugagugcacuacugcacuuccaccugggugacagagcaagagucugucaaaaaaaaaaagaaagaaaagaaauauuuggauauagacggcaagagagaagaauacagugaaccaugguauugagauuggggaacucuuuucccuacgauuaacaacggaaauggauuagaaaguggaacuaaauuuagaguaaggaaugaugaauuugguuuuaauuauuugaauaaaaguuuuucauaagaauuuggagauaagagacuaaugacugugaccucagguacaugcauauagauguuauaaaggugugcuuguuaauguuggggaacucacuuuucuaguuaauucaguaucagcuacaugccucugcuuaugggaguaagaaguggagagggagaagccauuagaagauacaguuuuauauauauguucucauccagcucgauuuguguuuugguucucugucuuuauugugguauuuuuguuugacagcagauaccuugagugauucucucaauuccugaaaguuauuauuuauuaaaguuaauacugauuuaugauuuuuuuacaaacuucuacuauuagaugucccuuauuuuguuuuaguuaacaacaaguuuauuggagaucauguaccuaccucuguugugauaaauuaggagugacuuugggaaaaagagaaauauuacaaaaaaugugcuuucagugaggaaaugauaaauuuuguuuuugaaaauguucuuuucuucccuuauggacaagauuagaaaugcuuuuaugaacuguuuuugugcuaccauacacauuucuaaaaauacucauuuuucuuuuucuuuuuuucuuuuuucuuuuuuuuuuuuuuugagacggagucucgcucugucaaccaggcuggagugcaguggcgcaauacuccgccucccgaguucaugucauucuccugccucagccucccgaguagcugagacuacaggcacccaccaccaugcccggcuaauuuuuuguauuuuuaguggagacgggauuucaccguguuagccgggauggucuccaucuccugaccucgugauccgcccaccuaggccucccaaagugcuggguuuacaggcgugagccaccgugcccggccuaaaaauacucauuuuucuuuccagauuuggaaaguuagucuuuaacguagaucuuuuccuuugauuuuuccauauauuaacaauacuuacugaacccuuucccccuuuauuuugccagucuuuucuacguaauaggcuuuccuuccuaauacuggauugcagugacacuugcuuaauuucauauguggugacuguauaggccgagaaagugagauaguucagccuuaauguacacaguguaccaucucuuaccgguggcugguagcuuauguacuuucagagaaugugguaugcaaagaucuguguagcuuugaagucauccugagauaacugcucugaucuuaaaugauccucagauacuugaagaguccucuguagcaguaauucuuaaacuuguuggccacaggaccucuguauauuguaaaaauuauuaaggaccccaagcagcuuuuguuuauguagguuauaucuaccaauauuugucauauuagauacuaaaauaaaaaaauaauauuuauuaguacauuuagaaacaauaaaccuaauaaauguuaucauaaguaacguuuuaaaaugaaaaacaguuuugcaagucucucuuucuuuuuuuuuuuuuuugagacagagccuuugcacuguuuccuagacuggagugcaguggcaugaucuuggcucacugcagccuccgccucccggguucaagugauucuccugccucagccucccaaguaggugggacuacaggcaucugccaccaugccuggcuacuuuuguauuuuuaguagagacaggguuuugccauguuggccaggcuggucuggaacuccugaccucaggugauccaccugccucagccucccaaagugcugggauuacaggcgugagccaccguacccagccuaguuuugcaugucucucuaaggaaaggaggacuacaaaucuaaaggccuuaugugggucuucugccucuuguaagaggcugccacuagagugcucacuaggucacucuuuagcugagaucucuguuacuuguucaguauuguaauaaaauauuaugaccugugacaucaacauggauuaacaaguaucuggcuucuuggucaaggguuaggaaguuacacuguucuuuaguaacagugagcaaugggaaaaugcugugaguaauggugaggaaugguaacuuuguugauuuguuguugauagcauguauuucuugacccuuagagagguucuuugggugggcugucuuaaggaagcccuuauauuguaguuggcuaaccaacaggccugcgccaucacacccagcuaauuuuuguauuuuuaguagagacgggguguugccaugguggccaggcuggucucaaucuccagaccucagaugauccacccgccuuggccucccaaagugcuggcauuacaggugugagccacugcaucuggccuaccaguacuagagucuggcucuguugcccaggcuggagugugcaguggugugaucuccgcucauugcacgcuccgcuucccagguucacgccauucuccugccucagccucccgaguagcugggacuacaggcaccuaccaccgcgcccagcuauuuuuuuguauuuuuaguagagacgggguuucaccguguuagcuaggauggucuuaaccuccagaccuggugaucugcccgccucagcuucccgaagugcugggauuacagaugugagccauugcgcccggccuguuuuuuuuuuuuuuuuuucuuuuuuugaaauggaguuuagcucuguugcccagauggagugcagugacacgaucuuggcucacuguaaccuccaccucccggguucaaccgguucucuugcuucagccuccagaguagcugggauuacaggcaccugccacuaugcucaccuaauuuuggaauuuuuaguagagacaggguuucacuaugccaggucucaaacuccugaacccaagugauccacccaccuuggccucccaaagugcugggauuacaggugugagccaccgcacucggccuaguauuuuuaauuuuuuuuuuuuuaaacccaguugcauuguauuuaugugauaaaccuacagcauuuguuguauuucaaagaagcauuuuugggaacuaaguuuguuuuauaggacuuaaaauuugaaaaauugggagaauacauucaaaaaauguucuuuugauuaucuuucauggauuugauagccugcauaauaaguaauuucuucuuuucacaugacuccucuuccugggcauaggaacuuaaaguagguacuacauucuuaggagagaagcauauuguaaugaguguuuccagucuuuccugucuuguaauuuuaggagggucuauuucuuauuuuucuaugaaaacauguuaucuaugguacagaguaucuucuuuuucuuucuuuuucuuuucuuuucuuuucuuuuuuuuuuuuuuagacagagccuugcucucucgcccaggcuggagugcaguggcgcgaucuuggcugauugcaaccuuugccucccgggucuaagcgauucuccuaccucagucucccaaguagcagggacuacagacgccugcuaccacgccuggcuaauuuuuguauuuuuuaguagagacaggguuucaccauauuggucaggcuggucucgaacuccugaccuugugaucugccugccuuggccucccaaagugcugagauuacaggcaugagccacugcgcccggccuguacagaguauuuucaagagaugaagcagguaaaagguuauuuacuuaaaugguagcagauaaauuuuuggauuucucuugguauuucugaugaaagauacuuauuuuaaagggauaguguauugggucucaauuguuggaaaguugugggaacacuggcuguuagaauaacugggggcagaagguguuucuaggauuuaggguggagaggucuuaaaguuaccacauuccccucacugcuuaggacaggucugcauacugaaaagcuuucccucauaccauaugauuuucauaugucuugcuaggaauuugauaggugaaaaaaaucugcuuauagucauuugagccaagauccuauaacuaaauaaauguguguaagugcauuagcauuguuugacugaggacgaaguugauagaagauuauacuucguuuuguuuguaacuuuaccuagaacuuuugccauuuuggaaaagcacuucaacagcaacauugcauuguugcuaaugcuacugucucuuuagcuucuguuugcauagucuuuugguguaguugugcccuggcauuuacauguuaacauacauacuauuuuauuauaaauucuuucuuuucauuuuuccuucauacagcauuauauaauuuuuuuuugaaaccguaugugggagugggcuuauuaucugugcauuucaggauagugaagggcauauuuacaaaauguuuguuauaaaaugggagaguauuaagucugauaagccugaaauucacuggugucauagauggaacacugaaucaggagagcugcauucuaguucugauccuggcuuugccagguguguagccauggcaguauuuaagcguuuugaaugccaguuuccucaucuuuaaaacccauagaguuggacuaggugaucuuuagagucuuucuucugaaauuacuugauuuuguuuuugucaguuauccuaguggaauucucuaagagucuguucacuuugaucauaaugcccaaauucaaaacugauucauaugaccaaguugagugcuucugggaaggagaaauacaugacuaaugaaguucuuuucaagguagaugggagaaaaucaguguuuacaucuaaagggcaaagagccuucaugugaauuucaucaguugacaaauggggaucauaauacuuguauuguuguuggaauauuuaagugagauuaaagaagauaauauuuauaaauuauggacaagacuaccugacauaauagguaugcagauaaaaguugaauuaaaauuaagucaaacauuucuuaaauacaaauacauuuuauaauauauuuugaaguaugaaauauaccuuucaugaucugcuaccagaggcaaacaguagcaugggaccuauaaaauuuuuuuagaaagugggucacaguggauaauaaguuucauuuggauaacuaaucacuaccagcccagccuuaauauuccuguaggaguuaucaggaacuuugaguagaguaauuagcucucaggauuuucaguuacagucauauucauuauuuaacauuuuuauuuccacaaugacucauccaugaauuauggagugcuuucccaaaaggaauguaguauugcuggaaaugaauuuuuuauugcucuauuuucuuucuuugguaagggguuccuuguugguuaguugggcccaaaacucuccacaaauaauuuaaaauacgugcuuuuguaugaagaugacuuaacaaggcaguggagauuucucuugaaugggcaacauagaaugcuuaaauuuucuuauucugcuuauuuuaaauuauuaauuuuuguacugugguccuguacugugcuuuuuaaauucuuacaugauaaguguaugucacuaaaagguauacuuugcucacaauuucccuauuauuuacuccacugacauuaaaauuguagcauuacaucugagguucccuuugguuuuuauguaucauuugcuguuguauccuuuaaaaaauaguguaauagauuugucagugaaaaugaugucuuacugugaugcuguuaucaaaggcaucucugaguaccuaugauagagaacuagugaagggguuaauaucuauuguagauauagaugcuaauauaucuagacucuuauagaugcuaguaauuauuauagaacauuuauagauaccauccuagaugcuuucauauacauugcuucuaauccuuacuaacaguucuguagguaagcaauguuguccucauuuauaggugaggaaauugaaaauuaagagaggaauuuguucagguuucacaucuagcaagugacagauauugguccgucuggcuacaaagccaaaugucauuguguuuuugacuaaggacaaaugaaugaaguguacauacuaguuuaaaauauuuauugaaaaauuaauauucagucauuuauuaaauguaaaagauggcauuaaaauuccucuguguuuuguuggaggaggaaauacaagaauagguguaucauaggauccaaaggcuccugagaagggguuaacauugagagaagggguagagaaaagagauaauaggugaucaguugagaagaugauaaauauaauuugauuacuuuaaauaaucagucaacaucagcagguguaaaugacauacaucaguacuuuucuuguuuugauuaggcaggaagcaguagaguaaugauucccagacuugcauuuugcacacuagcaaaauaaaauauaaauaacagaaaaaaagugggggagacuggcauaggauugucaaauaaaaacaauuaaaaagugauacaugacuacauaguauuacuguuguuuuauaaggggaaggucaaucuaacaccaaaggaauugugcaucauuccacaauaagagacaguucuuucaagaaaauacagauuuuaacuuuguagugacaguuuuauuaaggcaacuuggucauggacuggcuuugagaaacauuaguuuauaauagggaacaccacauuauagccaaauccuuccuacaggaguuguacauccuauaagcaaagaauggcuuuuacauuuuuaaaugauuaaaaaauuaauauauugugauaugugaaaauuauaugaaauucaaaauucagugugcauaaauaaaguuuuauugggacacagcuauguuuauuuuuguauuauauauggcugcuuucacaccagugguagauagaguaguugugauagagucuauaugacuuacuagaccugaaauacagugucuacucucuggccuuuuacaaaguuuuucaauacuuuguuuggauaacagaguaaauaauaauagcuaacacuuguguaguguuuacuaagaaacaggcccuguuuuaugugcucuauguuauuaaccaucauaacaauuuuaugagguagguacuguuuauugaaguggaaacugaggcugagaguaaguugcccaaggucacauggcuguuagguggcagaggcagccuucugccuagauggugccacuccacgguacaugcuucaucacugcacuuggcuagcagagaaggaaaucagagacuucaggaugugacgcacccuucacauuugccguaguuguuuuaggaaaagaggaaaguagccuuauucuauaguugccugaaguguuaucacugaguaguugaaugaagaauucagcauuaauuacuucaugaugcaugaacauuugguguauuuuuaugugacccaguggauuuuccccagaggucuguugauugaaauguccuacuuauugauguccuacuuauugaacuuuugaacaaauaaaucuguuauuucugaacuauugaguucauuuuugguauaauuagaauaauaaauuacacuauuaacuugguggaggguaacuguuucucuaucauaaauauuuaucguguuguucuuaaggagcauaaggcauaagccccccgucauugauuuaauuuaaaaauaaaacauuuauugacacauacagaaauauuuuaauuaaaaauuguuaaauggcuuuuuuaaugucuauauauauucuaccccccaccccccaaaaaaagccauuguaugccaaagcccgaaagaagaauuacauuaccaguaguuggauuuuuggcugaaucuauucaaggggaaaucacuauuuucguuuuagagauggcuuuggguggaggagguaagguuucaagaacugguugaaugaaagaauauugacaaguaagugaauaaacuagaauuagugugaccacuucugauuucucaaauaauguguuuacaaacaguguuccuacauuguaauggcaguauaaaaugcugauuuaaauaaauagaaguuuaguggcuacacuuuuucuuaguuaaaccucacuauauucuggauuuaaaaaugacaguaacuaauguuaguuuugugcuccucugaagguuagaaaccuguuauaugugucuaaaacggguuuuaauggguuuaagaccacagagaagauaggacugacacuuuaguaagauucuuuuuuucaaucuauuuaauuguucuaugauuuuaccuuauucaaggugauggagggugaauuaggguggguaaaggguagggggaauugagacagugguuaagguugauuuuugacuuguaguucgcuuucaucuuuaaauuguggaagucgccuuccuuuguucauuuugaaguuuugggcaaaauguucucaggcuagaugcagguaaugcagguaacagcggccagcacuucccauacuagagggcguugacuuucucaaaguguugacucguuugugauguuuuugcauuuguuugguuucuguuugcugcuauguuguugcucuucccaguaugggauaggguuaugguauuaguagaauuacaguguuagugguuuuucuuccucuucccauuccauccauaaccuugacacucauaauuuugaaaccuaucguucauuacaaggguuaaaaucuaaaaugugacugugcagguugagauggcauguuacagcuccugccaccucuuuuucuugugacagauggcuuccccuccugguuguaauccacugcugauuuuuuucaaagagcgaauaccauguguuccccauuuuggcucugguuguguucugcccacucauuggcuucagaggaucuugaaacaggagguacuugcugcuggcauuuauggcaggaaguggauacaauugcgauacuuugugccaaguguucauuuauuagaaaaauugugcuuccuaaaauuaaacauuauuucucugucacaucaagaguaaagcuaaauuuuauuacuuuuuagaauaugcuuuucccuuaauguuguauuauaaaaauuuuuugguggcaaauuuauuacaaaauagauuuuuaaaucugaauuucacauacucaaagauuuauagucugugcaagacauugaaugaguagcucuaauugcacuaguauaauauaauuacgaaagggaucuguaucacagagacuucugaucacagaaacaguuggaauuguuugugaugugugguauugaacuugugauugcauaugcuuugugguaccuauagacaguaguguuugucuauuuuaacucucuugcuucggaucuccccuugaguagauucagcuaaauaaguuauaaauuucaccaucuuaggccuucuugaaaauuauaaguaucugagacagcuuaauuucauaaagcuacugugcauauuuggaaguaugguguuugguuuuuuaaaaaaaccuggcaggccagaguaagcaaauuguuuuuuuauguuuuugucaagaaacaccccaagauaaauguaaacaaauauuugcgcauuaccgucauugauacuggaauuugacauuucuguccucagaagucacuguucugucagagucugcuguacuugccugagugaauagugcaggauuggcaaaaacguugccugcucauggcagaucaucucuaaaucucucuugacaacaucucuagcugaacccagaucagugauucucaaccuuggcugcauauugguaucacugagaaacuuaaaaaacaaacaaaccaaaaccugaugccugagucucacccaaacccucagauaauuugauuugauugggcuuggggguggucuugcuguggagauuuaaaaaaucuccccaggucauucuaaugugaagucaagguugguugagaaccacuggcuacuacaaauggauaagaguugguagugugaacugaaauguauuugccauccucagucuagugaggggauuuucuaaccaugccacaauauauaaacaauuugcaguuugaauggauagagguugguuaucauuggaauuugaaaggacaaaugacaaguaacaucggaugauuuaccaguguuuugugaucuuuuuuuuuuuuuuuuuuuuuuaagauggagucucacucuuguugcccaggcuggagugcaaugguacgaucucagcucacugcaaccuccaccucccggguucaagcgauucuccugucucagccuccugauuuacaggcaugugccaccaugcccggcuaauuuuguauuuuuaguagagacaggguuuuaccauguuggccaggcuggucucaaacuccugaccucaggugauccgcccgccucggccucccaaagugcugggauuacaggcgugagccacugcgcccggccaaugacauuuuaaaagaauugccuucagaggguagcuggaaaagcaaauggaugugggacaagagguuguuccacaaccuccugggguggggauacccguucugugauggcauuaaggagaacgagagggcugagaagagagcaaaaugaucagcccuggauuuugggacuuggccaaaaaagaaaggauggaacaggacgucaggauaagaucuaagacuugaagcagaaacuguacuucuuccugacccaggaggugugagacagggaaguggugguagcaaacaggauagaaugagagguucccuuuuacacccaaacuuguucuuugcuuaguggcagaaggcucaauuuuucuuuauuagagcauuuucuuuauuacagcacuaugagcuuuacuauaugugaaucaccugugagcacuuguuaaaauuucuggaucccucccaaaguuucugguuuaggacugcugggggaaggcucaggaaucuguauuugugaagguuaacugaaccuuuuuuguuugcuuaccaucuauucaguguuuucccuauucuuuguucuauuuauuuaguaauuuaaaaaauugacucauuuuaaaaaacugaaucuuauuuuaaaaugaaacugucacuacuacacguggaaaacauuugccaaaaaauaaaaaaugaaaguguaaauacauaacuauuaagaaaaaggucaggccgagcacuuugggaggccgaggcggguugaucacgaggugaaggaaucgagaccauccuggccaacauggugaaaccccaucucuacaaaaaaaugcaaaaauuagcugagcgugguggcgcguuccuguagucccagcuacuagagaggcugaggcaggagaaucgcuugaacccgggaggcggaaguugcagugagccgagauugugccacugcacuccagccuggcaacagagugagacucagucucaaaaaaaaaagucauauauguaccacucugaagauuauuuuuaauaucauuuugggaacuacuagcgauucugauacagauaguuuugucaucauacuuggagaaauauugaacuagagacaaaaaguuucacuuagauugcaugauuuucagcuacuguugcacacuuggaaucuggggcauuuuuaaaauacuuuuggucagcccccaucccccgauuuaauuggugugggcuacaaccuggacaucaggauuuuuaaaacacucuccuaagguaaucguaauguauauucuggguugaggauuuagagguuaaaaagcauauaaugcaguuagacuaagaagcauaaauucaugaauacuaaaauacacuuaucucgguauaauuagaaauaaagaagacuggcugggcaugguggcucaugccuguaaucccagugguuugggaggccgaggcaggaggaucacuugaggcgaggaguuugagaccagcaagggcuacauagcaaggccucgucucuaccccaaaaaaaaaaaaaaaaaaaaaaaaagggcagaagaaaaauuagacagguacagugguaggugccugcaaaucccagcuacucaggaggcuaaggugggaggauugcuggaguccaggagguugaggcugcagugaguccugauccugucacugcacuccagccugggugacagagcgagacccugucucuuauaacaagaaugaaaaacaccacagugaccaccugggggaugugggcagggggagaggaaaagaaggugaauuaauaaagcacuaaggcaccguguccuuaugaucgccucugcuccugccugcuucucuuguuuucuguucuugaugaauagcgugaauuaauaaagcacuaaggcaccguguccuuaugaucgccucugcuccugccugcuucucuuguuuucuguucuugaugaauagugugaauuaauaaagcacuaaggcaccguguccuuaugaucgccucugcuccugccugcuucucuuguuuucuguucuugaugaauagcaagagcuuuuaaauugucagcuaguccccaaacguaagugugcaucagaauuaacuggaggguuuguuaaaacacagauugcugggacucauccucagaauuucugaucgaguaggucugggguggggcacaagauuuaauuucccaggugaugcuucugcugcuggucagggaacaacacuugaaacacucaucuaguuaaccaagcugaaaacuuuaggacauuagccugacauuuauugucucuguguauuuuauauauauccagugaacuuuaaaaauaauuacguaaacacaaaccuguguuuccaucaccuagaauuaguaaauguuaauggguguguggauaaauauuaauuaugaauaaauauugccuuuuuggugauaauaaaccgcuguguuuuauuucacacuuuugaguacaaggaauaaaaaaauacaacuuuucugggcuugagauaagugcucuuuagguuaagcuauaacaccgaagagaaaauagugcuccauuaacuuguuucaucagucuuuuaggcaaccaaaugagaaaagcaaagaaaaacaguacagucuagauuguauacuccaucugagaaaaaacauuaaaaaguauuacguaucugaaaaugaaauugucggacaggcgcgguggcucaugccuauagucccagcauuuugggaggcggaggagggcggaucaccugaggucgggaguucaagaucagccuggccaacauggugaaaccccgucuccacuaaaaauacaaaaauuagccggacaugguggcaggcgccugcaaucccagcuacucaggaggcugaggcaggagaauuucuugaacccaggagguggagguugccgugagccaagauggugccguugcacuccagucugggcaacaagagugaaacuaugucucgaaaaaaaaaaaaauugucagcugcaaucauuuuauccuguuuuucuguuugaauaguuuauuugaauaguucauggaauuaauaaguugaauuuauuucuauaucuagaaacuugggaggggaaggguaaacuguuauguaugguauaaaaaauuuaaaaguguugugaaaauacuauuuucaauucuaaaacgcuuguucaauucuaaaaugacuuguuuccccuaugcuugauauagaucaagagggaaaaaguauuaauggguauuauuuauucagcaaacauugaguuuacauucaggacugucaacuugacuauggaacaauucaaguagcuuucguuagucuugccuagcuuuucguuaugcauuaaauaugugcuucauucaggaggagaucaccccaccccagccagguuaguuuugucagguagaaauaaugcuguuuuuauauucucaugaagaguguauguauuuuuucaucguggagcuaaugcuaggauucccugaacuugcuagcuucuauaaauccuccucaccauucuucgaagcaagggcuuuggaaaguauggacuuaacugucucaugaaaauccuuguauagcuucaauuguccucccuccuauuuauuuuucaugaaauuauucucuugacacacuuguuuauuuucuauuuagucuuucuagacucuucuauuugcuuccuucuuggacuauuuguucccucuugcuagaacucuuuaucuucacucauuaacuaaacuuuaagaaaagaguccuucccauguuuccuuuaacagggaggccagcuuguuuuuacagcucauauaauauaugcagguaguagaagacagaugaaagcaaauacuuugcaaauuaugguauguuugcuucaguuuucaaaaagucugggagcuuggucucuuuucccuggaaaccaccucuguuuugucuugcagaugagagugugaucuuuaagcuagccuugaccuuuuggguggucugugcuuaucuuucaaguguuugcaguaauuaggaccaguauaucaaaaaaagcaugcuaccuauguuauuuguauuguccugaucuucuagauucagaaaaaaagagagguuauuauuuuuauaacuggauuuccuauauuuguggauaagaauuccaaaacuaacaaagagaaaaucaucuugacuguuacgugcuguaaaaaucauguauucaaaguuuguacuaucacaauucuggauucaugaggauuugccagacauucaaauuaaagccuaaucaauaacuuucuucuucguagagggccauucuaaggccagugcuuucccagggccuggguauauuauguaguaugaugaauaucacagagcaauugcccuuguuuaggaacuguguauugggauuccuuuaagauuuuuguuuuaacauacuuacauuucacuaggauucuucccuaccgcacccccggcucuuuuuaaaaaauuuaccuaguuugucccuugccuguuuggcuacuagauauauuuaacugaccuuagacagugcugcaggcagaguucagcauuuaggcaaaacggauggcaguguuagcuguuuuucuccuggcaugucacugugcauuaucugggauggcaugcuuugugaguaucuguaugguuucccaaugagagaagggaggucuggcugcauucacucgcacaaggugaccuuuguuucuacacauucucugcuuuaacaaagcauugucuaaucagucugucaauacauauuuauugagugccuacugugaaugcccaguaguaugcuguguacuuugagagauuuuuuucaaaagggggcaggguagaaagaaagagaaauaugcauuugaguuuagaauaauguuaacaugaaauauguauaccgugugugauuuuauaaacaugaauuucuggaggagcagaauucuagaguauucuggcccacauuagcuucaagaauggaauuauucuuaagaguaaaaucacuuaagcuagaaguuccaggcugcugugagcagugccucuacacuccagccuuggugacaggagaccccuaccuaaaacaaaacaaaacaaaacaaaaaaagaaugaacuguuuccucauuaaggugcaacuuauucauguaagagagauguuuaauguuaaggauuuccuuuccuuuccuuuuuucuuuccuuuuucuuucuucuuuccuuucuuuucuuugacagagucucacucuaucacccaggcuggagugcaguggcgcgaucucuguucacugcaaccucugcuucccggcuucaagcaauucuugugccucagccuccccaguagcugggacuacagucaugugccacuacacccggcuaauuuuuguauuuuuaguagagaugggguuuugccauguugcccaggcuggucucgaacuccugaccucaaaugaucugcccaccucagccucccaaggugcugggauuacaggcgugaaccaccauacuuggccuguuaaggauuucuuuaaaugugguauuugauauauaggcuuacacaauuaguauaucuuaaauuauguaaugaauuucccacaaucucagcauuuaaaaaaauguuuggaauaggaagaugcucauaauauuuuaggggaaauacauguauauauaguguauauauguauguauacaaugaucaaucuuuggagcagcauaguguaaaaagcgcaagcuacggagucagacugcuggaugguucugccacuucaacugaccuagggacagguagauuuuauuauuuguuuccuuuuuuguaaaaugaaaauaaugguacaucaugggugagauguaaacuuuaaaugaguuagaaugcauaaagcauucagaaaaggagcuggcugggcguggguggcucaugucuguaaucccagcacuuugggaggcccauggcgggagaauugcuugagcccaggaauuugagaccagccugggcaacauaaugagaccccugucucuaaaaaauaaaauaaaauaaaugaaaauaaaaauaaaaauagaacauggucuggccuguggaaaacauuaauuguuacuuuuauuguagccuuuuuuuuuuuuuaaaaaaaaggugaaugucagcagagaaaaacuguuuuaaaggauauccauaaaauuuuuuuugugauuuuucucagauucauaggauuauuaauuuuucuuuuuaucuguaauuccuuuuucccccguaaugaacacguuucuaguguaauaaaguagaagauaaugaagaauaagauuuagucugaauauuuauaugaauccuuaugaagaagugucguugucugucauugauacccaagauuuguugucucacggccauggaaaacuaggacgcagacacacaaagagugagguucagaguggaaguuuaauaggcaaaagaaagagaagagcucucugcgacagagauggguccuggagaggcugguccugguucugcgguggaaugcaagggguuuuauagauaagcuugaggagguggugucaugauuuacauagggcaugaaagauugguuggaccaggugugccauucuggaaaacugguuagggcuagguguuccauuugccuagggugcaaaaaucuggccacccccacccuaaucuuuuauuaugcagauggcuucucugucugcccagcgcagugucuguuucuuuacuauacauguggugacaaagaaaagggaaggugaagccuccauguugaacauaccuggcccccagguagccguuuucuguuagcauagcugcugacauucacccaugcaagcuuccagcuugcuuuuuuauguuugcagcaugauuuuucaggcugcucuuuguuagaaaagaaauucuuuuggggcugcuuuuuguuaaaaggggaaauuacgccgaggacucuauugcccuuauuaucugcguaaauaauuucuuucuaccuccuguaucaaugauacaacaaaaucuagaauuuguugccaggaaauuaguaaauauuugaaugauauugaauggucuacauaggugauguuauuuuaucuugaagcuguucauaauuuagcauaggaaacauggcaaacauggcagaaauaccauggaucauaugcuuguuuuauuuuuaguguuuuuuuguuuguuuguuuuguuuuuuuugagacagucucucacuuugucagcgcgaucucucggcucacugcaaccaccgccuccagggcucaagugauucuccugccucagccuccugaguagcugggauuacaggcguacaucaccacaccuagcuaauuuuuguguuuuuaguagagacuggguuucgcccuguuggccaggguggucucaaacuccuggccucaagcaguccaucuuccuuggccuccuggaaagcgcugggcuuacaggcaugagccacugcgcccagccuguauaucuucuuuugagaacugucuguuuaaaauauaaaugaaaauaaaaauagaacaggggcuggccugcaguaagcauuaauuaugacuuuuauuguacuuuuuuuuuaaaaaggugaauaucagcauagcaaaacuguuuugaaggaugcgcaugguuuuuuuuuuuuuuuuuuuuuuuuuccuugagguggagucuugcuacguugccaggcugaagugcaguggcuugauuucggcucacugcaaccucugcuucccggguucaagcgauuccccugccucagccuccuuaguagcugggauuacaggcacuugccaccacgcccagcuaauuuugguauuuuuaguagaggugggguuucaccauauuugccaggaugcucucgauauucugaccucgugauccaccugccucggccucccaaaguacugggauuacaagcgugagccaccgcacccggccuaaaauuuuuuuuuagugauuuuucucagguguguaggauuauuagauuauuuagauccuuagaucuagacuauuuagauccuuugcccauuuuaaaaucagauuagguuuuuuuuguuuuguuuuguuuuuguuuuuuuguuuguuuuugcuguugaguuguuugaauucauuuuauauucuggauauuagucccuucucggaugcauaguuugcagauguuuucucucauucugcagauugucucuucacucuguugauuguuuccuuugcugugcagaagcuuuuuaaguuuguuauagucccauuugucuauuuugguuuucucaccagugcuuuugaaaccuuaccaagaaagucuuuuccuagaccaguguccucaaguguuuccccuacauuuuuuuuucuaauaguuuuauaugaauaguuucaggucuuacauuuaagucuuuaaucaguuuugaguugacuauugcguuugguaaaagguaggggucuaauuuaauuuuucugcauguggauauccaguuuucccaguacuaucuauugaagagggcguccuuuucccaaaguaugguuuuggcucuuuuguugaaaaucaguuggcuguaaauauguggauuuauuucuagguucucuguucuguccuauuggucuaugugucuguuuuuauaccagcaccaugcuguuuugguuacuauagcuuuguaguguauuuugaagucacauagugugaugucuucugcuuuguucuuuuuuguucauuauugcuuuggcuauucagggucuuucugguuccauauaaacuugagaauuguuuuuuuauuucucugaagaauaucauugauauuuugauauggauugcauugaaucuauaguuugcuuuggaaaguauguuuuuuuuuuuuuuuuuuaagagacgaggucuugcucucucaucccagcuacaguguaguaguaugaucauagcucacugaaaccucaaacucuugggcucaaaugauucucccacaucagccucccauguagcugggaugacaguggucauuuuaacagcauucuuccuauccaugaacaugggaugucuuuccaauuuuuuuuguguccucuucaauuucuuuuaucaguauuuuguaauuuucauuguagagcucuuucaccuucuugguucaauuuauucuuagaguuuguuguuguagcuuauuguaaaugggauugcauucuugguuacuuuuuuagcugguuuguuauugguguauggaaaugcuacugauuuuuauauguugauuuuuuauccugcaacuuuagugaauuuguuuauaaguucuaagauuguuuugauggagucuuuagguuuuucuagauauaagaacauguugucugcaaacagggacauuugacugccucuuuugcaaucuggaugcccuuuauuuuuuucucuagccuaagugcucuggcugggacuuccaguacuauguugaguaagaauggugaaaaguuggcauacuugucugguucuaguucuuagaggaaaugcauucagcuuuucccuauuaagugugauguuagcugucacuuugucauauguggccuugauuauguugagguauguuccuuuauugccuaguuuauugagaguuuuuaucaggaagguauguugaauuuuauccaauguuuuuuucugcaucuauugagauaaucauauggauuuugucauucaugcuguugaugugcuauauuacauuuaucguuuuguguauguugaaccauccuugcaucccugggauaaaucccacuuugucuugguguauugucuuuugaaugugcuguuggauuuuguuugcuaguauguuguugaggauuuuugcaucuguguucaucagggauauugaccauaguuuuuguuguuucuguacccuugucugguuuucgcaucaagguaaugcuggcuggcccuauagaguaaguuacaaagaauuaccccucuucagcuuuugggaauaguuugagaagaauugguguuaguucuuuaaaaguuuuguagaauuuagcauuaaagcuaucugauccaggguuuccuuuguugagagacuuuuuauuaaaauugauucagucuuguuacuugguguuguucuguucagguuuacuacuuguauuagucuguuuucaugcuggcugaugaagacauacugagacuggagagaaaaagagguuuaauuggacuuauaguuccacauggcuggggaggccucagaaucauggugggaggcaaaggccacuucuuuuuuuuuuacuauuauacuuuaaguuuuaggguacaugugcacaaugugcagguuaguuacauauguauacaugugccaugcuggugugcugcacccauuaacucgucauuuagcauuagguauaucuccuaaugcuaacccuccccccuucccccaccccacaacaguccccagagugugauguuccccuuccuguguccauguguucucauuguucaauucccaucuaugagugagaacaugcgguguuugguuuuuuguccuugugauaguuuacugagaaugaugguuuccaguugcauccaugucccuacaaaggacaugaacucaucauuuuuuacggcugcauaguauuccaugguguauaugaaaaggcacuucuuacauugaggcggcaagagaaaaaugaggaagaagcaaaagcggaaaccccugauaaacccaucagaucucaugagacuuauucacuaucacaagaauagcaugggaaagacuggccccaugauucaguuaccuucccuuggguccuucacauaacgugggaaauuuuuuuuuuuuuuuuuuugagacggagucucgcuuuguugcccaggcuggagugcaguggugcgaucucggcucacugcaagcucugccuccuggguucacgccauucuccugccucagccuccugaguagcugggacuacaggugcccaccaccacgccuggcuaauuuuuuuugcauuuuuaguagaacgagguuucaccguguuagccaggaugaucucgaucuccugaccgcgugauccaccugccucgggccccccaaagugcugggauuacaggcgugagccaccacgccuggccacaugugggaauucuuggagauacaauucauguugagauuuggguauaguacacuauaucacugcuucuuccugguccgaucuuggcaaguucuauauauccaggaauuuauccauuccuucuagguuuuccaauuuguugguguauaguuguucauaauggcgucuaaugauucuuuguauuucugugguuuccuuuuucauuucagauuuuguuugagucuucucucuucuuagucuagcuaaugguuuguggauuuugcuuaucuuuucaaaaaaccaaguuucuggcugggcguagugggccaugccuguaaucccagcacacugguaggcugaguccgcagaucacuugagcccaggaguucgagaucagccugggcaagauggugaaacccugucucuacuauaaaaaaaaaaaaaaaaaaguugcugggcguggugguguaugccaguaaucacaguuacuugggaggcugaggcaugagaaucacuugaaccugggaggcauagguugcagugaguugagauugcaccacugcacuccagccggggugacagagcaagacccugucucagaaacagcagcaacaacaacaagaacaauccccaaaacaaguucuuguuucauugauguuuuauaugugucucucucuaauuaucuaaucuaauugaaucucucucuccccccccauaucuccauaucuccaucucuugcuuucucuuucucucucucugguuucuauuuugcuuauuucugcucuggucuuuauuucuuacacuaauuuugaguuugguuuguucuugccuuucagguuccuugagaugcauugcuagguuguuuauuuaaaaucugucuucuuuuuugauauaaguauuuauugcuguaaaccccccucuuuguacugcuuuugcuguuucccagagguuuugguauguuguguuuuuuuuucuucuuuucuucuuuuuuuuuuuuuuuuuuugagacggagucuugcucugucacccaggcuggagugcaguggcaugaucucggcucacugcaagcucugccucccggguucacucccaccucagccucccuaguagcugggacuacaggcacccaccagcacgccuggcuaauuuuuuauauuuuuaguagagacaggguuucaccguguuagccaggauggucuugaucuccagaccucgugaucugcccgccucggcccccgaagugcugggauuacaggugugagccaaugcgcccggccuuuucuuuucuuuuuuugaaaaugaagacgggguuuugccauguugcccaggcuggugucgaacuccugagcucaagccaucugcgugccucagucucccaaagugcugggauuucaggcaugagccaccacaccuugucauuauguuguguuucuauuucgguuuuuuuuccaacaaaucuuuugaauuccuuuuaaauuucuccauagacccagugguuuuucagguguuuaguuuccaaaguucuuguuuuugaugucuaguuuuaucccacuguggucugggaagauacuugauaugauuuuaguuuuacaaaauuuguugagacuuguuucguggccuaacauaugguuuauccuagagaauguuccaugugcugaugaggagaauguauauucuguagcuguugcauggaauguucuaugaaugccuguuaguuccauuugguccauaguuccacugaagaccaguguuucuuuguugauuuucugucuagaugaucuguucaguggugaaagugggguggugaaguccgcaauuauucuuauauugggaucuaugucucuagcucuaauaauauuugcuuuauagcugggugcuuugguguuaggugcauauguguuuauaguuguuacguccuuuugcugaauugaucccuuuaucauuauauaaugucccuuuuuauguuuuuugacuugaaagucuauuuuguuugauauaaauauagcuacuccuucaugcgucugguuuccauuuauguggaguaucuuuuuccauuccuucauuuucuuuuuuuuugagacggaguuucacccuuguugcccaggcuggagugacuguaguagcaugaucuuggcucacugcaaucucugccucccggguucaagcaguucuccugccuuagccucccaaguagcuggggauuacaagcaugugccaccacgccuggcugauuuuuugcauguauguauguauguauuuauuuauuuaguuuuugagauggaauauugcucugucgcccaggcuguagugugguggcaugaucuugcuucacugcauccuccaccuccuggguuccagugaugccccugccucagccuccuggguaucugggauuacaggcaugugccaccacgccuggcuaauuuuuguauuuuuaguagagacgggguuuucaccauuuuggcuaggcuggucucgaacugcugacuucaggugaucuaccugccuuggccucccaaagugcugggauuacaggugugagccaccgcaccuggcuuauuccuucauuuucuauguguguuuuuacaugugaagugaguuucuuguagacagcauauaguugagucuuuuuuuaaaaaaaaauccacucauucagccuauaucuuuuaauuggggaauuuaaaccauguacauucaagauuguucuugauaugugaaggcuuacuccugucauuuuguuguuuucugauugcuuuguauauccuauguuccuuuuuuccucucauuguuuauccuugcuguuuggugguauucuguagugauaacauuugacuaguuucucuuucucauuuguauauuugcuuugccagugaauuuuauacuuuuauguguuuucgugaugauacauauuauucuuucccuuccagauguaagacucucuucagcauuuuguauggcugguuuaguggugaauuuuuucaguuuucauuugucugugaaagacuuuauuucuccuucauuucugaaagauagcuuugcuggguauaguauucuuggcuaacaauuuuuuugcuccccacccccuucauucagcaguuugaauauaucauuucauucucuccugacuuguaaaguuucugcugagaaaucugccauuagucugauggagauucccauacaugugacuugaggauuuucucuugcuguuuaaaaaacuuuuuuuuuuuuuuugagagacauuauucuguuucccaggcuggauugcaguggcuagucacaggcacaaucaugucucacgacagcccuccaacucuuggccucaagcaauccuacccacucagccuccugaguauucucuugcuguuuucagaauauucuuuuuuauuacugugauuauuauuauuuuuagagauagggucuugcuccauugcccaggcuggugugugaugguucagucauagcucacugcagccuugaacuccuguguucaagugaucuugccucagcuucuugaauagcuaggacuacagcuaaaagauuggccaucccuggcuacuuuuuacauuuuuuguauagauagggucuugcuauguugcccaggcuugugucaaacuccuggccucaaagaauccucccgccuggccucccaaagcauugggauugcaggaguuagccaccguguucaguguagaauucuguuuuuaucauuuacuuuugacaacuuggcaauaauguaccuuagagaggacuuucuuugggcugaauauguuuugggaucugugaauaccaaagauucgagggauauaugccuguaucucugcugagacuucggaaguuuuccgcuauuauuucauuaaacagguugucuaugccauuuaccaucucuucugaaauucccaaagugcaaguaguuguucacuuaauggugucccauaugccaugugggcuuuauucuuuuuuauccucucuucuuuuucuucugaguuuuuucuuuuuuuuucuuuuucuuuuuuugaggcagagucucgcucuguugcccaggcuggagugcaguggcacgaucuuggcuuacugcaaccuccgccuccuggguucaagugauucugcugccucagccuccugaguagcugggauuacaggugugcaccaucacacccaacuaauuuuuguauuuuuaguagagggaggguuucaccaugauggccaggcuggucucaaacuccugaccucagguaaucugcucaccucggccucccaaagugcugggauuacaggugugagccaccgcgcccagcccugucugagauuuugcaaaagaccugucuucaaguucagaaaauccgcuugauguagucuauucuauuuuuuauuucacucauugaauucuuuaauuucacaauuuguuuguuuguuugauauauaucuccuuguugaauuuuucacugaugaauuguuuuccuauuucuuuguaccguuuguguguguguguguguguguguguguguguguguguguguuuguauauugcugaguuuccuuaagaucauuauuuuucauuuuuuucaggcauuucagagauuucuuuuuuuggggcggggggggacggauuucuuccuagagaauuaauugaguuucuuuugagguguuguauuucccuugcuuuuuuauguuucuugugucuacuuuggcaucugugcaucuggugcagcagcugcuccuuccaauuuuauggagcagcuuuugugcagaaauacuuuuuccugcagguauaucuacaguauuggcuggauaacgugcuuuggccguacaauagaguaguauucagccaugaaaaggaaugaaguucugauacaugcugcaguguggauauaccuccaaaacuuuauccugacugaaaggagccagauacaaaagaucacuuauuguaugguuccguguauauguaauauauuuuguagauaaaucuacagauguagaaugcuaauuggugguugccagaggcugggaagaaugaggaaugggaagaaacugcuggguaaggaguuuuaacuuuggagugauggaaauauuauggaacuagguagaggcagucauugcggaacacugugaacguacuaaauguuacugaauuguucacuuuaaaaugguuaauuuuauguuauaugaacuacaccucaauacauuauuuuuuaaaaguuuuaugaacagucauaaauuaaaacaaauauucgcuauggcgauuaauauaauugcccuguguugaggauuuaccgggagcuggagccuucacauauauugauucuaagccuuaugucagcauugcaagauagauuaggaagaacaaagaacuauauuaguaguuuaaaauaauggcuuuaaacugcuuuacaccuuguuuaucaaaucaagugagcccuugaaauuuaaucagggacuggacgguagggggcacccaugguacuuauguugcucuggcuauguugagagcgucuuaagucauaaacacagauuuguugaaugaguuugauacuuugaaaauuaucaccuagaggcugggugcgguggcucacgccuguaaucccagcacuuugggagacugaggcagguggaucacgugaggucaggaguuugagaccagccuggccaacauggugaaaccucaucucuacuaaaaauagaaaaauuauccggguguggugguaggugccuguaaucccaacuauucaggaggcugaggcaggagaauugcuugacgcugggagguggaaguugcagugagcugagauugcgccauuguaguccagccugggcaacagagcgagacucugucucaaaaaaaaaaaaaaaaaauuagcaagaaggaucuuauuacgaacuuauguuuauuugaguuugguauuuuaucuuucaguuuuaaguuuuguaguugaaaauauggaacuauaggcaugugccaccacacccagcuaguuuuuguauuuuuuauagagacgggguuuugccauguugcgcagacuggucucgaacucuugggcucaagcaaucugccugccuccaccucccaaaguguuggaauuacaggugugagccucugugcccggccaaaacauaaguuuuaugauauaauacuugcucuauggacgauguuagauguuuuaaguuuuauuuucuuuuaaugaaaaaagauuggcaaccacuaaauuguuuuuacaacucauuuuuuaacaagccaguuugaaaaguuuuuaguguaaaaugccaguguuucugcuauccgaugaaaagcaucagguucuauaaaauuuuacuauuggaaaguuaggguuuggggaagaguauucuaaauauauguaacuuuguaaucauaacacaaacagaaguaauguuaauaaaugguaccucaggagauuacuuggauagcacuaggaugccaggugauaguagccagagaaugcuucaacauauauucaaaacucaccgaaguaauuuaguagaaaugcuugcuuacagugcugagaaauugcugauggaaguggaucucugagcgcaggaaaaagugcagccugucuugagcagagggccaugagugcucaggggugugccccuguaggaagggagcccuggauacaggugcucuguuuuaguuuucucaaaauagagcugaaaggaucacuauuuauucagcagccaagcagagggcauuuuccuuuccugcugaaggcugcaauucugccugucuuuguaguucucuugccuaggaaaagguacauaugaaucagcacagcuuuguuauaaugauaguucucuauuuaucaugaucauguaugagcuaauuuauauuguaaaaaauauauuuagaacaaaacuguguguguguccaguguaguuugccaauuuuacuguauuucauuuuagccacugcuuuuuuuuuuuuuuuuuuuccuucugagacagagucgcucugucgcccaggcuggagugcaguggcgcgaucucagcucacugcagcauccaccucccgaguucaagugauucuccugccucagccucccaaguagcugggacuauaggcgcccaccaccaagcccagcuaauuuuuguauuuuuaguagagauggguuuucuccaucuuggccaggcuggucucgaacuccugacuuugugaucugcccaccucggccucccaaaguacugggauuacaggcgugagccaccgcgcccggcgaugcugagaucuuaauuaagacucuaaguuuuggagagagauguucaaguuuuucaucuuuaccugagaaucccuacaaaaugccaaauacuguaauuguacacuaaggugccaaaauuuugaucucaaagauccguaugaaauuaucuuggagauaaggaaccugaaggcuuaaaagacacaagaaucaaguuucucuucuggcccuuucuuauuuauuacauacaaaaauaauuacuuuucccuuuaggaauuaaaaaaaaaaguagucacucagggauaccugauucuuuacugaugcuuagcauuuuuuugugaauaauuuuuaucccucuaacaguaaaaugauguuaaaagcccuugaaaaaaugaaaauuaauugcauuucauacccuugaagcucugauuuuauugauaauuuuguuuuuuaagugaacaaaaccucaaaauauacuagcaagguaaauuuauugauuucuccucuuaugcccgauugcuuaucaauuugguucuuuugucuaagaaugauccaauuagcagacuaauuuuuuuucaacagggaacuuucgccuucuuacacuguguucucauuggagcauugcauagucucugcauacguagagcgugaagauggugucuuuauguauaccuucuuaaguaagcuaaacugucuugaaaauggcaguaaguggcacauuaagacacaaaagguuauuucuuuuuuggcgaaugguuguuuguuuaaauggagaaacauaaggucuuauauugagagguagauuuauuuaauauuccauagauguaauuuuaaaaauauuucuccugucucagaaugaagugaggguucugcuaagacagcuuuguaauucacagcuuucuuugaaaaugcuguaccucuauuccuuauugauggacuugaaugcacaaucauuugugggguuuuuuuguuuuguuuuuaugaaauagcaguuugaucauuuauaccaaaaguuagugcuauaugauuagauaucaagguuccuuagauagaagcauuccaggcuggauaucugacuccuuuuaucaucugcaugguguacuuagcuguauauaaaauggaaaaguagcaaguuuaaaugacugguaaaguuggaggcacacucugcuacccagcgguucuauuucugugucuucuugagagaaacuuuuacccaugugcucaaggaucuauauagauggagguguaauuuauuauaauggugaucuagauaggaucuagauagauggagguguauuuauuauaauagugaauaaguacaaaaauacuuaacuguuccucaguaagugaauggauacauugauauuauucguauaguggaauucaaguaaacaauccuuaucuccagaauacuuagggcagauguauuuuggaauuuagaaauuuuuaaacuuuaaagguaauucgguauguauaccauuuauuguauaacacucccauugggauuugggaaacaccucauaaucaaacauacuaauuuuucuguagcaaaauuuaugaauauucauauuaagugggauaaauagauuuuaaauggcuucauacuauuuggguuaauuacauuuuuuaauuagguuaugggaaaacuuaagagcuuuuuggauuuuagauuuuuggaaaaagaauugugaacccauauuauaaaguucauaaaaugaaugaaaucgagcuacauguaucgauguggauaaaucugaagcauauuauguuaaguaacaaaaggaaguugcagagauaaccuugugcaaaugacaucauuuaugugaauuguuaaauaagcaacagugagagagagagagagagcucugaagcaaauaaggcaaauuauugguagugguuuucuuacuuuguuguauguuugaaugugucuuuauaaccucaaacuucagcuuuuaaaccuucuguuuuaccuuaagaauguaagguuacauugaguuaggcaauaagaguaugcuacaaagcaugucagaacuggaaguguucuuuaaaaucauuuaaauuaucaucccuucuuuuuuucuuacuuucuuuuuuucuuuucuuuuuuuuuuggaggcagggucucacucugccgcccaggcuggaguauaguggcaugaucaugguucacugcagccucagacuccugggcucagggaaaccuccugaguaucugggacuauagaugcaugccacugugcccagcuaauuuuuuuaauuuuuuuguagagacagugucuguguugcccaggcuggucuugaacuccugggcucaagcaguccuuccuccucggcuucucaaagugcugggauuauaggugugagccacugugccuggucuacucuuccuucuucuaauccaagucauuccuacuuguuaagagauucucuugaauauuuauuuauuuucccuuuuuaaaccuuagaccuuuuacuucuuuucaaaacauauuuugguugagauauaguuuccauacagugaaaugcacacaccuuaaguaucuuguuuccaugaguuuugacaaaugccaacacccguguaauccacaauucugucaagauacagaacauuuccaucaucccacaaaguucccuugcaucucuccccaguucgcaucaucccugccccgcagcacagguaguguucugauuccuuucacuuuaauuuuacguguucucgaacuucauuuaaauggaaucauacagucuguacccuguugugucuggcuuuuguugcucaguguguuguuuuuuacauuuauccauguuguugcauguauccauaguuauccuuuuauauacugaguaacacuccauugugugaaugugguacuaucaguuuauccaaucuucuguugauggacauuuguguuguuuccaguuuuuggcucuuauagauaaaaccacuguaaacauuuuuauaugguuguguuuauugguacauguuuucauuucucuuggggugauaccuaaggguggaauuccuggguccuaggguggugcauacuucacuucgugagaaacuaccagagcaguuuucaguguugcuucuggcugcuuccauccuugccagcauuugguauuguuaauugucuaaauuuuagccauucuaguggguguguagugauaucuuauugugguuuugauuugcauuuccccaguuacuaaagauacuagucacuuuuucguuugcuuauugguuaguuaguucaauugcuuauuguccuuagaagaacguucaucuuccccaggaauguauuuuucuuuuugaaguaucuaagucuucuacccacuuuuaaaaaguuuuuuuuuuuuaauugaguuguagaaguaguuuauauauucuggauacaaguccuuuaacaguuauauguggcaugccaauuuuauuuuuauaguggucucuuucuuuuuaaaauuuuuccucaucacucuuuccauaugauacaauguucucuuuugauaagcagaaauuaaaaauuuugaagucuaauuugugaauuuaaaguuuuaucauuaguacuuccuaagauaaccauccaaauaucuuucccuuaaaaguauaaagucugaggcugggcacaguggcucacaccuuuaaucccagcacuuugggaggccgaggcuggcagaucaccugaggucaggaguuugagaccagccuggccaacauggagaaacccugucucuacuaaaaauacaaaaacuagcuaggcuugguggcgggcaccuguaaucucggcuacuugggaggcugagguaugagaaucgcuugaaccugggagguggagguugcaaugagccaagauugcgccacuacacuccagccugggcagcagagcaagacucugucucaaaaaaaaaaacaaaaaaguguaaagucagcugaagugauaugaaagcuuuugugaucauagaccuaagcauuugaauugcaaauauaacuuggugugugaaagcucugcaguaugcaugcaggaauuaaaugucugucuggaaauaaugccaacaaauauauuuauugggguuugugugauagaauuggcagauaaccaaggaagcaaauuuauuuuccuuuuaaauaugaaggaaaauuuaugaaggaagagcaaauuuauuuuccuuucaaauacgaaaacaugaaguaaucuuuuguaauguuuacuaccuacauugauugccuuucucugcauuaauuucucaaaaauuuucuucauuaauuuucuugaggagcucuuuuaucugcuuaaugucuuuacaaacacaugugcaaaagagucucagacgcaucuuauuugaugauugucauggaaaauauuaaggguuuguguacaaauguuuauacugcaguguuuugcuucaagaaaaauguauggucuucucuaugcaaguuuuaucauuuuuguuguuguuuuuauuuccaaguccuuucuguguuuuaauuuuaauuuuuacuuuuauuuuugagacagagucucgcacugucacccuggcuggagugcaguggugcgaucucggcucacugcaagcucugcuuccuggguucaagcaguucucgugccucagcuucccuaguagcugggauuacaggcaugcaccaccaugcccagcuaauuuuuguauuuuuaguagagaugggguuuuaccauguuggcuaugcuggucucuaacuccugaccucacaugaucugcgugccuugcccucccuaagugcugggauuacaggcgugagccacuguguccagccaauaaauacuuuaaaaauaaauuuucaggccaggugcgguggcucaugccuguaaucccagcacuuugggaggcugaagcggguagaucaugaggucaagagaucgagaccauccuggccaauauggugaaaccucgucucuacuaaaaauacaaaaauuagcuaggcaugguggcugugcacuuguagucccagcuacuugggaggcugaggcaggagaauggcuugaacccagaagacggagguugcagugagcugagaucacgccacugcacuccagccuagcgacagagcaagacuccuucucaaaaaaaaauuuaaaaaaauguuuuuuucagcaauguguggaaaauauacacaagauauaagaccaauaaaaugcuacugucuaggagaugaggugccucauaccugaauccagcaccaaggugggcggauaaccugaggucaggaguuugagaccagccuggccagcauggcaaaacuccaucucuacuaaaaauacaaaaauuagggggugguggcguacaccuguaaucccagccacuugggaggcugaggcacgagaauggcuugaacucugaaggcggagguugcagugagccgagaucacaccacugcauuccagccugggcgacagagcgagacucugucucaaaacagaagggacuuggaaauaaaaacagcuaacaacaaaaacccguaacauagucauuuauuaucauuaucaaguauuauguacuguauauaauuguauguaccacacuuuuauaugacugucaacgcauuagguuuauuuacacuaacaucauugcaaacacauggguaaggcauguguuacaacauuaugauggcuaugaccaaugugauaggaauuccccacccucccacccgagacggagucuugcugugucgcuaggcuggagugcaguggcaugaucuccacucacugcaaccuccgccucccggauaagcgauucuccugccuuagccuccugaguagcugggauuacaggcacgcaccacuacacccagcuaauuuuugcauuuuuaguagagacggcuuucaccaugauggccaggauggucuugaucucuugaccucgugaucugcccgccucugccuuccaaagugcugggauuacaggugugagccaccaugccuggccugugauaggaauuuuuuagcuccauuguaauguuaugggaccaccaugauacaugcagucucuuguugacugaaacgucaugugguguauauagaaugcauuuaugacaguaggacuuacccauuuugauaguguuuucauuuauuccuuuuucuuuuuuuuccgagacagagcuuugcucugucacccaggcuggagugcaguggcgugaucuuggcauccuccaacuccugggugcaagcgauuuuccugccucagccucccgaauagcugggauuauaggaugccaccauguccagcuaagguucguaguuuuagagaugggguuucaccauguuggucaaacuggucucaaacucccccaccccaagugaucuacccacuuuggccucccagagugcugggauuacaggcaugagccacugcacccgaccacauuuucauuuauucuuuaacuucuauucuggguugugguagcauaaagauggauuauguuuauugcugaaauaaaccuguuguccaaauuuugauguuuuccagccauuaucuugcuacuuagauuuauguacagcauucgcagagcaaaaagauagaugaucuuauuuuuccuggauucagaggcagagaguaguuguuagaauucuaguguaauugcucauucauuuucuugacucugacaucuuuuuuuagaggaaaauaacuuugguuaguaagcuccaaauaaugggugagaauguuaaacaauuuaauccaucccuuugaguucuagugcgggucuuuuuugcauuuuggugagucuccugcuuguguuuagauuagucugaaaacuuugauuugguuuaauauuugagggcuuucagugugcuuugcuguacaggaaauaaaucucugucauuaacucaaagaauacuaaacuaacaauaaggaggaguaaauuaccuuggaggcucuuccccugucucauucucugugguucagacucauuaaauuaguuucuucuuuuaaaauguuucuucuuuuaaaauuauggaaauuagaauucaguugacguuuguacaaagugggguuauaucuguguauaaguuuugacaccccccaaauuuaacuauuaauagccuacuguugaccaggggccugauaacauaguugauuaacacauauuuuguauguuauauguuaacauguauuuuauguauauacugcauucuuuaaagcaagcuagagaaaagaaaauguuauuaagaaaauugucuggguguggugccucaugccuguaaucccagcucuuugggaggccgaggcugguggaucacacgguuaagagaucaagaccaucccggccaauauggugaaaccccgucucuacuaaaaauacaaacauuagccaggcgugguggugcucaccuguaaucccugcuacucuggaggcagaggcaggagaaucguuugaaccugggaggcggagguugcagugagcugagauugugccauugcacuccagccugggcaacaaaagugcacuccauugcacuccaucucuuggaaacagagcaagacugucucgggggaaaagaaaaaaaaagaaaaucacaaggaagagaaaauacacuuacuauucauuaaguagaaguggaccaucacgaagaucuucauccucaucauuuuuguuuugaguaggcugaggaagaggaagaagaaaagggauugguauugcugucucagauuuggcagaggcagaagaaaauccaugugucagcagacccucaaaguucaaaccugugugguacaagggucaacuguacuuuguuuucauagagauauauuaaaguuuuaugaguuuagcucauagugaucuuauagguucuaagcuucauuugaauauauugcauguaaaauaaaugcuuuaucuguguuccuuuugucuuucuugaauauuguuguuaauuuaaaauuuguaauagguuauaacucuuauguuuuacccauuugugagcuuuauuuuuggauaagaacuuuauccuguacuuuugcugugcuucguauaguacaacuaugaaagauucuuguugacuguugauuaucugaaaaugcuucuuuuugcuucaggucaaauauugaauaaaccuagagcauauaauuaacauuuuuauuaggacugugguuuguauuuuggccaguugggauuuaagaauuacuuguauugguugguguagaacugauuuuuuuuuucuuuuucuuuuuuuuuuuuuuggagauggagucucacucugucgcccaggcuggagugcaguggcaggaucucagcucacugcaaccucugccuccccgguucuagcaauucuccugccucagcccccugaguagcuggguuuacaggcgcgcaccaccaugccuggcuaauuccuguauuuuugguagaaacgggguuucaccaugguggucaggcugaucuugaacuccugaccuugugauccgccugccuuggcuucccaaagugcugggauuauaggcaugagugauuuuuuuagaauaagaguaauuggcugcauuauuuuuuuaaggaagagguauaacuucccagauacuugcaaugcggcuaauauacaguagccauuuacuuucaacauaauuucucaacauuuaauuuuugucaguuuuucauaaaaaauuuaugacaggguaaaaagaugacauuccuaaguccuagaaaguuuauugaugauaaauacaaagaauuaaauugcagaucagucuuagaagugcuauucuguggauaagcauacagcccugggcagcacagacgggaacaucagauagcccaaccaaaccggaagcuugacuugguugacuuaagaauucuuuaaaacucuuuugcguguuacauuaauaaaguuuauuuaauacauguauuuauauguuucagaaaaaaauguucuuaauuuaacauuuguaaaaggguacaauacugguguuuucucugacucugaucuucuugauaaacaguguacugaguucucugugauauauuuuguuuguaaucaugaccauuucacguguccauaauuuuuuuucucuaaaaauaucucuagacuacauaguucuguuauuuuaggaaugagaauaaacgggaucaaaguguacucuuguucuaagaaacuaaugacaguuuauuuguuggaaguucugccucagaagagcuucugauauuuaucuaaaauauaugaauaguaguugugaucugucauuguuuuugcagauaucuaauuguuguaauaaaagucauaggcccugucagauaguuaagaauuuucauuauuguuguucacaauauccuaccauuucauugagauauagcuugguguaauaauaguacagucccuggaguaaauuuuagacaaauacuuucccagccuuucaaaaucaagcugaguguuagagugagaaguagacuagugaguguugcuauaaaauuuggagugugagaucauuuugcagugugucgggaacagacuucccaaauagacauucuaguauuaucuuacaacucgaucuuuccuuaaacucaauguaucuguuuuugguugaucauuauagaugucugugaugugugaauaugcccauuuuaucuucuguaugaauaugcuggagaaagaguagccuugcuuguagucugcuuuuuuccuucuucuaaaggaguuggcaggaauuuuuauaaaauaaagcuagccugauuguagccaaaagaggaaauguugguuuauauuuuaguggagaaaacugcuguauagacuucuaggcuaccaagucagagcauuguuuuauuuuuauacuauaguaaaaugggugcaggcggagcugaagaaccagacacacuaguaguuaauguuuucuuucuuuaccaaaauaguaauugccaugcuacauuuagccauaugugccaaagcguaugugaaacuguuaacuguagccaacauauauuucuccugacuugaaugaauugaugacgaauggucagaaaaggaggaacagucauaccuagaaaucagcuucccuguugaauuucacuucugguauuucccuuugggauauauucacucaggagugucaggauuuuuuuugacuuccaagggaaagaaacuaggcuucagagaauuagcauuuugauacaucuuuuuauugaaggucuuuugaacuccagcaacuguuaaucuuuaaaagaugaugcugguagugaaaugcauuuuaaaauuuauauucaugaauuuaaauuccugauuuuuuuuuuuuuggugaguuuauucuucgaaagaaauagcagugcuuuucaaguguuugaagacuaccagaauugaaagcucacugcuugcuaaaagcauaauacccaaaccggaaaugauaaaggaaaaugucauugucuuuguauuaaaaaagaaaauaucuauuaaaagucaucauaaacaauguuaaaagaaaaauggcagacuuggaaaaauauuuguaacauacacagcaggugaaagguuauuuuccuaauaugaagagcucuuaaaauggauuaagaaaaaauguucaauaacaaaaugggcaaagaacaaggagagaggagucacaaaaguugauauacaaagacacagauagaaaugauuuguaauaugacaaaagucgauauacaaagauacauauagaaaugauuuguaauaugacaaaagucgauauacaaagauacagauagaaaugauuuguaauaugauaaaagucgauauacaaagauacagauagaaaugauuuguaauaugacaaaagucaauauacaaagauacagauagaaaugauuuguaauaugacaagucgauauacagagauacagauagaaaugauuuguaauaugacaaaagucgauauacagagauacauauagaaaugauuuguaauaugacaaaagucgauauacagagauacauauagaaaugauuuguaauaugacaagucgauauacagagauacagauagaaaugauuuguaauaugacaaaagucgauauacagagauacagauagaaaugauuuguaauaagacaaaagucgauauacagagauacagauagaaaugauuuguaauacgacaagucgauauacagagauacagauagaaaugauuuguaauaugacaaaagucgauauacagagauacagauagaaaugauuuguaauaugacaaaagucgauauacagagauacagauagaaaugauuuguaauaugacaaaagucgauauacagagauacagauagaaaugauuuguaauaugacaaaagucgauauacagagauacagauagaaaugauuuguaauaugacaaaagucgauauacagagauacagauagaaaugauuuguaauaugacaaaagucgauauacagagauacagauagaaaugauuuguaauaugacaaaagucgauauacagagauacagauagaaaugauuuguaauaugacaaaagucgauauacagagauacagauagaaaugauuuguaauaugacaaaagucgauauacagagauauagacagaaaugauuuguaauaugacaaaagucgauauacagagauacagauagaaaugauuuguaauaugacaaaagucgauauacagagauacagauagaaaugauuuguaauaugacaaaagucgauauacagagauacagauagaaaugauuuguaauaugacaaaaguugauauacaaagauacauauagaaaugauuuguaauauguaucagaauuacaauuguacauacuuugugauccagcaauuccaucuuugagaguucccaagaaaaauguggauucauguguaaagauacauaugugaaggugcaucuuacaauagugaaaaaugagaacuaaccuaaaauauccguaaguggaauuuuaugaccaacaucuucucuccaaccaauuuuuuuauuaugguaaaauauauauaacauaaaauuuaccaucuuaaccauuucgaaguguacaguuuaguggcauucaguauaucccaucuaucuccagaacucuuuucaucuugacagacugaaacuguauacccauuaaacaauaacuccucguucugucccacuccuauguccuggcaaccacuguucuaguuccuucuuuaucaauucgacugcucuagauaccucaugucaauggauacauauaguguuugucuuuuugugauuggcuuauuucacuuagcacaacgucuugaagguucaucuguguuguagcauguguaagaauuucuuuccuuuuuaaggcugaaaaucauuagcaggugauaugguuuggcugugucuccauucaaaucucaacuggaauuguaucucucagaauucccacauguugugggagggccauaggaggagguaauugaaucaugggggccagucuuucccaugcuauucucgugauagugaguaagucucacgagaucugauggguuuaucaggggguuccgcuuuugcuucuuccugauuuucucuugcugccgccauguaagaagugccuuuugccucauaccgugauucugaggcuuccucagccauguggaacuguaaguccaauuaaacaagugccuuuugccucauaccgugauucugaggcuuccuuagccacguggaucuguaaguccaauuaaaccucuuuuuguuuccaguuuuggguaugucuuuaucagcagcgugaaaacgaacuaauagagcagccaccuuauuuccaaaaaaaaaaaaagauuuuuucaauggauaaugcagguauuuauacccuuauuuaaaguaugagggaucugaaacccagaaagauggugacaugucuaaaugucauaacuagucagcgugagagucagaacugaaacucauguuuucucaucacaguuucguguucuucccaguaugguacacugcuuaggccuugaauacaaggaaugaucuuuuauuguugcuucuucauuccuaaaaauaagauuuuugaugucacagccuuuuggaauucauuguauaaugugcuggaauuuacauaaccauucagauuaaagguucguguaccuucuuuagggauagaagcuaaagaucuacccucucaaacauuuuaguaguucaucugcauuaacaccuuuauuuaauuagccacccauguuguuaccguccccuguauaaaaagcuuugcauauucuaacuuaaaaaaacuuugcuauauuauuaucuuuggguauuaccaguuuugauuucugcaaucugcucuguuuuugcuacuagaggaggaaagcugauuuggaguuuucuuuuuuucuugguucuaguuuuagugggcugcaaggauugcuuugaaugccagcucuaucacuuacucugugaucuuggacaagugcuuaaaccucucuaagccucgugcccucauuuauaaaauuaaauaauaguacauguguuggguaucuaaaauagucaaauucacagaaucaaaguguguaaugguaguugccggggguagggggaaauggagaguuacuaaucaacaggaauauaaacuuuugguugagaugaauaaacucuacagauuugauguauaacauuguaccuguagucagcaguaaugcauuguacacuuaaaaguuguuaggaaaguagaugucauguuaaggguuuuuacuacaguaaaauaaaaaaagaguccaugugucauaaugaagauuaaauaacauaaaaaaugugugguacaaucuggcauauacaaacuacuuguuaaauguuaauauuuauuauuuaauguuuauaauacuuaaaagucauuuuguauuucgcuguccuucgguuuugcuuguuuguuuguuuguuuugacacggagccuugcucugucacccaggcuggagugcaguggugugaucuuggcuuacugcaaacuccaccucccaguucaagcaauucuucugccucagccuccugaguagcugggauuacagguucgugccaccaugccuggcuaauuuuucuauuuuuaguggagacgggguuuuaccacguuggccaggcuggucuugaacuccugaccucgugaugugcccgacucggccucccaaagugcuaggauuacaggcgugaaccaccgugccuggccaauuuuuguauuuuuaguagagaugggguuuuaucauguuggccaggcuggucuugaacuccuggugauccgccugccucggccucccaaagugcugggauuauaggugugagcccccgcgccuggccauccuuuguauuuuuugaugaaaaaaaaaaauuuuuuuuuuuuuuuuuuuuuuaagacagaguuucacucuuguugcccaggcuggagugcaaugagugcagucuuggcucacugcaauucccaccucucaaguucaagcgauucuccugucucagccucccgaguagcucagauuacaggcacacgccaccacgcccggcuaacuuuuguauuuuaguagagacaggguuucaucauauuggucagacuggucuugaacuccugaccucagcugauuugcccaccuuggccucccaaagugcuggaauuacacaggugugagccaccacgcccggcuguuuugaugaaauuuuuugaaagaauguauucauauuccuguagauuucccauuucccacauucccucaaauuuaguuuccguguuaauaucuucuauuaauuuugaacagugucuuuauuguaguuuaugcaaagugaggagugagugccauacuuauuuugcuuccuguugagaauaaacugaaguuaaauuacugacauuuugcauauuaucucaaucauuuuuuaaggaccuguaaaacagaauaaggugaauccuaauuugcuagaugcagauuucuuguagcuauuuuugauuccugcaggcugcucugauuugcuacuugaggaggaaagcugauuuggggguuuucuuuuugucuugguucuagcacaugcagaugacaauccaggcucuccaggaugaauugcggauccagagggaccugaaucagcuguuucagcaggauaguagcagcaggacuggcgaaccuuguguagcagagcugacagaggagaacuuucagaggcuucaugcugagcaugagcggcaggccaaagagcuguuucuucuucgaaagacauuggaggaaauggagcugcguauugagacucaaaagcagacccuaaaugcucgggaugaauccauuaagaagcuucuggaaauguugcagagcaaaggacuuucugccaaggcuaccgaggaagaccaugagagaacaagacgacuggcagaggcagagaugcacguucaucaccuagaaagccuuuuggagcagaaggaaaaagagaacaguauguugagagagguaugugacuacuuuuuuaguuuuaugauuuguugguuaucuuuuuuuucacugauuaaucagcaucuuggccccagugaaucuacgugcucugccgugcugguggaagagaauuucauccuuuguauuuaagugcgucacugauuucuguucugauuugcccuguuguaugggaugacauugucugguauguaugcuggcucagugacuuucugggucuuuucucuccugcuccccugauuuugagaguucauuuguugcuaaagggguaaaaaauuccuugauuuuucacucaucucuagaucuguucauagagacaacaaacacaacaaaaccagaaucagaauagcuaaccauugcuuaauuuaaaaauauuaguaaaagagaguaagcgguuaucucagcuuaugugugcuuauaaaaguccuuggcagcaauaauggauauuugcccugugguuuccauggaaacuguugccuugcuguaaaagauacgugauaaaaaucauuggcugccauggaggcauagcuggagagagugauguagagacacaguguuacuuauuuuuagcugaccuaggugacuacugauaauuuuuuacuuuucuaaauaauguaucauuuuaagaaggcguaaaggaagaaaccaucuuauauugaauuaaaaaauuaauagccauaauaacuuuucuauauauaguuggacuucagguaauuuucacuuuugggcaggggaaaauaaaucccuaaucuguguuaguaugagucugaauaauuccuuuuuaaauaaaaugugaggaaggagguuuaaaaaauggcguauucccaaagcagcaaaauaauaauuuuuaaaaauacuucuaaauuuguagguuguucuauaauuuuuccuuuuguaaaaagucugaaaucuuuuuuaacagugagggcauuuuuauuuuugaaguagaacaucauuguuuuuuaaaaacaugauguuauuacacuggaaauccauuguaguaaaauugggaaauagauuaacaaaaacuuauaacucaaaguauuguuaccuaguaguaauuauuaacuuauguauaugcuuccagucauuuuuuuuuuauuuuaaauuuuuauuguuuuuauuuuuagagauagggucucacucugucacucaggcuggagugcaguggcaugaucauggcucacugcagccuugaaauccugggcuuaggugagccuucugccuuagccucccuaguagguaggucuacaggugcaugccaccaugcauuguuaauuuuuaaauuaaaaaaaaaauuuuguagagacagagucucccuauguugccuaggcuggucuugaacuccuggccucaagcaauccucccuccuuggcuucugaaagugcugacauuacaggcaauaugccuaugccuggcccauuauuauuauuguuguuguuguuguugaaagugcugagauuacaggcaauaugccuaugccuggcccauuauuauuauuauuguuguuguuguugaaagugcugagauuacaggcaauaugccuaugccuggcccauuauuauuauuauuguuguuguuguugaaagugcugagauuacaggcaauaugccuaugccuggcccauuauuauuauuauuguuguuguugaaagugcugcgauuacaggcaauaugccuaugccuggcccguuauuauuauuauuguuguuguuguugaaagugcugagauuacaggcaauaugccuaugccuggcccauuauuauuauuauuguuguuguuguugaaagugcugagauuacaggcaauaugccuaugccuggcccauuauuauuauuauuguuguuguugaaagugcugagauuacaggcaauaugccuaugccuggcccauuauuauuauuauuauuguuguuguuguugaaagugcugagauuacaggcaauaugccuaugccuggcccguuauuauuauuauuguuguuguuguugaaagugcugagauuacaggcaauaugccuaugccuggcccauuauuauuauuauuguuguuguuguugaaagugcugagauuacaggcaauaugccuaugccuggcccauuauuauuauuguuguuuguuguuguugaaagugcugagauuacaggcaauaugccuaugccuggcccauuauuauuauuauuguuguuguuguugaaagugcugagauuacaggcaauaugccuaugccuggcccauuauuauuauuauuguuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccauuauuauuauuauuguuguuguugaaagugcugagauuacaggcaauaugccuaugccuggcccguuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccauuauuauuauuguuguuguuguugaaagugcugagauuacaggcaauaugccuaugccuggcccguuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccauuauuauuauuguuguuguuguugaaagugcugagauuacaggcaauaugccuaugccuggcccguuauuauuauuguuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuguuguuguuguugaaagugcugagauuacaggcaauaugccuaugccuggcccguuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccguuauuauuauuauuguuguuguugaaagugcugagauuacaggcaauaugccuaugccuggcccguuauuauuauuauuguuguuguugaaagugcugagauuacaggcaauaugccuaugccuggcccauuauuauuauuguuguuguuguugaaagugcugagauuacaggcaauaugccuaugccuggcccguuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccuaugccuggcccauuauuauuauuauuguuguuguugaaagugcugagauuacaggcaauaugccugugccuggcccauuauuauuauuauuguuguuguugaaagugcugagauuacaggcaauaugccuaugccuggcccauuauuauuauuauuguuguuguuguuguuguuguuauuauuauuauuauuauuauuauuauuauuauuauuauuauuaucauuugugacagagcuuugcucugucccaggcuggagugcaguggcgcaaucuuggcucauuguaaccuccaccucccggguucaagcuauucuccugccucagcuuccugaguagcugggacaacaggcgugcacaagcuaauuuuuguauuuuuaguagagaugggguuucgccauguuggccaggcuggucucaaacuccugaccucaggugaucugccugacucggccucccagagugcugggauuacaggcguaagcuacugcacccagccccauuuuuauuauuuauagauuccuucauuauuuguuucuuuuuuuaucuuacaaggauggaaugcugugcaucagcacuguucagaaagacuuucuggguggagugcuaauuaaguugggaaggggauuuuauaacaggguaaguguccuuuaguagguacccuuucaguggagaucugaagagaagaagccagcuuugccaaguaaaauaauuucaugaagaagcauuaacaguuuuaaagaccucauaggaaggaguuuugaggaaacaggagggaggcuggagggcaagaauauacuguauaaggggaagacuuaaugagaugcgaaauuggagagguggccagagucagauucacuuaucacguauuuacuggacaccaaccaugcgcacagcacuaaggauauagcagcaaacaaauccaugcugucuuugagaaaaaguaccugccuuuaugauccuugcagauaaugcaaccauuuuauucaaaaugggagagaaaaccauuccaccguugaaucaagggagugacacaaucugauuugcuuuuaaaauuuacucugguugugcugagaauaaauggaggaaggagagaagagugaacaagggaguauaguaaggaauuuaacugcuguaaucuagauuaggggaauggggacuugaaaugauugcuggagauguacagaauaucacuagcguaucaggaagcagcacaaagaauuaugggcuggcaaugcuaggguauccagaaauuucauuaguuauugaauuauuguccaucuuuuaaaaaaaaguggcauuuaaucaauucuuuuuuuuuuuuuuugagacggagucucgcucuguugcccaggcuggagugcaauggugcgaucucggcucacugcaaccugcgcccccuggguucaagcgauucuccugcuucagccucccgaguagcugggauuacaggcacccaucaccaggcccagcuaauuuuucuguuuuuaguagagacgagguuucaccauguuggucaggcuggucuugaacuccugaccucgugauccgcccgccucggccuccuaauaugcugggauuauaggcgugagccaccgcgcccggcccacauuuaaucaauucuaaaagucacaacuuucccuguuuuaacaaugaaauugaguuaaguguuaacacuuggugucauguuaacagucuauaucagcaaagcagcaguccugguauauuuguuugcccguguauucacaaauauaaucauguccauucauuuugucaucauuucagcugagguaugagcauuguuggcauuucccauguuaacuuuguuguucaguguuucugcauaaauauucugugaaucagcauugaaacaaaauuacccgguauggagaaaguuaugaaaacaguuuaugaugguaugugauuaaacucuguuuaaauaaguuuaaaaaaacuaacucuugcaaucaguauuaaguaaaaauucuagggcgggugcaauggcucacgucuguaaucccagcacuuugggaggccaaggcgggcggaucgccugaggccaggaguucgagaccagccugggcaauauggcaaaacccugucucuacuaaaaauacaaaaauuagcugagugugguggugcacgccuguaaucccagcucuuugugaggcuggcacaugguaauugcuucaacccaggaggcggagguugcagugagccaggauugcaccacugcacuccagcgugcagagugacacucugccucaaaaacaaacaaacaaaacccuaaauuuaugauaaaguuuugugucaugauuuauuuggaggcauuuccacuauuucuuuucagcauguacaacaguggugugucuuauaaucaguggcaucuuagauuugaugaaauaagauagcauuaaaauggcauuuguagcuauuaguaguaacauuuguaauuaguuuuacguuuucuuuauuaacaugauuuuguagcuggcagguaaauaauucucccccccaaaagccgagagguaaaaaguaagauuucaaugaagcauuguauuuucuguuuguacucaaaucacauuguuguuugaccgcuuauucuuagcuuuuguauuauuucgcuguagcuccuuucauuugacuguuagaagaguggggacaucucuuggacaaaugcugaauuacaggcaagacuugguuagugcugagggcuugacaggugauucuguuauacaccaacauuugaggccccaacuuugguuuucaguccgcuagcagaggauaccuaaguuggcuguggaauuuuugggucuucaauccauaugcauaccaaacauugucuauaggccaacuaaauaauauauuucaguaugugcuccuacuuacuuaaaugcugguaugcuauugugauuaauaaaauacaacuuuguuuuaaaacauuauugcagccuacuaguuuuuugucuguauuuuaaucaacaaaccguauuaguacaacugcuaucguguuagguuugcaaaaaucuuugagguuaaaagugcuaauauuugaauauguucuaggcuagggaauucugaaucuaacuagcauaucugaggacugcuugucaguuugucaguauuacuggcagauagaagguauaagcagaggagauuaaagaaaaaaagaaacauauauauauguuuauguguauuuauuuauauauaaauauauauuuuucuauauauaaauguauauuuuucuauauaaauauauauauuuuucuauauauauauauauauauauauauauagaaaaacauagaaaaugaauaggaauuuaaaaagaaauuuuuuuuuuuuuugagacauaguguggcucugucgcccaggcuggggugcaguggugcaaucucagcucaccgcaaccuccgcgucccggguucaagcaauucuucugccucggccuccugaguagcugggacuacaggugccugccaccaugccuggcuaauuuuuguauuuuuaauagagaugagguuucaccuuguuggccaggcuggucucaaacucuugaccucaagugauccucccggcucggccucccaaagugcugggacaacaggcaugagccaccacacccggccaaaaaagaaaaagaaauucuuaguuugucuuuuguagcaauuuuggaagaugagaacaguugcauaccuuauuuauuuaaguuauuccuucucucucuuuuuuuuuuuuggcaacagagucucgcucuaucgcccaggcuggagugcaguggugcgaucucagcucaccucaaccuccgccaccuggguucaagugauucuccugccucagccucccaaauagcugggauuacagacgugugccaccacaccugggcuaauuuuguauuuuuaguagaaaugggguuucacuguauuggucaggcuggucucgaacuccugaccucaagugauucgcuggucuuggcuucccaaaugcuaggauuacggacgugagccaccgugccuggcccuuccucuccuuuuuaaauuacaucauuuguccuucauuuccauuuugacaaggugacauuuucugagcacacuacuauuaccagagaugguaauggguucagguacaauggugugugacacugggcaaguuaagauacgaaaaagugguaacaguucuuuccauuuacccucccuucuuuuuuauuucugucuccgcuguguugucaguaugauaaauucagaaauugaaucugugaagggacuucccgaacaauguggagcuucuauccuugaaccaagggugcugagggcuaagacuugaaacuugaaaaaaaauuuucagaccuaaguuuuacuuuuuagucacacauacuucuuucucucaggugugcaaguaaaaguugacuuacuuuuacaaagaaacaacuagggaaaaggagaauuauuaaauuuuguuucucaggcgugguggcucauaccuguaaucccagcacuuugggaggcuuaggugggcagaucacuugaggucaggaguucaagaucagccuggccaacaugcugaaaugccgucucuacuaaaaauacaaauauuagccaggcaugguggugcaugccugcgguccuagcuauuugggaggcugaggcaggagaaucgcuugaacucgggagguggagguugcagugagccgagauugugccacugcaccaaaaaaaaaaaaaaaauuguuucuaacuuguuuauuuucuaaauauaaauuagucauuauucuuuaguuauuuaaggagagaaaaugaacauauuuuuuauggucuaccacauuugaaaguauauuauagcaacauuaaauggacuaagacaaaaaaagacaaauagacuauauaacaagauucagauacuucuaccucuaauuuuuucaaaugaaaauuuucagccaaaaaggagugaaauaaagugaccaaauagcauauucuacuucuuacacuucuuugaauaguacuucuauuuccagucuucucucucuauugacaaugcgggaggcauaggcuugaugugcuuggugggaaaggggagcuuaugagcucacugacuggaagauguguucauagugaacuguaaggugcaggcuucugaaugggaguuuguuuugagcaauggguuuuaaaacgucuuuguagaaaagcuuuaugccuauggaugguuuaaaauacaccccaauucuuuauuguacgcagggaaggauuuuuuuuuuuuuuuuuugagauagggucugacuuugucaccuagagugcaguggcgugaucuuggcucauugcggccuccaccucccaggcucaagcaguccuccugccucagcccccgcaaguggcugggacuacacaugagcaccaccacacccagcuaguuuuauguguuuuucauagagauggggauucaccguguugcccaggcuggucucgaacuacugagcucaagugaucugccugccuugguuucccaaaguguuuggauuacaggcaugagccacugcacccagucaggacuuuuuauucaaauggauuuuucgguuuucuuuaggaauuaggugaugcucaagaggagaaaucagaugaaauaaguugaaaaucuaaauuguguguuauuuuuuaaaaaaugcaguuuuaauauuuucaaguagauacagaaauaccaaauaaaaauguuguaaaguauagguuauaaaauuuuguuaauaaaugaagauuguuuacaguuagcagaguucauuuuauuuuuacucagacaauuuaaaguucgacacucauuuauugaacaaauacuguuaaauaucuaccgugugcccagucaaucaccuuguagugugcagaacagauucaacauggacaaacuaggcugggaggaggcugacgaguuugucguuuuaaggcaggugagagauuauuauggccuaaacuaauuaauguguuagguguugggauggaagaaaacaaauaauuuuaagagauuuuaaaaacucuuuuuugauacaauauggaaugcauguaagaaauagaauaaaacagguguauaguuaaguaaauuauaaaguaagcacccucauaaccacuaccuaggucuagaaauagaacuuucacagccacccagaaguccuguacgugaaccaacccagccagaacucucccuucccucuaaaaguaaccaguguucuggguuuuauaguuaucaugccuuugcuuauuauacuuaucacaucugauccuuacuaucauaguauuguuaucuuguauuauauguuaaauuaauaucauuccuagguaucaucccuaagaauuaugucuuuguuuugucuguuuuucaaaaauaugcuuuaaaucucuuaauuaccgauuugcccuuaauuccuccuuuuuuuucucgugcaguuggagcauuucuuggcuuauuagcuggaaugacaauuccaucaucuuuguaauauccauguuuauuucaguggaaugacuucucuccugguuguaggucauauuuuccuacuucguguguauagaauuugugguaugauggacauuuuggacacaaggugauugaguaucuggauuuugguaccuuccuuaaugaaggguuguuuugucuggcaagaguuaauuuacuuggggauuaacuugauccuuucaagacuugcuuuuaaacucuguuaggccugguuuagaauagccuuuucucuaggcuacaucagcucuacuccuaagcuugaccuuuuagugucucuacuaaaugccucugcuguucuccccacuauuuggaacuugaauuuuucccagcccuaugggguucagguaguuacucaacucauggcucucugauaguugcucuuucuccaguagcucuugaucuuauuuuguggcagcuugcccuauacaugcacagcuuaguauuuggccaaagacucaaggggacccuugucagguuagacagugcugcuuuucugguaagcucccuucucuguguuuuguuuuuaauuuuuaauuuuuuuuuuuuuuuuugagacagagucucacucuguugcccaagcuggagugcaaugucgcgaucucggcugacuguaaccucugccccccagguucaagcgauucuccuuccucagccucccgaguagcugggauugcaggugccccccaccaugcucagcuacuuuuuguauuuuuggaagagacgggguuuugccauguuugccaggcuggucuugaacuccuggccucaagugaucugcccgccuuggccucccaaagugcugggauuacaggcgugagccauggugcccggaccucugguauuuugcuccgcaaaguuuugcagauuaaugggaaccuuacucauuaaacugucuuuggagcuuugcaagacugcuguucuuuguuugggcuuucccucccuacgccccauacuagacauaucugggccaucaccuuguuuauuuucucucaaggaucauaguccuguauugcuuguuauccagggucugaaaacaguuauuucaugcauuuuguuuaauuuuaugauaguuuaugacaggaaggcccaucucaccuuauggucaaagugagaaguauaaugguaaauuuauugaaagauuuaaagcagauuaaugccaugauuuguggauauuuuaucaagaucacccuggugcucucuugaaaauagacaaaggagguggaagaaagcuaacuagaggcuguugcaaacuagacuggaaauggggugaaaugguuagacucaagaaauacuuccgcacuagaacaguuaggaccugcuguugacuugguugugggaaaugaauaucaggaggagaaaaaggagagcuuugguguuuggcuugagccacuggaauggcagugccauuuaaugagacagagaagacucaucucucaucagagucaccagaugaugggugagauugaagaagaggaaaucaagaauuuuuuuugauaaaauaagugugaguugccuguuagacaucuaaauagagaugccaaaugggcaguuggauguaugaguccugaaaucagagcagagggcaggccuagaaauucaucagcauuuccguuguauuuuaaaccauguaguagauuaaagaguuuagauggaaaagagaaaaagguuagaacugaucaccuggucacuggucuaauuuagaccuggaggucugauuuagaaggaagaaccugugaaggaaacagagaaagugcaacuggagagugagaacuaaaaacaggagagugugauguccuaauagucaagagaaaacaagugucuaggagggauugggccguugcuuugaaugcuucugagaguuccagggagaugaggacagaaauguguuuguuagaguugguaacuuagaauucguugguggucuugaugaguuguuucaauggagggguagagaaacaagccagauuaggcugcuuuuaugagguaaagggaaucuuguaugucugaaauauuuuaaaauuaauuaaaauaaaaagagugaaugggagagggagaggaagaaggagagauagcagguguggaccagcugucuucagggcaggcauuugaacaccuuggaguucacagagacucugcaguggugugugggcaguuucagauucucaacucccaugugucauucucuggauuuuaguuggccgaaaacauaccugugagaucaucuuuccccucccuuuuuaugguugcacuuugcccacucuaacuccuguucauccuucagcucucagguguuccuuaggaaacuuuacaagaucccaagacuacgucaggaucuccuaauuacucucuuacaguauuguggauauuuucuuuauaacacuuuuuacauaugaauuauacaguuacuuaaaaaguauuuucauucauuugacaaauauuugaguacuaucauuguacuguguauuguucugggugcugauauacaucagagaauaaaaaagaaaaauuccugggauaggagagacaaacaauaaacaaacaguuauaaauaccaagaaaaaaguagaucuugguuagggagauuggggauguauauuagagucaaaucauaagugaaaaugggguaauaaggaugagccugcuugagacuuugauuuuuuuuuuuuuuuuuuuuuuuuuuuuuuuugacagagucuugcucugucacccaggcuggacugcaguggcaccaucucggcucacugcaaccuccaccuccuggguucaagccauucuccugccucagccuccccaguagcugggauugcaggugcgcaccaccaggcccagcuaauuuuuuuguauuuuuaguagagauaagauuuuaccauguuggccaggcuggucuugaacuccugaccucgugauccacccgccucggccucccaaagugcugggauuacaggcaugaaccaccgcucccagccgagacuuugacuuuugaacagacuucaacaguuaagggaaggagagagccugucaaagggagcagugagugaaaggccuuaagucaagagggugacugacauguugaggaaaagcaaagaggugagucuggcuggagccgacuggaugagagagaggaguauaagagaugaggccagagagguaacagggccggaucauguagagccuucuaggucagcauaaggacugugacuuuuacugugaguaaaacgagaagcuuuugauaauugcaagcauauuuugacuucugcuuuaaaaagaucacucuagaugcucuauugugaauggugagauagauuugggagacuguugguguaauccaggcaaaagauaaugguggcuuagagcagugugaugguggaggugguaaguuucaggauauauuuugaaaaugggaagagcaggauuuccugaugaguuggauauagguguaagaaaaaaagagacuccuauguuuuuggcuugaacaacuggcuggaugcauaccaugaaucaaggcaggaugagugaagcaaguuuagaggggaaggccaggaggucacuugcagauguguuaacaguggggcagauauuugauacuccaggaaaguaaagguacauacgaguauggauuucaguaggagguaaacauuugggaguuaucaguaugugcaugauacugaacgguaaauaccaagggaaugaguauagguggaaaagagaagccuacaaaggacugaugcuugggacacuccugaggaguugggaagaaaagcuuaggguaagauaggaggaaaagcuuagggugccauaccuugaaagccaaggaaagagaguagaauaaggaagagggauugagcaguuggguaaaaugcugcuggucagguacagugacuaaggaugcaucaugggugcuagcaauguggaggucgucagugacccugaugaauugcauagaugauuauuugauuaaacucuauuuuuccuauuaaagcuuccaugauaaaagggaccaaauauguuauuucucauuauuauaucuccaaaacuuaguuccuggagugcauaaaugggauaaauacauaggucccagagccucugggaggacuagagaacugggcuccgaaguuauauagacaagaauaaugccucgaaucaaucacacuucuauauugcuuuagugaugacagugcugcguggcacaggcaugugaguguguuacgccgacaucacugacacugcucaccaccacuggagccucugcuguuggugugucuggaagccugagguagcugcugccucugccacccacugcuggaauugucuguaaauauucaugucccggcuucuucaugucacaagauucuguuucaaaguacaugacgaaugugucugauugaggugauuaggucauguaccugggcuuuaaucacaagaaaggcugggcaacaaguauguggcauuuucaauuucuguugugggagguagacucugccuuuaaauguggaguucccacacaugcuaaggaauucagauaucacacggcgaggaagagugaugaaugccugccacggugcgagauaaauagauuuugugggguauacguguaaagguaauaguugaaaccauaggauuagggaagggcuauuuuggaugguuauuuguacggguuguucaccaaacaagagcuuccugcugauggagcccguaggcccuaaaauucagccugugcuucauggugauguugcaucuacccaagaaggguugcuuuuuuucuaauucgcauaaaguuacucuguggauuagugaaggcuuuggauucaggcuauagaauccagauguuccaaggacaggaauuuagaaaaugucugcagguaggaaaggaaaaggguggaguuuagagcuaggauaauucuuuaauggaagccgguugaaaauuuuaaagacguuccuucuuuaacuuaaauuuuuuuuuuucugguaccagcuagaguuugcaaaggaggugaacugacaauaacuauuagguuuagaaacaaggagguuuuuuauuugcuauuuuagaucguaugguucaguggagaggugaggauagaaacuggcugaucauucauucaucauucauuccuucaucuaacaaaagaggaacagauagagaggagaaguaauuuuuaacgacugcuuacauaucagacagugccugaggaauacagaagacaguuucuaaaagaguucacaguaugguauguuagagaagaaaaacuauugcuaauacaaugggguaagugcucauggagcuauguaagcuguguagcaugcuguaugagaaauaggagguguacaaaauucagcacaggaguaggaagggacuaaaauauuuccuuucuagcuaauucuugaacguuugguagccauuucauucauucaguauucauuccuuaaaugucuauuaagcgcuuaccaguguggcagcuacuguuguaggugcuuuggauccaucagugaaugaaugaaacaaagaucuuagcuuuuguggagcguacauucucguagagaauaauaaguaaacauaauaaaucauaaaauauguuagaggguaagugcuauacacaggaaaaaguagagcgaaguaaaggggaaggacacaugcguucuuuuuuggcuguguuaaauuuuaaaauaagguguagauuauacugaaaacguugaacauucauuuuguuaugaaaaauuucaagccuacacaaaagcaguaagaacugcaugaugaaucuccacaugcucaucacucagauacaccaguuucgaaaauuuugccacacuuccuccauguauucuuuuuucuuuuuccucuuuucuuuaccaaagauuuuaaagccaaucccuggcaugacgucauuuuccucugcagacuuuaauaugcgucucuaaaauauauggacauuuucuugcauagcgacaauggcauuaucacaacaacuaaaccuaauacuaacacaaaagaggcauuugagccaagacuggaaagaagugaagucuuccccuagcagcuugugcaaagggcuuaaggaucaggagcaugcuuagcauauuugaggagcagcaaggaguccauaguggcuaaagcauggagacccagggaagagcgaugagaugaggccuuugcaggcugccgagaggacuugggcucuaguuggagucgaauggggagccaugacaggguuuucagcagaggacugacaaggacaacuuuauguuuacaagggucacuugaagugcuccauuaagaaaacacuguaguggagcaagauaaagcagagcucaguuagaagguuguuauggauuaaaagguauauuuuuguuuagugguucauuccaggugguggccguggagauggcaagaagugcuuggauuuuggguauguuuugaagcuagagcuaacuggauuuccugacugcggcuugagagcgaaaggaaggcauuaagaagacucauagguuuguggccugaguaacaggaaggauggagcagguuugggggcaccaucaggaguagagaugacaucuugccauguugcccaggcuggucucgaaccccugggccaaagugacccuccugccuuggccucccaaagugcugggauuacagguaugagucaucacgcuuggucaggaguugaguuuugagcauguagaguuugaaauguuuguuggacaugaaagugagaugacuagguggauaguuaaagcuggaaguagggagagaggcagcagaaagcauucaucucuguauucccuggauucccaagagccuguccccaggguacuuggaaguacugacugauuuauuuagagacauucacagagucugacaagaaaaucacugaagugguuugguaaccuggaaggcucugauaucccuuccuuccuuuucuauccugaacucaguaaaauuuggguaaaaaaaaaaaaaaaagcuauguuuuucugacauuuucugaaccugaacuacuuaggaaacuuguucaacagugucauguuuuucuuccuaacuguagcaccacuagagagcgagcuucaucguagguaaccagguggugguuauucuggggguggaugccguggaaaggauguugucaacacagauugcuuuccacagcugcagucagcaaugcagacugauugugaugguauuuauuucuccuuuuaaaagggagcauuucuaauccccauuuuggaucauuuggaauucugauuauauuucccggaguuauguggaagauugacacacaaccugaggaugugaaaucguaguuucagcuguuaugguagcucgugucugugugacugauuuuaaauaacuagguguucagagauagggauccuccuaugccugcaugguugagugagccugaaugcagucuguggauucccugauucacagggaaagguugguaacacagaaggggucauugucucauaaggcuguagugaucuuuugcauacaucggcucucacuccucuuugaaaaaaaugagggugaacaggagagcacugaaucucuuucugccucuuuucuacaggagaugcaucgaagguuugagaaugcuccugauucugccaaaacaaaagcucugcaaacuguuauugagaugaagguaagugagaaucuaguaaagaaucuuaugaauuaccuuauacuuuuaagugaucaaaaacuuccaugugugaguguuaggaaauggcauguaauaguauuucacuuauuuggagauuaagagugagaaucaaugaaaaugacaucuuaaaagaauuucaguuuuauuuccuuuuacuuguagaccauaauucaaauuggaccaaaaagaguugaacagaauuucuuuaaaucagcuauucgcagaugucuuggucucaggaccccuuuauucucuuaaaaugacagacucacuuccuucauuuuaagaaaaugucugccagauaccaagucuggguaaccauagcuugucaguuuucuuucaaguaaaaauaguguuccgugaagaaaauacugaauucaguuuacaacucaaagcaacacgaguccugugcuuagggacagccaucguauuucaguacgcagcuucauuccauuugucacacacaauauuaaaaguauguguacuccagaguugagauuuuuuuuuauuauuuuuuauuuuuauuuuuugagauggagucucgcucugucgccuaggcuggagugcaguggcgugaucuuggcucacugcaagcuccgucucccggguucacgccauucuccugccucagccucccaaguagcugggaccacaggcgccugccaccacgcccagcuaauuuuuuguauuuuuaguagagaugggguuucaccguguuagccaggauggucuccaucuccugaccucguuauccgcccgccucggccucccaaagugcugggauuacaggugugagccaccgcaccuggccaagauuuauuaaaaguaauacuuuuuacugcuucuucaagggcgguauuaaaugaaguagucuuuuaaaaauuuuauuucuuauuuuucauuuuuuuccuacaaguacuugacgugacaaauauuaauauaaugacuacaaguaugguuugaugccauugccuugauuugugcuaaggcacuagcaguuuugcccaucauugcuguauaucuuuagugcagacaguggaaaagucaagugacaucaugguauuauugugaaaauaguuuugaucaugcauacuuugugaaaggguugaggguacccugagaguuccauagaccauccuuugaaaaccucugccuuaaguuaaugaauauuuagaaaucuuuaggcuguucaguauagugauuaagagcuugcuuucuaaguuaaacucccuggauucaaaaucucgcuucacuuaaccaacuguaagauauggagcaaauuaccuaugccucaguuucuuuaucaacaaauggugauaguaauaguacucauccagugggucguuuugagguuuaaauuaguuaaaacauguaaaaacacuuugaacaggaccuagcgcauaguaaacauucaauccauacuagcuguugcagcuguuauuuuuguucacaaucuguucuuucucauaaaaguucauguaguuagggaccuccccccacaacuacuucuucauauccucuagaaagcucaauacuguguuuugcauugugggccuucauuuaauauuuguugauaugacaagaauauuuagucaaugguauauaaauaauuuuauguaaauagauacuucugaaguaguuaugggaacuguugucuuaauuuggaugauuuccucuuaaaacuuuauaucguauacaucuuuauucucgguggggaaaggauuuaccaaacaaauuccgaauuaguggauucuggguucuuuguaguuaauugguagucuugaguauaaucuuguaaagggccuuuagaaucguucaguugcaugguuuuacccuuuccacauucaccacaaguuuguuguguuauuuccugaucccuuguuaacaccuaagaauaaaacacaugaauguaccuauguccacaaaaugauuuguuuaacugccuuuugacagaaugaggacgaguaauaguauuacuugguggcaauggaugcauuuuaaguugugugaaccuucagccauucugcuaagaaggagaaagauucugguggcccaguggggucaagaggaugugaugcugaaaucacaacagaaauagcuguguugcugagaauguggaaugagcuucagagaauuaugaaaaucuaguguagucuuuagggaaaauagggaagaaaggugauugaaguaaaagagcccaguaaucuugaaggugaugcaauuuucuuugcccucuccucuuucgccucuucuuccucucuuuccucuucuuaucccuucucccaccauuuucccucauuccagccuuuccuucuuuguuccucuucuucucuuucucuuccuccccuuucucuacuauuuuuuuguuuguuuguuuguuuguuuuuccuuuaccaguggaggaacagggaagaaugacuguacugcucuaggguuagaguuuugcugggauagauaaagcagagcgagugauugggaugcaaaugaauugagggugaugaugacagaguaguuuggacguugguccuggacuguacccuggaucuggaaagaguaaaauucagguggacugacagguugggagaaaauguaaaaguuaggaaaguggaauucucugugagguugaacaggaaauaaucagagugaggguaugacaggccaggggaagagaguucuggaugaugauaggauccaucaguccuauaaacuggaucacccaaauggacuggaggaugagaucauugcaauuaagggcgucaaagaauucugacauugcaauccucggauuauggcaagaguggugauugaaggggauauuguaagccaggugccaaagacuuccaaaaaugggcaggagugauggagaagucccuggauggcagcaauggggaggguagggugaaaaggaguaugagcuuuccauaaagggaaacagccuugaagaacugggagaaugucaacccuuuccccugcuccuuugugguguugggguguuauugaccuucacuggagagaguucaugggaaaaagguugagaauuuggggaauuugacaaagagcagaggauuucaguaaguccagugggauugguugguuaaugauggaagggcuggggcuggggaaguacagaguaguaaagugaaaaggaauuuuuuuauuuaaauauuacacauucuaggaauaagaaaccugguuggaaugacuuuccuuaaacccagcauugguacccguuggguuggugcuagaacuaguugagaguaucaggccuuaauuuucuggccugauuuccuugguagguucuucuucuggucagucaguaccugccuccugguuuucagagcuggagucaugaucccuuuuugggaagaagguuuuauggcucaugauuugguagugagggugcuaauuugucaaaagcugccuuugucuguguuuaggguaggggagaaguuagauuauauuuuuaagggccuuguagagacuuucuagaggcucuguacagguuccggcugccaugugauguacagaguuggaguucuuaccugggacuaaauugucuugaguggagccccagugcugcuggagauacacuucccucuuucagcugguccaguuucauuaccacucaggcugaugacagaggagaacuuaccuuuaacuuucacuuucuuucauuuguaggcuagucauaugcuuaugccuaguauuuuagucuuuuuuaaggugcuguguucugauauuuccagagaaauuuuauagcaaucuuaaaagugaauuuucagguagugcaauugaaguaguacuuuuuaugggucagucauuccacaugaguaaauaaaaauccugguuuagguauagaaugacucugauuguauuaauucaguacaauggauuuugaacagguacauuuuaaguuuaauuugaaugaauuuauaaaagacaguuuucauugugauauuuuuaaaggucacgugaugagcaagacagaggaauacauccucuccuccccucccuugaaccugaaaauagcuagguguaguuuucucgauauaaagccuuaaucucucucaucuuuaugcucugagaauaaaggagacuuaaucaagaaauuauugagguaaaguagaaaaggaguuaauuucaaaauagcuuccaaaggaaugguuuaucuaaaacuccaagugaaauaaagcuaagcuauacuuaauuuaugcucuuuaaggucucuauuucuuuggugaguaagcaccugcagcuacagauacauaaaacuauucauuccauguaggagucuuucuguaauucaugacauguaaaguagccuggggagaaacuagguacugcgacaaacaaaaucaagagaucgaauaugaaauaauguucuguuggaaggugauauuugugguagagaugaugguuuauaaggacagugauuuuuaaaaauuaagaauuauuuuaaauguaugaaguacagacaauaaggauugcuaacaugauaaauaacuuaauuauucccccauuuuucugcagugggauguuauguaauuuuuauuauugcacauauagcuguacacguuacuguauaaaucuuugaaacccucuuacuuuuuuccccuccuuuggggcauaauauguuuuuuaggggucaccaaguaaaaugauaaaauacuagaacuagaaaaggcuuuacuauuaauauuggaaauuuuuuucaccagaaauuuguaauuucugaugcaaagaaauuuuaaccaguuuuucauugcauuuacuucuucaguaauuuaguaauuauuuucaacuuuaauuuaaagggugcagagcuggaggcagccauagaagaaaaaucauacuguggauaugagugcuucuccucccacucaaauggcuguaaaggacguauuuuagaaggaaggcacuggcugggcaugguggcucacgcccauaagcccaccacuuuuggaggccaagacagguguaucacgugaggucaggaguucgagaccagccuggccaacauggcaaaacccugucucuacuaaaaauacaaaaauuagcugggcaugguagcguacacuuguaaucccagcuacuugggaggcugaggcaggagaacugcuugaacccagaggcagagguugcagugagcuaagauugcgucacugcacuagagccugggcgacagacucugucucaaaaaaaggaagcaaggcaccaauugccagacagcauuuuuucuguauauuugucuaucuuuauuaaauguaacuucuuuaaauaucauguuauucagcuuuucuggguuuuugugaauacuucaaucacuaaaucuuccauugucuucaggauucaaaaauuuccucuauggagcgugggcuucgagaccuggaagaggaaauucagaugcugaaaucgaauggugcuuugaguacugaggaaagggaagaagaaaugaagcaaauggaaguguaucggagccauucuaaauuuaugaaaaauaagguaauggcaugugagacuuuugauucuuaaaaggaguuugaaaaauugaugcauauuuuuuacuucucuagugaugauaaagccguauuuuacacucuuuuaucagguuucagggaagaauacuuuuagcauaguucuuucaaaugaaacuucuccagaauuaaagucagaauuacugacauagauaguuacuacaaguuuuuacuuauaaagacaauucucuguaugaggcuacauauguauugucaugguuuaaguuuucauaucuauuaguacuuccgaaaaacuuccagaugaguuuuucucacuauaugaaacaucagguucuuuaccucuugugaauuauuuaaaaagucaaaacccuaagaggcuugagauggaguuucgcucuugucacccaggcuggagugcaguggugugaucucagcucacugcagccucugccuccauguucaagugauuuuccugccucagccucccaaguagcugggauuacaggugcguaccaccacaccuggcuaauuuuuuguauuuuuuguagagaugggguuucaccuuguuggccuggcuggucuugaacuccugaccucaggugauccacccacuucaaucucccaaagugcugggauuacagacgugagccaccgugcccagcccuaagaggcuuuuuaaugaaaugggugaaaugaaguuacguuuccccuccaaauacaguucuguaacggaaagcccuuucuuugcccuauccuguggggaagauccacuugcugucagguuuauugcuucccaugugcacuucaggcguaauaugacaaagauugauaccaccaagaccuaucagucuguguuuaucaucagucacaauguuccuuccuuguauccaaagucauuuaguuugauucuguaaacuauuuaggcaaguuggaggauuuaguuuaucacaauuaucaauuuaccaguuuuguugugguuucauuaaacauuaugauuguaauuauaaaguuuaagccagaaaauaaguguuuucccccuuuauuucccaguuguauucuccagguucuuagaaaugaaacccgcaacaucccaguagugugaaggaaugauaacaucacuuccccuccaguuucuggcuucuugccauggugcccauaccuggcauauaagucuacagaauauuccucugcuaccuccagacucuauuauuaauuauuucuacuacuuucauuucaguuuuagaaauuaaaaacucacauacccaacuuuuuuuuuuuuucuuuuucuuuuuuuuugagucggagguaugcuuugucgaccaggcuggagugcaguggcgugaucucgguucacugcagccuccgucuccaggguucaagcuucagucugcugaguagcugggauuacaggcgcccaccaccaugcccaguuaauuuuuguaguuuuaguagagacggguuucacuaugauggccaggcaggucucgaacuccugaccucaagugauccuccugccuuggccucccacggugcugggauauaaucauaggugugagcugcugcgccuggccucacauaaccaacuuucuauuaguuuggauuuuucacccugauuugagaacaagacauagugccguaugaucucuguguuuauguuuuucauuuguugauuagcacauuccaguccacuguggggggaaaaaaccugugaacuuagaaacuaccuauggcucuuugaagagggaaugaggggaacagauuugauuguauuauauaaguuauuguuauuucuaguuaccauucugccucaaaaguagacaagaagaagaccuaaguugacacauaagugaaaaagaauaauaaugucgugacagguagaacaacugaaggaggaacuaaguucgaaagaggcucaaugggaggagcugaaaaagaaagcggcuggucuucaggcugaggucuuugccguaagauuuaccucuuugugugcaguggucccacagugggacccugcuagcucuauggcuucuggguggcuuacccuuucauucucuaugguuggcagcuuugcccauuacuagcacuaaccagccugcucugcucuuuaacugacuccuguucacuaguuugacccacaugucacuuugugugcagugagccuucacguguucuggaagccuuguaccugguacuuuauuguugcuuuugucacucuguggaugguauuucaaagccuguuucuuucucaacccuuuauuguugguuuauaugaauggcggccuucuuuucuuccuagguacaagaauauaugcaguuguucuaggccuaucaccuagaguuuauuugaauuugaaacucuugagcaaagugcuuuaccuuauguagacauuaucuuuaagucuccagugagugauuuugccacaaauguuacuuucuuuaggacagauguauagaaaguauuuaucuaguaaauugaaauuacuaagagacuuauuucagguaucuaaaucuaguucaauauucuaaugaacuuaaaauuucaauucagaacauaauaauaaaauaaauacaguuggcccuccauaucuguggauuugcaucuguguguuuaaccaacuguuuuuuauuuucaggguaaaaaaauggauguugugucugugcugaacauguacaggcuuuuuucccaugucauuauucccuaagcaauacaguaugacaacuauuuacauuguaaauauuuacauuguauuacguauuacaaguaaucuagagaugauuuaaacuauacuggaggaugugcauagguuauaugcaaauucuacaucauuuuauaucagggacuucagccuucauuaauuuugguauccaaggugugucuuggaaccagucccccauggacccauggauaccgagggauggcugaauaauaaaguagcuaacacuugcacacuuacuguaaacauuuuauaacgugcugaguuagacauauuaucaacuccaaauuauagacgaggaaacugagguaacagaauggugccuaggaaaacacagcuaguaagaggcaggauuugguuuuauacaggcagucuucuuccacauacugcuuacaaguucuuuacugaccuauacuaggcugugcacacauuugucaaagugucagcaaaaacugcuucugaaaauaauuguggcuaagacuggaauaaaaaaauacagcauuuaaaaaaccaaacuugggcuacuuuuguagauuugcuauuuaugguccacuuuauaguauauauuaaaaagggaaauauuuugguggaaagggucuaauuugguuuauggaaaccauauauuggcuagagggaagguugaucaauaacuuccuuuuuaaaauagcuacuauuaguaauuucugcauugagucagacaacaggcuaagcacauuucacgcuuuauuuuacugaauccauaaacaguacaguggcauucguauaauuucuccuuauuacuaauuaggaaacugauuaggaaaguaauuauucagggacacauagcuagcuuaguucugauaggugaaugucugcaaagccuugugcuccuaagcuuuguauuauauuugcuuccccuuuauaaugucuucccuucucagucuuuaaggaaaauuugugcuucuaaacucugcuuuucuuuucuuuuuuucuuuuucuuuauuuuuuugagacagagucuuucucugucgccaggcuggagugcaguggcgagaucucggcucacugcaaccucugacucccugguucaagcgauucuccugccucagccuccugaguagcugggauuacaggcaugcgccaccaugcccagcugauuuuuguauuuuuaguagagauggguuucacuauguuggccaggauggucuugaucuccugaccuugugauccacccgccucggccuuccaaagugcaaugauuacaggcgugagccacugcacccggccuaaacccugcuuuucauuuaaaauauuuucuuuucuuucuuagucuuuaaggucaauauagcauuauuugaagcuuacuuaauaaugcagaugaugacgaaacagauuuuuauauuuauuuuugaccacgugauuggagguagcuggaaauuugaauaaucuuagucauaguucuuuagcugagaaaaugguaacacuuugaacaucccccaaaauauucauucauacaacaaauguguuuuuguuacaaucaguguguuagggaauggaauaguguuaauggguuguuuuuauuggugaagggauaucauaaaagacuccacguuguuacagugugugcuaacucuuggguacauacuauuuugcaggaugaauauagccaccguuuaaaauuaucuuccacugauguuuuuaguauccucagguacuuuguauacaauaagcauacagaaauauuuguugaaugaaugaauaacuauaucucuaaaaagagauuuuaugcauaugagaaaaauacuuaaucuuuuuugaaacagaaggcuaaauuggaaauuuauuuuugguguuccucaaaggucuaauuuuaauuaaugugaaauuuauuucuucaugggaaauuguucucaaaagcuuuaucccuuauaccuaagauuauuacaauuacaauacuuuagauacauucaaguuuuugaaaaugaaaagauaacuuuuuguuucaucagugacaccgaaauuacugacuugucaaauguauacuuccaauaauuaguaucuuuuuuaguuccuuguuaggugguagacauaauuuaaaaggagauguaauuucuguuuacauggcuuccauuuaggguaaaaaacuauuuuuaaaauucuuagaaaacaggaauguaaagaagguguuagaaagaaaauacuuucaauguuaagagagaaauuaaucaauacacauaacaucaaauuauaggauuuuacaaaaccauguuauguauaacauuaaaaguggcuuuuuaagauaagaauuuuaugcaaacuuuugagaaugaaaaagauaacagugaaaaauuagcacaacagcagcagauuuugaauuuuaaauaguacuaggagguuucuaaaaccuuuuuuguuauaucugcacucauccugcauuugauccaucauguucugaagaggucucaccuagaaaaaugaaaaccauuucaucaguacagugguguucaguugcuuacugcugucucauagucaucuaauugaauuggaauuuccuuucccuccauucccuuucuaagagguuucaaagaauauuuagaagacacaauaaaugaaaacuggacauuucccuauugguugaauaaguuuagugguuuuuuuuggcucaggguuggggagauccaagguuaugucaugcaaaaagaugaauaugaccuaucacacaguucgugcugcauuuaguuucauauuuugugacucagaucugugaaagauacagauaagagguguuuguuuuauuucuuuuuuccuuaaaguguuuuacuucuuuucuagauuggccaggugaaacaggagcuguccagaaaggacacagaacuacucgcccugcagacaaagcuagaaacacucacaaaccaguucucagauaguaaacagcacauugaaguguugaaggaguccuugacugcuaaggagcagagggcugccauccugcagacugagguagaaacaauucugggauuuguggggaguugguuucuuggcaccuuuucauaagcguuaccugugcuguuuuuguuauguuuagaauugggaaauaugaguaauguuaugauuaauucuucagcagcgugaucagucacugugcuaaaauguaaccaucuuauuucaguuguucuuagaucuaacaaguuaaaacaggugcaguuuauguuuuuaauucuuuaaacuuuugccaagucuguacuucaaaguauacucugacaguauuaaaaauaaaaggauaauuguaaaagagaaaucauugauuuagaagcuucaguucaaccccuggugaauuuucuagucaugaaugacaaugagcuugguuacacuguguuuggaguacauuuaagugucuuuaaguugugauauuaugaauaacuguauauaggaaacuggaaucuguuaaaguucuagauagucuaauuuuaaaccacagauuauuagacaaugugucuucauauccuguuugaaaauaaaguuaguguuuuuagaauuuuuuuuuuuuuuuugagauggccucucgcucuguugcccaggcuggagugcaguggugugaucuuggcuuggcgugaucuuggcucaccacuaccuccgccuccuggauucaggugauucuccugccucagccuccugaguagcugggauuauaggcgcaugccaccaagccuggcuaauuuuuguauuuuuaguggagaugggguuucaccauauuggccaggcuggucucgaacuccugaccucuugauccgcccgccucugccucccaaagugcugggauuacaggcaugagccaccaugcccgggcaguguuuuucaaaaucuuggaagaugaucuagacuauuggcuaugacuucaguuagguauccaccaucuucagauagguauaugacuucagauagauauuuaguguauuugcuaaauaaucccagaucgauucuuaucuaucuuacuuucaaugaucgaagagaaagaguugaugauaccauguggauuuacugucuuaauauaaauauuuuuuaaagguugcagugaaauagauaauuuaagaauagauaaguaguuuugcuuuauagaagaaacauaaagcauaugauguagauuagcuuuuuuucuuuaaagaaaaauaagaacauaauuugguggaaaaaaggaaugaggaggaaaagaaagaauaaaaaccucauagucuuagaagacaagaaucuuccaauaaggaagaaugaagaaggaaccuaaacuguuucauguaauauuuuuaucuguacaauuuggggcuuuguuaaaaaugggagauuuuagcugacauguuugucauuuuucuuauaacuuacacuuuuucuauuuuaguuauguuucauuuuguuaugaugucagcuccauucuaccucacagagauauuuggguauaaaaucaugagaugcaguaguggcuaaggcuuuggcucuagagucauguuuacugaguuuggacuuccaucuuuaccacuuacuaugagucgcgugauccugggaacguauucaacuuccuuacacuucacuuuucacgucuguaaggugaagagaauaguagugcuuaacucauaaguuuguuguuagaauuaaacucguuuauuuacugccagugucuggcacauaguaaagucuuuguacauucgucauuguuaucauuuuauaauucuucuaauaaaaucaacuaaugcauauacuguugagauguuaagagaacauaguauuuagaugaucugcauuuucuuacuuuuauuaagcuaaacuuagguuuauucagggaauuauaaauaugaaaucaucuagauaauguuaccugcaaaguuauucauuuauagcuuuauuuuaaaaauuuuuugugggugcauaguagguauauauauuuaugggguaugugagauauuuaauacaggcauacaaugugaaaauaaauuauggagaauggcgguauccauccccucaaucguguauccuuugaguuacaaacaauccaauuacacucuuuaaguuauuuuaaaauguaauagcuuuauuaaucguuuuucacuucaguagcuugagugcaugcaauacagcaaaagggucagaagagggugccaguguucuagaggucagccgcacuuccaaguuugcuacuguaauagcuuuggauggagguggcagguguacaaaccagagaaccaagcaguugguuaaugauaaugcaaacauuuaaaagcuugucacagucuaauaaaugacuuuucccccuuggcaauccaugcuucucuuuguaccccccucaaauaauauucuuauuagccaggucucacccagaugggcuugugauugguuucuuguaccauagagaauagauuguauuuauugucauucaugaaugguuuuuaguuuuuagccauugcaggaguagcugagucucagugauuauuucuguaaguuacuagggccacugcgcaaauagaaccaucucaucauaaaagauaaaagaaugaaagcuaacuuucuuuggaauuugggaugauuuuaagaauguaauaugucuauuuauuagcauugcuuaaaaaauuacucugguggcacuugacaagagucaccuuuuccaauguaacuugccaguguuagagcccaguaaaaggcaguuuauaccagcucuuugaaaguuuucauguguuucuauaauuugcucuuaguugauuucaucuuuucugcagcuaucccagacuucgaucuaacacucggauuacuaaauuaaguauauaugaaaaaagaacauggagcauggaguuuuucuuucauuuuuauuuuuagagauagaaucuuacucugucacccaagcuggagugcaguggcaugauuauauuaauagcucauugcagccuggaacuccugggaucaaacgcuucuccugccucagccuccugaguagccaagacuuauaggcaugugccaccacaccuggcuaauuuuuaaaacuuuuugcagagacagagucucacuguguugccuaggcuggucugggacuccugagcucaagcaauccuccugccucugccucccaaagugcucggauuacaggcgugagccacugugccuagccuggaguuuaaaaaauuuuaaaaauccuuuaaggaaaacaguuacaugugaaaagaucuguuuguuuuuuguuuuguuuuguuuuuuuuguuuuuuuuuucccuauucaggguacauggacuaaggcccucugguguuauacaagguacaguauauauggaaucgcucccguuuuguaaccaucucuuuuaaucugaugacuuucacagagguggucuggauuuaguaauauagugguuaaaagcauggucuuuggugucagacauaggcuugaaaaccagcccucuaccuuuacuaguugugugaccuuagaggaguuacuuuacuucuucuuugugugugugugugugugugugugugugugugugugugugugugugugugugugugugagauggaguuuugcucuuguugcccaggcuggagugcaauagcacaaucuuggcucaccacaaccucgccuccuggguucaagcgauucuccugccacagccucccgaguagcugggauuauaggcaugugccaccacaccuggcuaauucuguauuuuuaguagagaugggguuucucccuguuggucaggcuggucucgaacucccgaccucaggugaucuguccuccucagccacccaaagugcugggauuacaggugugagccaccgcauccauucaggaguuacuuuacuucuuuaagccuccauuuccucaucuauaaaaugaggauaaugauaauaacaacuuccuaagguuuuuaugacuagguguuuaauucuguucucaucugaauauggagggacauuuuuuuauuaauuuauuauuuuuuuuuugcgacaagguuucacuuugucauucaggcuguagugcagugccuugaucauagcucacuguaaccuugaacuucugggcucaggugauccucccacuucagcaucuugaguagcuaggacuacagaugcaggccaccucuccuggcugauuuuuuaauuuguauuuuuuguagagacagggucucacuauguugcccaggauguucuugaacuccuggcuucaagcaguccuccugccucagcccccaaagcacaagaauuauaggcaggagccacuguguccagccauggagggaaauuuaaauucaguggguuaaaaaauuucgaaacaccuuacaguuuauagcacuuugauuugauuugaucuuuauuguuuuauuugcucuucauaguaauggcauggguuagacaagauaauuauuguuguuuugcuuuuauaauugagaauuuugugaacugcuuauuagcauaccacuuuugacuggcacuugaggcuacucucacuaguaacacugggacuuuugauauaucauuuacaguauucucaagaauuaaaguucuuuucuuguuccaaaauugugaugcuauacuagggaccuaccauuaaauguauuuucaggaugaauucucaaugugcagagcagagcugauuguaucaauaagccaaaauaauguacaccuuacugcuucaaaguaguacagguuuuuccccuucuccaggaaauuguguuuuggaauucuguuuauuauagguaaggaauauaaucuauaucuuaguaauaguaagaggaagugguucuuuuuuucggaggugcucaggagaucagcaucuagcacaaggugaggaccugcccuugcucuaggauguuuuggcacuaggcacuagagcuaggaugcuguuguuugacgugcacccucugcuugcagucccagcccaguucugacuucuucagcauacuaagaguuaguaauacauucuuagaacuagagggcauuuuuagagaucauccagucuuuccguaauuuaaagaauauguaugauaauaucuaaccugagucuuguaccauggaggguuuguauacuuucauuuucccaguuaauucuuagaguaaccuucuaagaaauaagaauuguuguaacauuuuacagauggggaguuaaaacuuagagagacugagguuacaugaccuagugcccgaucgauucaaacccgcaaacuugcguucuugaucauaacgcugcaauuccucccugugcagagagaauauagugacaugcugaaggccuauacaacuacuugguauuaguuuugggacuggaauucaucauuucugacuucgcuaauuaugaugugcauagacgaccaugacucuuguuugauugguagguugaggacuagccacaaagaaagauggggagaagaagaaacaauucauguugguagagaggagaaaaggauuuagguugauggaauuacauagccucagaaagagauaggcaucuuuugugacgagauugugaaagaagagaaagauguauugauugaucucuucauucaacacgguuuugggaguaccugcugagaacccuucugagcacuggggauacaguggcaaaugaaacaaaggcugaugaucucuaucucuaucucuaucucuaucucuaucucuaucuaucucuaucucuaucucuaucucuaucugugucucuaucucuaucucuaucucuaucucuaucuaucucuaucucuaucucuaucuaucucuaucucuaucuaucucuaucucuaucucuaucucuaucucuaucucuaucugugucucuaucucuaucuaucucuaucucuaucucuaucucuaucucuaucucuaucugugucucuaucucuaucucuaucucuaucucuaucucuaucucuaucugugucucuaucuaucucuaucucuaucucuaucucuaucucuaucugugucucuaucucuaucucuaucucuaucucuaucuaucucuaucucuaucucuaucuaucucuaucucuaucuaucuaucucuaucucuaucucuauaucucuaucucuaucugugucucuaucucuaucucuaucucuaucucuaucugugucucuaucucuaucucuaucucuaucucuaucucuaucugugucucuaucucuaucucuaucucuaucucuaucugugucucuaucucuaucucuaucucuaucucuaucugugucucuaucucuaucucuaucucuaucucuaucugugucucuaucucuaucucuaucucuaucugugucucuaucucuaucucuaucucuaucucuaucugugucucuaucucuaucucuaucucuaucugugucucuaucucuaucucuaucucuaucucuaucugugucucuaucucuaucucuaucucuaucugugucucuaucucuaucucuaucucuaucucuaucugugucucuaucucuaucucuaucucuaucucuaucucuaucugugucucuaucucuaucucuaucucuaucugugucucuaucucuaucucuaucugugucucuaucucuaucucuaucucuaucugugucucuaucucuaucucuaucugugucucuaucucuaucucuaucucuaucucuaucucuaucucugccuauugauauaucuguauauaucuaucuaaaucucugaaacagcugcucagaguaaaagaggacugggugcuaugaaaagagauagggcuuagaaucuuuuucagaugaguguguuucucucacuguuguauguggguuguugaguuaugggguagggguugggggugggugcugcagggugacacugguaugauauucaagucugcuugugaagguagacuggcuuuggagugcuccuuccccuuucagcauccucucuauaccuggggcagagcauuuguucuagcagcgguacagaugaucaugccagaggcguucugaucugggaggcuugcuuccugccacaaccacucccccagcuccagcuggugagauggcacugcuuacgguggugaugggguaaugucuuguuugugggaagauguagauacugauaagcuuaagaaguuacauuaaguuacuuaagaagauaaugauaagcuuaagaaaauacaguuacuuaagaagauaaugauaagcuuaagaaaauacaagcauaaguauggcucuuaauacgcuagaaaaaucaaaauggaauguauaaguuucaaaccgucagaguaaaacccaguuuacccaguggagaauagagaagaauggggaggggagagaaagaaaugugauagcauguggacaccaugaaaaagaaggcugagauaaguacaaaucaugggaaagucaauaaauacaaauaaguacuuagaucaaaaugaaaauauaaaucucaguugggcuaaaaagauacagaaagauacugucaacaagaguuaaacagacaaaaaguaacagcaaaguuaaaaauacagagauagaaaaaaauuuaaaaauaaaaguuauaucaggaaaauaggccuucccaaauaugauuuauuuuaauauugauuaaauuaucuuuuaaggcacacagagcaauguuauaugcugauaaaagaaacaguagaucaagaaaauauaaccgugccgaucgaugcaccuaacagcauggcauuuaaauacauaaagcgggccgggcgcggcagcccacgccuguaaucccagcacuuugggaggcugaggcggguggaucaccugaguucaggaguucgagaccagccuggccaacauagugaaacccugucucuacugaaaauacaaaaaugagcugggcgugguggcacgcaccuguaguuuucagcuacuugagagccugaggcaggagaauugcuugaacccaggagguagagguugcagugagcuaagaucauaccccugggugacagcgcaagauucugucuauaaguaaacaaauaaauguauauauagcagcaaugaggugaaacagauaaaucaacaauuguaguuggucauuuggaugugcuccugucagaauuugaucaaauaaagaagcaucaacauaaaguuuuaauaacauuaacaagcucaaguucauagauguguauauagaauuuuguccuaacauagagaauaaacaauauuuucaagaacuuacugaacagucguaaaaacuaaccauguacugggucauaaaggaaacuuuaaaauucccaagagucaaagucacaugacuuugcacuccuaaugcagcaaaauuagaaaucaggaguaaagauaguaaaguaguaauaaagguaguaaagaacagcagcagaaaaccaaaauaaguauauaaucuugaaacauacuaccaaaaugaccuguggguuaaaggaaaaauauaaacauuuaaaaaugaguggcagugaaagcucucuauauaaaaauuuguggaacauaauuagaaaaaaaucugugggguguaacuaaagcaguauuuagagggaaauagcuaguuuuuaacauauuuaucagaaaauaagaaagaaaagcaaguaaucuagguguucaaaucaggaaacuuagaaaaaacaguuaauccaaaaacaauaaagaauaauaaauauaaggugagaaauuaauagagaauaaaacaacaccaagagguaguuauuugaaaaagguuaauaggacaggaacagcucuuacagaugauaaaggagaaguaacuacuaguacuacagaguuuaaaaauaauauaagacaacucuaaacaauuauauucgaauaagcuugaaaaacaagaagaaauaaguuucuggaaaaauauaaaaugacagaagaaguucaagagauaagagaaaacaugaacaacagucguuauagaaauugaaaugguaaucaaccucaucccuuuuucccucccaaauccuaaggcccagauggcuuucgaggagaaaauauuugauauuuucuuucuuuuuuuuuuuggagacagauucuugcucuuucgccuaggccggagugcaguggcacaaucuuggcucacugcaaccuccaccucucaaguucaugugauucuccugucccagccucccaacuagcugggacuacaggugcaugccaccacgcccagcuaauuuuuuguauuuuuaguagaaaugggguuucacuguguuagccaggcuggucucaaucuccugaccuuaugaucugcccaccuuggccucccagagugcugggauuacaggcaugagccaccgcgcccagcccaauauuugauauuuucuaucaaauauuuaaaaauagucauuuucauccucaaguuguuccccacuccccaagaaaaaacaagaaagccuaauacucuacccaaggauaugaggaaaaauaaauaaauuaaaagauacuccaugucaauagaugguauaauuuaauccugcagggauaucaguuuuccugaaguuaauguauauauucuucugcauuuccaauuaaaacaccaagcagucggccgggcacgguggcucacgccuauaaucccagcacuuugggaggcugaggcagguggauuaucugaggucaggaguucaagaccagccuggccaacauagugaaaacccgucucuacuaaaaauacaaaauuagcugggcacgguggugcgcaccuguaaucucagcuacucggaaggcugaggcaggagaaucacuugaacccaggaggcggagguuacagugagcugagaucgcaccacugcacuccagucugggugacaagagcgagacuccgucucaaaacaaaacaaacaaaaaaaacaaacaguauuuuuuaggaauucauuuuauuuuaaauuuuguaaggaggaguuacaaaaagacaaauacuacauaugauuccacuugucauaccuagagucaaauucauggagacagaaaguagaaaggugguuaccagcggcugggaaggagagaauguggaguuuaauggguauagaauuuuaguuuuguaaggugaaaugaguucuggagauugguugcacaacagugugaauauacucaacacuacugaacuguagacuuaaaaugauugagauagcaaauuuuaugucuguauaucuuaccucuauuaaauuuuuaaaaauguauauggaugaauaaagcuauucuaacauuaaacaaaaagagaagagaagaugggagaacccugcccugugagacaugaaaauacagagucauaaaccaaacgaaaccaaacagugcaccucagaacagugcgguaacuagcacaggaaggagcagauaugaaaagaacagggagugugaaaucagaaacauuuauguggagagauagucagucauaaacuagugcaaaauuaagcaaguaugagaaaacugacauaccauauggagaauaaaguuggccaccuacuucaugcuagaugaaacagugaacucuagauggauuaaagaccucaguguuaaagagaaacuauaaagcuaaucaauaaaaauguuuaguaggaauauauuggguaagauaacuuaaaugucuccaucaaauuuaagcauuucuguucaagaaagaaaaccauuggcaaagcuaacagaugagauugggagaagaguuuuuuuagagccucuuaaaauaguaaggauucagauaaagaauaaaaaagagaugcuugaggcuaggugugguggcucacgccuguaaucccagcccuuugggaggcugaagcgggcggaucaugaggucaagagaucgacaccauucuggccaacauggugaaaccccgucucuacuaaaaauaaaaaaauuagcugggcgugguggcacgugccuguagucccagcuacucaggaggcugaggcaggagaauugcuugaacccaggaggcggagguugcagugagcugagaucaugccacugcacuccagccuggcgacagagugagauucugucucaaaaaaaaaaaaaaaaaaaaaaaaaaaccucaaaaaucaauagagacuauagggagagggaaggauuugaauagacaauuaacagauaaagaaaccuaagugguuaacaacuaugccaugauaucaucaaucuuacuaguaaauaaagaaaugcaaauuucaaagaugaugaaauacuauauuuuguucaucaaauugauaaaaauuagaaugugagauaacauucagugcuugugaggauuugggcaaacaguaacacaaaugacguaggugguuucaguaaucccauuccuugguauauuucccagaaaaacuuuccugcugguccacaaaaggacauguauaaggauguucaccacaguauuauuugugggaagaaggaauuaaaagcagcauaaguguuuauuacuaggggguuggauaaauaaaguauuguggauauguaccauggaauacuguacaaaagucaaaagcagugaugcagaagcagggauagauauaaguacuaucuauguuuacuuuuuuuuuuuuuugagacggaguuuuacucuuguugcccaggcuugagugcgauggcgcagucucggcucacuuuacaguacuuguuacaaguaguguguuguuuaaaaaacagcauccaucccguuuuuuaaaaguaaaaaacagguugagguauguaacauuaauauaaauugaaaacauguaugaauauaaaaaucacccucuguguuucuaagauacauauucaggaacauauuaaaacauauuagaauagcugcauauugaaggagggauggguauuggacauaaauggaaaaagaggaaaacaaaacaagaguagaacuucacaugaaucaacgauaacacuuggacagcggauagaccuugguccuaagugagauagggaucugaagccaagaccuccgcauaaaucuaguacuauccugagaaaggucggacgagaaaaaaauuccuccuaccaguauuaauggcaauaugagagacugacuuauucuccuuggcuuugauuuuguggagaaaggucucucaucaugcagguuugaguuugaauagacauaacugcucugaagggacauucucucaaccuaguacguguagauucccacagguaaaagcauugcuuagaaugaauuuacaauuccacauuaguuaaucacuuguggauuguaaucuccccugaaccaauaaugggaguaagaacaaauggagugaucagacccuuaggaacgcuggauaauagaacgagaguauaaacuaaaugauuaaaggacggacugagaggcaugggcacacucuccagaauggaugaucagauaugacuuguuaggauguuguuucaugacuauugagagcaaaagcugaaguagcacuagguuuuuaauuuuuauuuucuuaauuuuuaauuuuuauagagacagaaccuccuuauguugcccaugcuggucuucagcuccuggacucaagugauccucccaacucagccucucguaguguuaggauuacaggcgugaggcaccgugcccagcuagcacuagcuguuuaguacaguguguuugaaucuugggucugccacuugcuguaugaguguauacuuuuuugccucaguuuucucaucugugagaagaauaauagccuuaccccauaauguugugagaauuaaauguuaauuaucuauguaguaacacucaguaaauauuagcuauuauaauuaauaaaugcauaaagaaaugauuuaaaacgcgaggaaaaaaacaaagguacuguaaauaaaaccaaccggguuauaaaagaucaaaacaggauuuuagacaugaaauauauaguaacuaaaauggaaaacucaguauauuaguguaguugcagauuauagagagcugcaggaacaguuagugaauuggaacauagaucugaugagcuauuacccagcaagcaauaggaaagauaggaagauagaaauuauuaaaaagaacucuauguaaauugagcccaacuuauauguaggaguuucaggaguggauaaagagaaugggaggcaaucuuaagagagaauugcugagaauuuuucugauuuugaugauaggaauggauucuucaauucaggaacaaauuauucuugagcaggaaaauaucuacaccuacauacagcauaguggaaccauagauaaacuaaucuuaaauacugccagguagacugggcaugauggcucacgccuguaauccuaguggaggucaagguaggaggaucacuugagaccaggaguuugagaccagccggggcaacagugagacugcgucuccacaaacaacaacaacaacaaaacuaacaacaacaacaaaaaacuaaccaggcaacaacaagaaaaaaaacuuaccaggugugguguguacauguaguccuggcuacucagaagucgaaggcgagaguaucccuugaccuuagcuaagggcuucagggcaguagugagcuaugauugugccacugcacuccagcuugggcaauagagcgagacccugucucuaaaaaagaaaacaaccugcuggggagaaaaaauacauuacguguaaaggauuaacaauuaggccaacaucagacuuuucaguugccacaacaguagugagaauaugguagcguaaaaucuucaaaguuuagugaaaaacauuggcaacucagaauucuguaccaagcugaacucucaucauucuucaguaaagauagaagaaagacuuuuacuuucagauuaauacaaaugagaguuuacuacccaggaucccuauggaaacaacuguuaaaagauguauguuagaaagaagaaaagaaugagaugcaagaaaaaaaaacaggagaugaaaaggcauuaauguaacaggagaaacuaaucuaauaucaauauaauaguauggcauagaccuuacaguaauagugccguuacagccaaaacucgcaaaucaauugagguuuauucaguaaaggugaggaauuucagagaaagaucacaaaaggaagagcuugucuguugcuucuccuuguugguauaauguugcuaaauaauacagcagguggaauucugcaucuagauuguuucuaucuucccugucaagagcauaggaaugaaauaaauggaauauauauuucuacaguggcaaaaugaaaaugaagcucaaggugugugaagacagaaauuguaagaaagcguaaagaccucugcaauggccaggcagagugacucaugccuauaauuccagcacuuuggaaggccgagacaggaggaucacuugagcccaggaggguuuucacauagagaaagcuauaaggaauucucccuuucugugaggguuuucacauagaguuauaaggcuuuguugaucuuaguucugauaccagaacgaggaaguguuauguuauguguuggcuuaaggggucaaaguagguuggcugacugccaugcuuuaucagguuugcagaggccaagaguuccuuggggcugcauaccugaauagcacuuauugcaguauacuuuguguagccaauacugugucuucuuugucugcuaugaguuuucaagggaaaaugagugaagguaucaacauuaauuuuucagaauauaaauuugcgaaacguauagucuuuuuuuuuuuuuaaacuauguacuguggaaugacucauuucuaccuugacuauuuugauaucugagcuuuucaucuuuuugucaaguaugggguaucaaacagagcacaauugcaguuuguugaaacaguacucuaaaacaguuuacuuccguguggucuguaaugcugucagucccauggcucagugcccuucacguagcauucagccucccaucuaggugggaacaaugggaaaugcagucauaggauauaucauuuagaguggacuugagcaaguuacuuaauuaguuugggccuugauuuuucucagcuuuaaaguugggaguuuaaauucaguuauuuaacuguuaaaaaaauuuaugaaguacuguggaauacaggaaaauuguagaaaauauaauagauaccagucagauuuaacauacauuaaaauaaagaauucuuaaaaaugucucauucuaaacuaaucaauggaagaugugguuuaaauaaaaguuauuagaauuuuagguuuuuagaacuaguuggggccaggaauaaagauuuggaagcuguggaggugguggugaaagccuuagaauuggauuaguuucuccagaggagguuccaugcagugagaugugaggaggaggaaaugacagaggauggagaacacugaaaaggugugaucacagaguuagaaaggaaaagugucauguuggcaaagccaagaggggaaugauaggaaacaagccacauauccaugcaacuaauuauuacuacuaauuugccuuuagauagaucuguuuauugauuuaaaacaaaggaaaguuaagguacguugagagaauugguuuuuuuuaauugaggcagagucucucucugucacccaggcuggagugcaguggcacaaucuuggcacacugcaagcuccaccucccggguucgcaccauucuccugccuuagccucccgaguagcugggauuacaggugcccaccaccacacccagcuaauuuuuuuguauuuuuuuuaguagagaugggguuucacccuguuagccaggauggucucgaucuccugaccuugugauccgcccccuuggccucccaaagugcugggauuacaggugugagccaccgcgcccagccagaauuaauuguuuuuugaucagaagugagaggccaaaacaguaggguagccauuuucuguucacuuccauugguagagaaaaccuuguagacaaaagccuucuguuuuuauugaaguuggcaugaccuguuugcuacagacaaacuuggcaaguugggcgaaugcuguuccugcagcucugcuggugugaauaaacaagguuuuauuccuccugccaggacuggugucagggcaaugacuguguguguccugcuggucuuugagggguuuuccugaauauguuuuuugugguuuguaaaauauggaccucacgcaaaauuauacuacaaauuuaguucacuccaaaccaaaagaucaguguagaauucagagcaauuaaucugguaguagcaaagugguuuuuguggugguuuuuaucucaaaucuccagacuagcauauuugaauucuguacugcacaaaaaagcagacuaagacaaaguguacacaggugaugugaauugaauacuuagucaauaaaagaucauuuaauaauuagggguauggacgggcaguuucuguuccuaauauuuauuauaugaaauauuuuuuguaucaaagccuguguuuccagccacacuuauacuaaagguuuguauguuuauaacaagaguucuuauucuuucccuuuucagucaccuuuuucggucaccaauucauacuugacacucucucagugccgugcggguauuuauguccggucagcauugacauguuuccaggucacuuaacugaaucauggauccaauauaaagugcagcuugggcaucugggugccuuucauaaagaggcagcaauguggggucucacaaauguuguccugugugaugguggugccaucagaaugaaaaacacuuagaagugaugagggauguguuccuacauacagauccaugucccgcagauggaaaggcuuuuuucugaaauuaaugcuuagaagaacugagagacaagaaaauuaggcaguugagacuucagguuugaaugccuaagcuuuuugccuuuguaguaagaauuuguguauuuaggacauacaggauaaaauaauguggguuuuuuuuuuuuuaauugagacggaguuucgcucuugucacccaggcuggagugcaguggcacaaucuuggcucacugcaaccuccgccuccuagguucaagugauucuccugcuucagccucccgaguagcugggauuacaggcaugcaccaccacgccugacuaauuuuucuguauuuuuaguagagacgggauuucacauuguuggccaggcuggucuugaacuccucaccucaagugauccacccaccucggccucccaaagugcugggauuacaggugugagccaccacaccuggccgguuuuuuuuuguuuguuuguuuuuaaugaggugcuuuguuuuuugcuuuugguuagagguagugguagauuaauauauaguauacaaaauacagauuagcauguaguaauuagaugcaaaugauuaugugauuuauuuauuuuucaaauuucugacauguauacuuuucuaaggcuuugaccuccuuaacuguguagaagggucaccagauucaguaagcaccuucgccaugacugaugccuuguaauggguucagcuaauaggaaccaaaccugacacugucaaauaggauuaguagcaacacuggcuggcuugagcugugccugaaugccaguggauaagggucaguggguucuuuggcaucuugagcagccugguuguugaauuucauauuccacuaaggucuuuacucugugguugcaauccuuuucuuuuaacugaaucaauauucagucuguucugacacuucccuuuuggaccuuuuuuuguuugcauggcggaguguugugauuuuuacucucuuggcaaauuucagguauauaauacagcauuauuaauuacacgcugcuguauauuagauccccagaacuuacucguuuuauaacugaggguuuguacccuuugaucagcaucuccccaugccucucccuguuccuauccccagccccugguaaccaccauucucuucucuguuucuuugaguucaacuuuauucagauuccauauguaagugagaucauaccguaaucuguguuauuucugaucucaguuuucacugaaugcuuuuuguccuuguauuaugaguuguguuuuucugcuucuuugcuugucuggugaguuuggguuggaugccaagcauugugaguuuuaccuuguugggugcuaggcauuuuguauuccuguaaauauuacugaacuuuguuuugugaugcugguaaaauacuuggaaauaguuucauucuuuugggucuuucauuuaagcuuuguuagaugguaccaaaauugcauuuauucuaaagcuagucuccucgugcacccccucccccuugauuauauuaaagagauuugcaaaaauuuaaaacaauuauauucuucuuacuauuuuagggggaaaauacagguuuuugaaauuaaaauguuacuuugauuaacauaauggguuuauuguuauuuaaaagcuguucuaauuuuuuuuuuuuuuuuaaagauacagugucuugcuuugcuaccaaggcuggaguacaguggugugaucauagcucacugcagccuugaacuccugggcucaagcgaucuuccugcuucagcccccugaguagcuagaacuauaggugugugccaccacacuuggcuaauuaaaaaaaauuuuuuuuuguagagauagugucuugcuauguugcccagggaggucuugaacuuuuggccucaagugauccuucugccucagccucccaaaguguugggauuacaggugugagccaccgcaccuggcccuaauuuugaguguagcaaauauugauagauauaacucacauaaauaaaaacucaauaauuggggguccucaguaacuuuuuuuuuuuuuuuuugagacauaguuuugcucuuguugcccaggcuggagugcaauggcgugaucucagcucacugcaaccuccgccucccggguucaagugauucuccugccucagccuccugaguagcugggauuacaggcaugcgcuaccaugccugacuaauuuuguauuuuuaguagagacaagguuucucccuguuggucaggcuggucuugaacucccgaccucuggugaucuggccaccuuggucuuccaaagugcugggauuacaggccuaagccacugugcccugccgguccucaguaaucuuuaagagugcugaggaguccugagaccaaagggucugagaaugguaauggaagggaacauucagaacauuugggugccugaggcuucucuagagcaggguacuugcccaaagggggcuugggauuuugcuuccuguuccaaccuaaccuuuguguugcccugauaucuuauuuucuguuacuggaggcaucuuccaaacucaguucuccaggucacggaaacaagucaaugaaaaagcaggacaggugucacuucuguuauaagcuuaccacuucgggcuucuagucucuguuuucaacauuuuagugauguugucucuuucucuauguguacacuucuguauaugcuuauaugcaugcugaucuaugaauuugaaaagaaguuuguugugcuuuaccuagcauuucuggguguuuuguagcaguagguguggugggcugaauaguauccuccauaaaucugugucuaccugguacucagaaugugaccauauuuggaaauagggucuuugaagcuauuauuaguuaagguuugagauaagaucaugauggagugggcucuaaaugcaaugacuggaguccuuauagaagagagaggacauauaaagauacaaagaagagggugaagugaagguggaaacagagauuggagugaugcaucgucuacaagacgaggagccaggagacagcaagaggcaaggaaggcucuuucucagagcccucauagagagcaagguccugcuacaccuuuaugucagacuucuaaacuccagaacuuggagagaggaaaauaaaucuauuguuuaaagccaccugguuugugguccuuuguuagggcaguccuaagagaguaaaacaguuagguuuuucuggauuucuagcucauauucaggucauuaucagguauuuucagguuuuuaucaaagcauuucagguauuaucagggagacuguuaagauauaaugucaugucagaaauaacacaccaaaaauaagguucuuauucucucucgaagcuaaaacccauuuagucuucuucaucagaaaccugggaacccauguuugacuuaucucucuuuuaucccuuauauacaaccaauaaaagucaagcuccuagacaugacacugaugcuuuccguggcuaaggccuugucuucugcugcaccucacauaacuuaccaccuauucuaugcuuuagcaauucucuauucauagcucucugagaaguuaacauccuuucuaaucuucauuauuugugguaucucugcucaaagguucuuccauuaucuuccucaccagccaucuucugcucaucuuuacaugcuuugagguaucuccaagcaaucugagugcuucuuuucuguacuuuuagaaaauauucucuacacuucuguugcagcacuuucuauaauauauuuaugugaucuauuuuggcaacauucuucuccauuagguuguaacuucagcagaagacaggaaauaucuuaguuaucuuugugucuccaguaaccagcccaguguaacuuuuccgauauacaaauaccaugacuuucuccugcuuaaaaaucuucacugacuuccauuugcaaguaggauaaaauuuaagccucuuauuuuagcaggcaaggauuuaugaucuacuaucuuuucaggcuugucucuuguccuucuucuguuacuuuaugccaagcaauaccaaaugaauuuacaaguauaucaugcuguuucauguuucuagauuuuaaaguauucuauuuccucuuccuagauauccaugcauuucucucugccuucccuuuuguaucuagugauguucucuucauuauucaaaaaccaauucagacauuuauucuuuuagaaaacuuuucugacucuucugacauacuguucauaggagagauuucccugccugccuguguucaccuguguuccuuuaugcugguauucuuugguaugugauaacagauuauaaucuuugaugucauaucuagucuuugaguuccaguccuucuacucaccaguucuuuuuucuuuuucuuuuucuuucuuuuuuucuuuucuuuuuuuuuuuuuuuuugagacagagucucacucuguuggcaggcuggagugcaguggcaccaucucggcucgcugcaaccuccgaaucccugguucaagcaauucuccugccucagccucccgaguagcugggauuauaggcaagcgccaccacgccaagcuaauuuuuguauuuuuaguagagaugggguuucaccauguuggccaggauggucucuaucuccugaccuugugaucugcccauccuggccucccaaagugcugggauuacaggugugagccaccacgcccggccauaguccuucuacuuaccaguucuuuaauauaauaugagguaaacuauuuaacuacgcugagucacaguuuuaucaucuuuuaaaauagggagauaauguuagcuacuuuacagugcuaaauguuuuaagugagauaggauuacugaggauaaaagggugggcaaaauaggggccaggagcgguggcucacgccuguaaccccagcacuuugggaggccgaggcaggcagaucaccugaggucaggaguucgagaccagccuggccaacauggcgaaaccccgucucuacuaaaaauacaaaaaaaauuagcugggcaugguggcaugcaccuguaaucccagcuaccagggaggcugaggcaggagaaucucuugaacccaggaggcagagguuacagugagccgagauugcgccacugcacuccagccugggcgacagagcaagacugucucaaaaaaacaaaaaauauauauaauuuauaauauguuacauauuauguauauuauuuauauguauuauauaauacauauuauauaauauauaauauauuuauauaaauuagauauaauauuaucauauauaguauauauaauauauauuaauauauaaauguguaaauguauauauuauauaauuauauauaaaauacaauuauauauaauuauauauuguuuuauauuauauauaauauauaauccauauuauaauauaauuauauuuaauacauauuauauauaauauaauuauauuuauuuacauaauauauauaauuguauauaauauauaucauauauaauuauauaugauauauauuauauaauauauaucauguauaauauaauuacaauauaugauauauauuauauaauauaauuacaauauaugauauauauuauauaauauauguuguauauaauacauauguuguauauaauauauguuauauaauauauaauauauguuauauguaaguuguauauaauauguaauacauaauauauguuauauauaauauauauagaaauauugguaaguucuguauaaugauguuauuaaguucuauaaguagaaaaaaaaguguuaaauucuauuacaaaauacccugagaaaggaugagggagauaguauuugucuguuggggguuuggaaaauauuuauuaaaaugguggcauaggaaaaggaccuugaaagauguguucaguaggcagauuuuuuuuaagugguagaggguuaaggauauuacaggcauaggacaaaaugugaacaaugacaagaaagaaggaaaguauaguauuuauucagagaauggcaguacugcugcaauggagagccacuggaaguggggcaaggaggcauauggcaaagguuaggcagugcugguacauugggaccgucugaccauggaggaccuugaauucccugcugugauccuguggguuagggugguguuagagaauuagugguuaagaguguggggucuggaggcaagaccacguaaucuuagaucucugcuuauuuguagcugugagaucuugggccugcuaucuccucugaggcccaguuucccacauugccgugagagagugugaaguuuccugcagggagaaugcaagggaagaaaauacgauaccugagaacagaagugugaggauuuuaauguauauacaguaguccucccuuaacugcuuuuuugcuuuccuugguuucuguuaccuguggucaccuguggucugaaaauauuaaauggaaaauuccagaaaagaacagcucccagauuuuaaguuaagcuuuuuuuuagguagugugaugaaaucuuaugccauucugcuguauuccacccuggaggugaaucuuccuucuguccaguguauccacguacccacacuaccugccccuuagucacuaguagcugucucguuauuagaucgacuguugcagugucagugcuuguguucacauaacccuuauuuuauuuaauaauggccccaaagcauaagaguaaugaugcuggcauauuguuacaauuguucuauuuuguuacuaguuauuguuguuaaucucuuacugugacuaauuuguaaauuaaauguuauuauguaauagguauguauauagaggaaaagcauaguguguauaggguuugauacugucugugguuucaggcauccacugggggucuuggauuauauucuucgacgacaaggggggauuacuguauauggugacaaaaauauacaugaacacaugcaggaaggcccagaaaacuguuuaauucagaaauaaaguaguaaaguaaaacagguaugauuuuuuuuuuuuugaggaguugauaugagacugaaaucauugcuuaagcugggaggaaaacaaaacaaaacaaaaaccagaauagagacgaaugauaaaaaaagaaggacgauagaucagaggucaugcuauggacaaaggguagauuuaguagguguaggaggaagaaaagaacaguauuugugauucagaaaaaaaaauuuagaguuugaaaguucucagguagaucuuuccagauuauaauuagguuaacuauguauauuaaaguagaauagagguaaauuacagaugaaagacucuugaaggagcaugguagaacuuguggugaauaaugacaaaugggagcucaaaugauuauucccuacuuucuggcuuggugagacuggucgcguagaaguaguugguagaaauguaguuuagcagagugaacuaugguuuaucuacauguuuuuccuuuccaguaugguccaacauaauuuguaaguacuuacaguaguagcaaguacuuauuauagcagucuccaaugagacuagucuuguuaagaaauuuuccauacuacuuaacugagcaggaaguaccaccgcacacacaguauugcuucucagauaccuuguaguuuagauacacuacacauuggauaucccuuaccuaaaaugcacgggacuagaaguguuucagaguuugaguuugggaauauuugcauuauacuuaugcuuacugguugagcauuccuaauccgaaaauccaaaauguuccauugagcauuuccuuuaagugucgugucagugcucaaaaaguucuggaguuuggagcauuuuggauuuuggauuuucagauuuggggauggucaaccuguauuagaucuuccugagugcuuugauguacccuaaaugugaaacauuauucauauuuucuuugugguuuaauccacguucagauaggaaaaauaagacaaguuaaagaugagagaccauagaaccauacuugauuucuuagauuugcacuguucagucugguagccaccagccauuuguggcuauuaaguacuugcaauguggcuagcccaaauugagaugugauauaaaggugaaauauacauuagauaucaaagaguuaguaugaaaaaauauaaaauagcucauuaauaguuuuuuauauggguuauauguuugaaaugacaaugaaaaaagaauguaaaaaagcuuauuaacaauuuucggcuugaaaauaugacuuauuauuuuccuguugaacagcacugaaucuauguguggggugcuaaaagcuuaauaaaauuuucucugaauggauuuuaaaauaaguaucauuagauuucuuguuauuuuaaaguuauaucuaaugaaaggcauuaaacuucagggauaaagguaacuaguuaccaaacuuuuuagcugguuagucuugcugucuaaaaaguagaccuuugcuuuugcuuuguauggauaucuaagugcauuaugggguuguuuuucauaaaagccucauagccuaugacuagacuguauuaucugauauagccaguguuaugcuuggugaugcuuuuuuucccuuuuccucauuuuagauuuucuaaagcaauguagcuucacuuggaaacuuguuagaaauacugauuuugaaccccaacccuguugaaucagagacuaagggcuugauuuagcccuccagaugauucugaugugcaugaaguuugagaaacauaguuguagagauuccauuguguaacggugagcacacuggacucugaauccagagaaacauagauguagauaauacuacuuuuauagaauaacaaaacucaaccucuuuauaaccuuuauaacauaucuauuugaaaggaauuacauucuuuucuuuuuaauucaucacuuguaaaacuccuacauucuuagguggaugcucuccgauugcguuuggaagagaaggaaaccauguugaauaaaaagacaaaacaaauucaggauauggcugaagagaaggggacacaagcuggagagauacaugaccucaaggacauguuggaugugaaggagcggaagguuaauguucuucagaagaagguaagguacagguguuucgaguucaguggcccauuccucauacaucuucacuccuaccacuaaguuauuucuaaaugcugucagaguuucuugcucauuuuucaguuuauauuuuugugauuaguaauuuggaacucuuguugcgguagguagauuguuaagacugcucuauauauucaguuuuuaaaaauuuaaacacuguuaguaucuuccaguagugcuuuucaugcuguuucucaaaagugccuuguaaauugccaaaguguuugaacugacauucuuuugccccuucugucuuuuauugaaacuguaccaaauugguuuaguacauggacuugggaugguacaacuucauuuauguguuuaauaagaugacaauuuuaagccgagaccaguagcauccagaccaacacauaauucauauaugagcaaaaaaaaugugugugugucuauuucaauacaaaucuuacuguuccuuagugcuuguuauuuccccuuuuuucaguuaauauauuuugguauucuuuccaaggguuucuucauuguuguuacuaacagcauuguauggauauacuauagcaaaauuucuacugauggacauuaauuuugcuaaaaauuucuuccuuuacauaaaaugauuaauaguaaaaaauguuguacauguuuaguuuauacauaugucaagucaaguauauuucuaggauaaaguccuuaaaguugaacugcugagugaaaggaugugcauuuauaauuuugauggauuuugccaaguaaccuuaaagagacuguaccaaguuucauuucuacuauccgugaugaaaguguuauauucccacauacuugucugcagaguguguuaauaggcuuuuucacuuuuuggcaaucugauaggugagcaaacaaugucaguguaguuggaguucuuucauuguaaguaaagucgaacagacuuuuauauuuaacauccuuuguauuuucuauuauuuguuuauaugcuuuacccauuuuuguuuugaguucuuuccugcuuuuuuaaaaguugauuuguagaaaucucuucccaauuuaaaaauuaguucuuuuguccgaugugaguucuaaacauuucuucuuguuuggcuuauuuauugagauggagucucacuuugucgcccagacuggagugcagaggcacgaucucggcucagugcaaccucugccuccuggguucgagugauuccccugucucagccucccaaguagcugggacuacaggugccugcccccacaucugguuaauuuuuuguauuuuuaguagaaacgggguuuuaccaccauguuggccaggccgguuuugaaguccauggccucaagcgagccacccaccugggccucccgaaguacugggauuacaggcgugagccacugcaccagcccaccuuuuuuaaaaaauaaaaauaaaaaagauguuguccaggcuggucucaaacuccuggcccuaagccaucuucccaucucagccucccaaggccacugcuccuagcucuguuuggcuuuugacucguguguguguguguguguguguguguguguguguguguguguguguguguguucagacuucuuaaauaaagugaauguuuuaaggcuucuggauuuugugacauauuacaaaaguuguauuuuagaauauuucuuauuuucuagugauauugaucugucuguauccaguaacauuguuuaaauuuuuguguuuuugugauauauguuaauagcuaauuccuucuaagguacguuucuuuuucagaagugcccuagcuuuuuuuuuuuucuuggcuauuuuuccauuugaaauuuagaaucagcuuuuaucaucuccugccuuuaauucuuucuguugcauuuuuuauugggaguacauaaaauuuguaguuauuaauuuauagagaauugacaagaaugggguauaucuuuccaugaauucauuuuuuguuucucagaaauguuuuaauguuuccuucauaauagauuuuauacauuuauuaagcuucuuccuagguuuucuuuuuguuauaaaguguuauauuuuucauuacaucuucuaacugcuuguuuuuuuugugcacaugaaggcuugugauuucucuauaucaguuuuguacuuagucaucauacugaauucucuuaaagguuuggauuuuuuuuuaguuuauucuuuuggcuuuuccaaauauguaguguuaucauuucuaaauaauaauuaucuuccuguguucaguuuuaauguaugugccccauuuccuucuccuucuacuucuguguaccacacuacaugauacuggacaucuccacauuauaccugaucugaaugagaaugcuuuuagcucucucccacuaaaguacagugcuugcuuuuguguuagaauugauagcuacauuaagaaaguauccaucuaaauaaagugaauuaaaacuuaaacuuuuuuuuauuauuuuuuguuucaguaguuuuuggagaacaggugguguuuggugacauggauaaguucuugagaggugguuuuugagauguuggugcacccaucaccugaacaguggacacuguacccaauguguagucuuuuuaucccucacccauucccacuuccccuugacuccccaaaguucacuguaucuuucuuaugccuuugcauccucauagcuuagcucccacuuguaagugagaacaugcaauguuugguuuuccauuccugaguuacuucacuuagaauaauggucuccaacuccauccagcuuguugcgaaugccauuauuucguuccuuuuuauggcugaguagaauuuugugguauauauauauauauauauacguguauauauauacguauauauauauauacacaccacauuuucuuuauccacuuguugauuggugggcauuugggcugguuccauauuuuuuggaauugcgaaugugcuauuauaaacaugccugugcaagugucuuuuucguauaaugccuuccuuuccucuggguagauaccaguagugggauugcuggaucaaaugguagguccacuuuuaguuaaggaaucucuauacuguuuuccacagugguugugcuaguuugcauucccaccagcaguguaaaaauguucccuuuucaccacauccaugcaaauaucuauuuuuuuauuuuuaaauuauaucgcauugugguuuugauuugcauuucacugauaauuagugaugcagagcuuuuuuuuuuugagauggaaucuuguucugccgcccaggcuggagugaaguggugcaaucucggcucacugcaaccuccgucucccggguucaagcaauucuccuaccucagccuccugaguagcugggauuacgggugcucgccaccacgccccacuaauuuuugcauuuuuagucgagacgggguuucaccauguuggccaggcuggucuugaacuccugaucucaggugauccacccgccucggccucccaaagugcugggauuacaggugugagccaccgcacccagcccuuguugagcuuuaguauguuuguuggccauuuguauaucuucuuuugagaacugucuauucuuuugagaauugucuauucauguccuuagcccacuuuuugaugggauuauuuguuuuuuacuugaugauuugaauucuuuguagauucuggauauuaguccuuugucaguugcauaguuugugaauauuuucuccaauucuguagguugucuguuuacucuucugacuauuucuuuugcugugcagaaacuuuuuaguuuaauuaagucucaucuauuuaucuuuuuguugcauuugcuuuuggguucuuguucaugaagucuuugccuaagcugacaucuagaagaguuuuuccaguguuaucuucuagaauuuuuaugguuucaagucuuagauuuaagucuuugagccaucuugaguugauuuuuguauaaggugagagaugaagauccgguuucauuuuucacauguggcuugccaguuaucccagcaccauuuguugaauagggugucauuucccugcuuuauguuuuuguuuacuuugucaaagaucaguuggcaguaagugucuggcuucauuucuggguucucuauucuguuccauuggucugugugccuguuuuuauaccaguaccaugauugguuuuggcgacuauagccuuguauaguuugaaguugaguaaugugaugccuccacauuuguucuuauugcuuagucuugccuuggcuaugcaggcucuuuuuugguuccauaugaauuuuaggauuguuuuuucuaguucugugaagaaugaugaugguauuuugauggcaauuucauugaguguguagauugcuuuuggcagugugguaauuuucacaauauugauucuacccauccaugagcaugggauguguuuccauuuguuugugucaucugugauuucuuucagcaguuuuguaguuuuccuuguagaggucuuucauuuccuuguuuagguauuuuacugguuuuuuuuuuuuuuuuuuuuuuuuugcaguuauuguaaaagggguugaguucuugauuugauucucagcuugguaacuauugauguguaguagugcugcugauuuguguacauuaauuuuguauccugaaacuuuacugaauucauuuaucagaucuaggagcuuuuggaugagucuuuagggcuuuguaguuauaugaccuuaucaucagcaaacaaugauaguuugacuuccucuuuacugauuuggauguccgugauuucuuucuccuguuugauugcucugacaaggacuuccaguacuguuuuuuuuuuuuuuaaauuuuauuauuauacuguaaguucuaggguacaugugcacaaugugcagguuuguuacauacguaugcaugugccauguuggugugcugcacccauuaacucgucauuuagcauuagguauaucuccuaaugcuaucccucccccaacccccaccccacaacaguccccggagugugauguuccccuuccuguguccauauguucucauuguugaauucccaccuaugagugagaacaugcaguguuugguuuuuuguccuugugauaguuugcugacaaugaugguuuccaguuucauccauguccuuacaaaggacacaaacucaucauuuuuuauggcugcauaguauuccaugguguauaugugccacauuuucuuaauccagucuaucguuguuggacauuuggguugauuccaagucuuugcuauugugaauagugccgcaauaaacauacgugugcaugugucuuuacagcagcaugauuuauaaugcuuuggguauauacccaguaaugggauggcugggucuguugaauagaaguggugaaagugggcauccuuaucuuguuccaguucucaggggaaaugcuuucaacuuucccccguucagcauaauguuggcuguggcuuugucauagauggcuuaagguaugucccuuguaugccaauuuugcugaggguuuuaaucauaaagggaugcuggauuuuguuaacugcuuuuuuggggucuauugagaugaucaucugauuuuuauuuuauuuuauugguauuaguuuugaucuuucaauaguaauauuuucaaguaauagacuuaauaguuucaaaacauuuuucacuucucaugcacuugaucauuguauauuuuucucccauugugcuucucauacauuuacuucuuauuaggcacaauaacauguugguaagaaauaugaccagacaacuuuuaguggauuagaaguuacuuguaauuuuuacuaugauuaauaaugcguaagccuuuugauuccauuuccuauuaaacuuuucuuuaaguguaggauauuauuaguaaaauacgaauuuuuaaaauuucgcugguuauugcaguuguggaguuugugaggaggggagugauuuaauuauuugauuucauacagugcaaguuucugaaggcaucuggaugcacaaagacucgauucaccacugugccagcagccuguuuguugcucuaggcugauuauacccaaaauguuggugacaugauggauuaucacuuucauuaggucauaaguguuaggggcauauauuuuacuuuuauaacauuuguuuuucagcuccuauuuucuuugcucucauucuauaaggauuacuucauuuaaaaccaaaguguugaaagauugcgugggucuucagucauuaaacuuugccuuucagaucaugagaacaugacagcaagcuacuaaaaaagccuuagaugauuaauguuacuggaagaaaagauauacugguuagaauucaaagguuguuuggaaguaacgcauugcuuauuuuuaacuagguaaaaauuuuuagaaaaguuuuuguauuaguccauuuucacacugcuauaaagauacuaccugagacuaaguaauuuaugaagaaaagagguuuaauugacucacauuuccauaucugagucgcuagggaggcuuugggaaucuuauaaucauggcagaaggugaaggggaagcaaggcacgucuuacauggcaacaggagagagacagacacacacacacacauaucaugcaaaucuuguauauuuuuucuuuguccuuccucuucauccuucacagaaggcagcagaggaucaguaauugugcugucuuaguacaccacacugccccaguaauucaucauguuacaaacuuuuaugugucuuaaaacuuaccagauaguacaacuguuuucaaaauugguuuauguuauuagugcuucuuuuuuauuuuauuuaauuaauuauuuuuugagacugagucucacucuguuacccaggccggagugcaguggcgugauauuggcucccugcaaccuccgccucccggguucaagugauucuccugccucagccuccugagcagcugggauuacaggcaccugccaccucgcccagcuaauuuuuguauuuuuaguagagacgggauuucgccauguuggucaggcuggucucaaacuucugaccucagaugauccucccgccucggccucccaaagugcagggaucacaggcaugagccaccaaguuuggccuaguacugcuuuguagacaauuaccuuuaugccuguuauuuucagugcuuagauccuucccauucuguguacuuuuuuuguugacguuacuguauuaagguggucagaaucaacauuugugauguauuuccagcaccauuguuggcugauaaaauagagauagcuuuaaauuuaguauccauaaaaaauaaaaugaauaccguagguuuagagaaguuuaaaguucucaagggaucuauguauuuuuuaaaaauuauauaaaaauaacuuuaaaguaaucuuuuuuucuugguaaaacgugcaguuuuauguauuuuuaggcaggaguaacaacuuuuuccacauuuccauccagagaacaaaggucaaaacagcauuuauuauucuagcuauaguuuuacuguuuaaacuuuugaaauuuuguguagcaccauugagagaagauuagugcuuacagcugaaacuuaguuuuaauacaguaucauauauacauauauauugguugauuuguuuuugagacagggucucacuguguugcccaggcuggaaugcaguggugcaauuauggcucacugcaacccuugugucuggagcucaagcaguccuccuaccucacuucuugaguagcugggacuacagacacaugccaccaugcccagcuaauuuuuuguauuuuuuguagagaugggguuucaccauguuggccaggcuggucucgaacuccuggacugaagugaucugcccaccucggccucccaaagugcuacgauuacaggcaugagccaccaugccagacaucuuuuuuucauuuuuuguuaucauuuauuucugaaacucagccaauaugauguauagagacaaauacauagauauugacuggcaaaaagucauggagauaaaguguauuacuugaacaagacuucagauugaauauuauuauucuuuaguuuucauucauuugcccgcuuugugagguauuaggaaugacauggguggugguggauacaacauagaaaaauuucacuugcuuaauauuacuugaacuaaucucugggaccauagucccuuggccaucaccaagacugagaagaaucgaaucaagauuuugcuuuaggggaagguuguuuugaauaucuuagggggauuuacagugcacucuccuguagcuuacauugcaaagcauucuggcaugggauaagauguucauaacucuguguguugucuuuaaacagagucuuugaagcaguucccucagacagcacaggacauuuuccuacugaaggaacucagaugcaguuuaggcauacuuauauguggaaacuauccaucucauaguuuacuacugaacccugaauuagcugguagcaacaacccccuacccucucucccgcagucagaggcuucuccugauagccauggcaguaaaaauagaacaguagaacuaaaauauuuuccagaagcagaacauauucauagggaaaggaugaauucaaaguuauuuacaacucuuuuaucuucaaaccauuacauauaaauugaucaaauaaaaauagcuagucuaauguguuuugagcagguauuaccauuuuuauuuauuauuuauauugcuuauuuuugaaucaugauauuucaggcuuuuuauuugaugagucaacaucuuaagauuccuaaugagaauggaauaugaaaaauaauugggucauuguuaacaaugauaagucauuuugacaguauguguacuugauaugaucaaugauacuucagcucugugguucucuuccccaaaaugcacaaccccaguccaauuaugaacaaaacaguagacaaauccuaguuaagaaacauuccaccaaacaacugacuaguaguauucaaaacugccaagccuccaaaaacuaggaaaguccaagaaacugucacagccaagaagagccaaggagacaugccauccaaacguaaugacauaucccaggcaauaucuuggaacagaaaaauggcagcagacagaaacuaaggaaaugcgaauaaagcacggacucuuguuaagaauaauguauccguguugauuaauuaugacaaaugugucauacuaauguaagauguuaacagugugaaaucuggccucuggguucccaggaacucucuguaucaccuucucuguaccauccucaccucucugcaaauccaaaacuauucuaaacaaaaagugcauuuaaaaaaucaauucaaauuuggcaguguauuaggguuaagaauaauaaaguaacagugauuuugagagagcucaaaaauaaaaaauuuggaauggcauucuuuucaaagcuugguggacccaaaaccuauaaauacuucagugggggagaucagggauuuuaccuucggaacauuaagguuguaugaauuuauuggggaagagggaaggcuacaaaguagucaaccuaauucuauuugucuucuuugccccuggcuuccagaucucucuccaagucaccauagaccaugugcaccccaauauugaauaucucaugaacaaccaggacagauuugaucuaagaaagacucaaugcaagaaaucccuguuauauuccaguggagaguguuauguggaauggaccccuccauuugaacucuuaaauucuguuucaauucaggucauuauucuccucugcuuuccuuggagguuuauacaaaucuuagguacaccaggaaaccauccuuugagccaggguucuuucucagugccaggcacuuuucuaugugaauuauaucaacagguaacccugugaaccauguuucuaccuaacgcuguugacaaauuucaguccuguuucauuucacacaacugcccaacuugguggaucagaagacaacagguaaagauaaccaaguagccaccaaguaagacuaggaggcuuuccgcaaaaaagacaacuuucugaaaugcuuggugaaacuguucauuagacagaauguacaucacuggauugaugauggaguuuaaaaauagcucagcaaggcugggcgcgguggcccacgccuguaaucccagcacuuugggagaccgaggcagguggaucacgugaggucaggaguucgagaccagcguggccaacauggugaaacccugucucuacugaaaauacaaaaaauuagcugggaguaguggcaggugccuguaaucccagcuacucgggaggcugaggcaggagaauugcuugaaccugggaggcggagguugcagugagcugagauuguaccauugcauucuagccugggagacaagagugagacuugguaucaaaaagaaaaaaaaaaaaaagcucagcaagaugaagaugucuuaauauggugguaucuuggcuggcagagaaacaauaaagagaggcagccagcagaugauaaaagccccuaaaaugauccccaggguuucuguggcuuuccuuguuugaaaguaaauuuccuguuguacuaggacacuauaagcaugcuugauuuucaugugauuaacaagcagaggagagccaguuaagcgccuuugccucucauggaggcugggguugaggaagaagagugagcugugaugaccugggcaguggugcugugaugauggcuucuggauguucuuguugggcaaugugugaagaugaugaacaacacaaccaaaauguagaaggucuuacauguggaguagguggugcaagaggucuaggagaagagcacugggauagagauacaauuugagauggcccauuuacuauacuacagggcauuggugauggcccaguaccuggucagagcaacagacagaaauaucgguuggaggccauguagcacgugaugcuagaagacagccagauguugcacaggaguuggccaaauuuccaggugugugugauggucuaugugaugcucauggauaugaacaaggagccagugagauaguuggcugguguauauagcuuccuggugaggaagauggugguaagcagaaagguguuggagagagcuguugucagugcgaugauggaaaggaccacagcaagagaucucuagccccuggaaguucccagcuccuaagccuccgguauuuuuguaguaucgagggauccguuggaggccuccuggaggaugucuuccauuggaugguuuugugaggacauucuagggagcuuucucuuccacagucauagcuucucuuuucacaguugucuguaaaaggucaucuuuccauuuccuacuucugggaaccguacaucagaagagcaaaccacaacagaaaaucuccaaggcuugauuacaugaagaacacugaggugacuccuagcuacaguuaaaggcuuuucccaaaucagauuaaucccaagaugucucucuguucuagaacucugauaggcacaugcugaauauguuagacaauugcagguuaucacagcacugugggcaaagcuccacaauuucuugccuuugguauuuugacucuuuuuaaggcuugagacuuauacguguuuaacugugccuucagaauauuucccauccuauuccaaagagauuguggauuucagguugcugccugggagcuuuuaaaauuagagacaaaagggaauaccagcuuauucagagaagcaguccagucaacagcucacaguuuuccuaggugaauccugacauaugauugguacuuaauuuugguuccuuuucuacugacuguuuuugagccugaaaagacaaacauuccaguuaccaaagcuugaagaaugcaugaacucggagaagggaaaacaaacggaucacugugaguuugccaagcggggcagguguucgaagccccucccuggccgugcguguggaaugcugggcuugcccuccugggcccuccuuucuucacauggucggauuuuggccuacauaaucacaggccccagcccugcgccuuccccuggcccuuucccuuccugcacuuuugggauacuccauuucuuuuuuuguuaauuaauaacuuuauucguuuggaguaguuugggaaguucccaaguguaccugaauaauguacauuguauucaauagguaauuuuucauuucuccccugccugccucccccugcucugagucucuaguguccguuauaccacucuguaugccuuuggguacucagcacugccucccucuuaugagugagaacaugcaguauuugguuuuccauuccugaguuacuucacuuaggaugauggccuccaguuccauccagguugcugcaaaagacaugauuucauucuuuuuuucauggccgaguaguauuccaugguguguguguguauguauauguauauguauauguauauguauauguauauguauauguguauauauacacauauacauguauauauacacacacacgugcauauauauguguguguguauauauauauacacacauacccauguguguuuauacacacacacacacacacacacacacacuuucugucucuugccauauacaaaaauuaaccuagguggauuaaagacuuaaucuaagacccgaaaccauaaaaauucuggaagauaacacagggaaaacuccucugaacauuggcucaggcgaaggauuuaugacaaggaucucaaaagcacaacaaaauaaaaaugaauaaaugggacuuaauggacuuaauuaaacuaaaaagcuucuguacagcaaaauaaauaaucaaaagaguaaauagaccaccuacagaaugggagaaaauauuugcaucauauucaacaaaauauuaauauccacagucuacaaggaacuuaaaucaacaagaaaaaaaaauaaucccauaaaaaaugggcaaauagcaugaauagacauuucucaaaagaagauauacaaaugcccaaaaauguaugaaaaaaugcucagcaucacuaaucaucagggaaaugcaaauuaaaaugacagugagauaccacccuaccccauccagaagggcuauuauuaaaaaguuaaaaaauaauagcugguaucauggauguggugaaaagagaacucuuacacacuguuggagcaaacguaaauuaguacaaccuuuauggaaaacuguauggauauuuuucaaagaacuaaaaguacauuuaucauuucaggcugggcguaguggcucacaccuguagucccagcacuuagggaggccgaggcagauggaucaccuguggucaggaguucaagacaaaccuggcaacauggccaacguggcgaaaccccauaucuacuaaaaauaaaaaaaucugaugggcauauugguacgugccuguagucucagcuacuugggaggcugagacacgagaauugcuuggaccugggaggcagagguugcagugagccuggaucgugccacugcacucacagggcgagacuucaucucaaaaaaaaaaaaaaaaaaaaaaaagauuuaucauuucauccagcagucccacuacuaggagucuacccaaaggaaaagaagucauucugaaaaaaaagacaucuaugauauggaaucaaccuaagugcccaucaaccaaugaauggauaaagaaaauuaaacuuuccuuuuuuuuuuuugagacggagucucgcucugucgcccaggcuggauugcaguggcgccaucucggcucacugcaagcuccaccucccuggguucacaccauucuccugccucagcuuccugaguagcugggaccacaggcacgugccaccacgcccggcuaauuuuuuguauuuuuaguagagacgggguuucaccauguuagguggucucgauuuccugaccucgugaucugccugccucagccucccaaagugcugggauuacaggcgugagccaccgcgcccugcugauaaguauuuuuuuaaaagcccugagaaaugacaauguaggauuuaaaaaaugacuuguauuaacaguaugagaguaauauguguucaagguaaaaaaaaaauaaauaaauaaaaauaaaaauuaccaaaacauauggagugaaauuaaaguuccuucucccauccuuugcuccucucagugcaguucuuuaggguuauuaacuguuguuaacaguucuuugugugccguuucauaaaguuucuaugcauaucaagcauuuauguguuauauaccuuuuaaaaaacaacuggaaucauacuuuuuauuaauuuaaaaauaaacauuuuaauaucaucuuauauacagcuuuaucucaucuuaaaaaauaucuacaugguuuucugaaucauacuucuaccauaauuuaacuaaauuuaaccuaagauuuacagguagaugaagauagggguuuuucuuauuuuauuuuauuuauuuuauuuuuuugagacagagucucacucugucgcccaggcuggagugcaguggugcaaucuuagcucacuacggccucugccucccagguucaaacaguucucuccugccucagcccccugaguagcugggauuacaggcgcgcaccaccacaccuggcuaauuuuuguauuauuaguagagaggauuuuaccauguuggccagccuggucucgaacuccugaccucaugaucuguucaccucagccucccaaagugcagggauuacauuugugagccaccacgccugaccucuuguugauuauaguaguauaacgcauaaugacauaaccgucucauucaugaguugauauuguaugcguguaaaaugucgauagcuguuuaauuauccaccaagaguuuuccacugauuuacacggagaauguuuuuuugcacaguuucauuaaacauuuguuaucaaaccuuuuuaaauuuccacugacuugguaggcaauucugaagugucucuuuucuugcuuaguauuuauuuaaaguugaguucucauugagcauuuuuucauagguuuuuguuuuguuuuaauugggagguauauguuaauuucuuuuccauauuuuucuguuugaugauguauuuuuucuuguugauuuauaggaaguuuuuccucuaguaaauacauuggucuauuuccuuuuauguuuuacaaauacauuuuccuguuuuuuguuuuuuguuuuuaacuucauuuauguauuuauuuggggguuuaugucaccaaauuuaauaguacuuuucuuuauguccucucaguuuuaggucacacuuugaaaguccuuauacaugccaaagucauuuucauuuuuauauuuuuuugagaaaggcucucacucacucugucacccaggcuggagugcagugucucagucucagcccacugcaaccucuaccucccaggcuccaagccaaccuuccaccucagacucucgaguagcugggcuacagccgcacacaccaccauguccagcuaauuuuuuagcuuucuguagagacaggguuuugccauguggcccaggcuggccuugaacugccgggcucaagcagucugcccuugccaagguuauuaaauaauucauacaugcuuuucucugguacuuuuaaaguuucuuuuuauacaucuaaaaauugguuuauaaaauuuauauauugccguaaugauucaguuuuauguuuuuacauguggcuggccaguugucauuauaguauuuguuaaauaauccaccccuucucuucugauuugaaaugccacaaauaaauuaucagauuaguagauuguuuugcuauauuaauuuuauuuuugcaggaauuucucacucuucucacucauuuacuuuuucagaugaacuuuaguaugauuuugucaaauuuuccucuuccaaaaaaugaacuuguuacuuuuuuuauugaaugugguaucucagaagucaagugaagaaaggguuucaaagaggagaggaugaucagauuuuucaaauacugcugaugaguuacaaaaaaugaaaauugaccauuggcuuuaauaaagugaagauccaaauaucuaaaaaaccaucaugcagaagaaagauuagacuuguucaauauggccccacauuaacucaaucagcagauacucuaaggagucaauucuaaagagagucaaacuguccaaaacugauaacacacuaccugggaggaaaucaauucauucauuauaaguggacauauagcaaaauuaaaguguaauccgucacuuuaucuaauuuugcuauauguccaguagagugggcagaguuuauaguuugugccuaguuucuccugugauuaucuguuacuuuaaacaauauuuuaaaacuuucugugucuugauuuaacacguuuaaaaaugaagccauguuuauugacuacuuuuuauuaaaaauaguuuauuuauauuaccaaucccccuucuugauuuuaguugguaaacuuuuguuauauuuugcugaguucauaguacuuuucaguuuuauauuguguuguuuuuuguaaaggagaaacauugcuuacuguaauuaugauucauauuuagcuuuuauuucugaauuucaguauauuuaaugcucauaacuagucguuaaaaacagcuuaacuguucccaguuuuuuuguuuuauuuauuuuuuuuuugagaaggaguuuugcucuuguugcccaggcuggagugcaguggcaugaucucggcucaccgcaaccucgccuccuggguucaagcgauucuccugccucagccucccagguagcugggauuacaggcaugcgccaccaugcccagcuaauuuuucuuuucuuuuuuuuuuuuuuuuuauaguuuuaguagagaugggguuucuccauguuggucaggcuggucucgaacucccguccucaggugauuugccugccuuggccucccaauguccugggauuacaggugugagccaccgcgccuggcuguucccaaguuuuaaacuuuaauuuuugguugcccaggaacuucuuugaauuguuuuguaugaaggguuaugggugcuaucccaauuccuuguuuguugaccauguguuuauguuaucuuuuuauauuuuaaaaaccauuucagagauacaaaaauguauagagaauaauauacugaguauaaucacucaaguuaaguaaacauuucaaauauuguugaaguucauuggcauaucucuccuugauaguacuccuuuuuauucuaucccagagauuaauacuugauuuuaguauuuauacauguucaauaagaggaaguacauauggcaaauaaauaugagaaaaauguucaacuauaaugaaugaauugauuuccucucagguagcauguaucaguuuuggacaguuuugacccuauuuuguuuaaccagaauugauuccuuagagccuuuggcaccagggaccaauuuuguggaauacaauuuuuccacaggccaugcugcaggggacaguuuugggaugaaacugucccacgucagaucaucaggcauuaggaucucauaagaaacaugccaccuagaucccucgaaugcacacuugacaguaggauucacgcucuugugagaaucuaaugcugccacugaucugacaggagguggagcucagguggucacgcucacuugucucaccgcuuacuuccugcugugcggcccaguuccuaacaggccacagaccggcacugguccauggcccaggaguuggggaccccugccuuagaguauuugcugauugagauuaacuuggggccauagugaauaagucagaucuuuuuucugcaugauauuuagauauuuggagcuuacucuuuggcagcccccaaaucucaauauccuacgugaaguauuuuuauuccccucauuguucuuauuugcuuugguuauuuuuucugaugacuuuuaugugucuaaacugauuuuucuuccaucuugacuuguuuaguuaggauuuuggaucuaauugcaagagagaugauuaaaaugggauucauguuccguucacggcccuuagcugaaaugugggcuacucagugaaacucacuaacguucaguuucuucaucuguagaguggauauaauagcuacuuaaggauguucuuguuuaacgauguaauguguaugaaaucaugcaccuuggaaccuguaaagugguauauacucaggauaugagguaucaacauaauuuauucucauuaaauuucauucagccaauuacucugaauuuagaaucauggagaaucuuuugacucuugauuugauuguuuagucuaacaguaauuuagucugacaagucuugauuugacuaacaaaucguuuagacuaacaaauuguuuagccuugauuugauugaaggauugucaauccuucaauuucaugccuucuacccauuuauaaacgugcucuguauacuuucguauagacaauaaaauguugaacaagcccccaaaagauuuaggugauacauuguaagaaacugcugaucagauugauauauccaucacaacaauucuaaaagcuuuuuuuguugccuguagaauuuuuuuuuguaagcucacuuuguuugcagguccagacuuuuauaaaucuauauuccuauuuguccuucauguauguucuucaauaagacccuuaaaaaucuaagaucaaggugagcaugguggcuuacaccuguaaucccagcguuuugggaggcugaggaggguggaucaccugaggucaggagcuugacccugucucuacuaaaaauacaaaaaauuagcugggcgugguggugcccaccuguaaucccagcuacuggggaggcugaggcuguagaauuucuggaacccaggagguggagguugcaguuagcugagaucacaccacugcacuccagccugggcgaaagaacaagacucugccaaaaaaaaaaucaaaucuaagaucagccuguaaaauuccuucuucuuuaaauuuucuuuuucuuuuuguagagacaaggucucacuguguugcccaggcugguauccaaacuccuggucuuaagcaaugcuccugccuuggccucccaaagugcugagauuacaggcaugagccacugugcccagccugaaauuccuucuaaugaugauaccuugauagugaaccaccucaggaccaccaccuacacauauuuuccuagcguucuaagcaauguaugcacuggaauagucuuugcuguuucuucuucuuuuuccuuaaugaguacauuuguaguuguacagucaaaauuauguucuugugggucucccagucuucccagucuuucuaaaccguccucauuccgcauaguguuuuccacuaugugcuaggcaaagacauauagauguggucucugcucucaggagucccagaauuaugggagguuagaagguuaugauacgaaugguauacgguggggcaaaaaaacgaggaauuuuagauuuagcccuguaugaaaggagucugaggaagucuuaggagcugagucuugaaaguuugcaagguagauggagaagggggcaucuaagccuggagaguggugucaauaaaaacgaggagggguguuccuuuccaccgugucaugcccuggcauuucacuucugcuuuuaaacauucguaauauacgcucuuaaaaauuucugguagagcucugcauaugaaugccguuucugucucauuacgaacucugaaaucacuugcucccuggcaaaauuauacccaauuuuuaccuaaugagaaaaauuacagugaauguagucaucuuuauugaccuguuaauuuaggaagcaguugaguugaguuuuuuucuccucugucccagaagauuuucaaucaaaaacuguagaaauuuaucuucagugggauauugugguauaacuuuuaagguagaacuuuagguaucccuguagagaugccuuaauucuguacaaaaaagccuuaaauucuguacuuugcuucuugauucagacacuuguucccuaaggaagaagaauaugguaacacuacauuuauccuuuucuuguucuuuggugucuacauucucuaaucauuucuuucaugaauauuauaacuguauauuuaaguaauauuuaaauauuguaauauuuagggagcaguacugagaaacuauguuauuuuggcauuuaucuagauauacuuaaaagaaauuuuuucuucugagcacaauggcaguuaugguaaucgcuggguuauaaguuagucacauacuguggacugucucugguucugucugggccaccacuguccacccauagucuuccuugcuuucuaaguaguauacauauuuguaugcacuaggguaacccagugcuuagagaaugaaacgagacaauagcagauggccaagcgugcuguacaaugggauuaguauugggcuccuccuucccaggguucuccccuaugguuuaaaguaguucuguguuacaguaaauuucuuaucuuuauaauaaaucacugaccuggaaaauguaauugagcauuugaaucugagcugcauucaaaaucuguguuaaaauuguacagcuucuugcuugauugauuauaaaugauaauguagcuuggaguuuaauuugcuuacacagaugcuaucaacauucccuuccaugcuucuguaacuucuguuuauuucguuuugcuugcaucuccaguuuccuagguuuguuuuuuuuuuuuguccuaguugguucuuuaagucucuucuauuuuguuuuggguaggaggucagaaagaauagguccuuuguauguuccguuuguuuucugugaagucuuggauaagacaguuguuaguuuguucacuuuuuccauaucauaaaaucggacaggagaguaagguuguuguuuuuuuaauuaaagacaauauuuacuaauauauucugagaaaauauuuuauuuuuaaaauugugccuuuuuauuuuuaauaaggaucaauuccuguauuuucugaauguuauuauuuuaaaucuuaacccagcugugaagcaagcuaaguuuagagaagacugugucaggccuaauugaacuuuacgucugaaacauaauuuaguuagauauuagaauuuuuucguuuucuuuccuuuacuuauaauugucuaauagaacucacuuugcaguucuuuguugauggagaauauguauaguuaaacucuugaaauaucauuuuauugcaaaaacaaugcgcaguaaaugaaguuugauuugaugauuauauuuuuacugguagcuaaggaaauauacucuguguaaauuuauuugcuucauacaacuuuuuuuccccucccuuuuuaaaaguaaaccuuaaggaaguggagaguuuaacuugcaaaguauuauuuaacuucuguaugucaacagguuucugguuuuaaaugaugcugauccuauacaagugauauuuuauaauuauugaagaauuauucucuuagaaagggagguuauuuuuuuuaccuuguuauaguguaaaucuuuuaauuaugauauguuccuuagcaguauuccuuccacuuccagaacacuccucuccaaaaaauacuacaaaauaacaaaauacccccucaucccuacauugugauaaucuagaaauaauaaacuucagauauaagugauuaaaacaacaauaaaauggauguauugugauagaucuagcaaacucuauugcugcaugauaacugcccuaaaacgcaguggcauaaacaaccauuuuauuuugcuuauuuauuugugaaucaggaauuccagaagggcucacauagguaguuuguucuugauuuguguauuuucaccuggaagugucuaugauuggaugaucuccuaccaagauggcuuauucacuugcauauauucucuuugcuccuuagccucugucuacauggugguuuuuauuuuuauuuucuuuauuuuuauuuuuugagauagagucucacucugucacccaggcuggagugcaguggcacagucucagcucacugcaaccucuaccuccuggguucaagcaauucucaugccucagccucccuaguagcugggauuacaggcaugcagcaccacaccuggcuaauuuuuuuauuuuuaguagagacgggguuuugccauguuggccaggcuagucucaaacuccuggcuucaagugauccgccugucauggccuccugaagugcuggauuacgggccucagccaccaugucugaccuacauggugucuuuugccccagcuucugcaggugccuuggguuccucguggcauggggaaaguagucacacuucuaauguggaagcugcuuccagauuuauagauguuagaagcagaagcugcuuggucaguuaaggguuauucuugaaaguggcuuggaaguggcaggucacuucuguuguauucuguuggucauaguagucacagaaccugcccuuuuuauuuuauuuuauuuuauuuuauuuuauuuuauguuguuauuuuauguuauuuuauuuuguuauuuuauuuuauguuauuuuauuuuguuauuuuauuuuauguuauuuuauguuauuuuauuuuugagacggagucucgcucuguugcccagccuggagugcaguggcgcuaucucagcucacugcaagcucugccucccggguucacaccauucuccugccucagccucccaaguagcuugacuacaggcgcccgccaccgcacccagauaauuuuuuguauuuuuaguagagaaggguuucaccguguuagccaggauggucucgaucuccugaccucgugauccgcccaccucagccucccaaagugcugggauuacaggcgugagccacugugccuggccagaaccuguccuuauuaaagcaggguggugguggugucaagaauggggcuccaccuucuuccugagaagggguagaguucauggcagaagaguaugugagauggaagacauuguugugaccauuuuuggaaaauaucuacuucaguagaauaaaacauuggauaagggguuggaaaucaaagagugaguuuuuuuugugcgguauggcaauaaaauucuuacucccuuuucuguugucuuaugauauugcagccuuauuaaccagaauggaaguggaauguuucuauuuccauguucugcucaguguuuuaaucuguuauuuuuaggguuucuacuguuaucuguugcuuucaaacaagcuacuccaaaccagaaagaauucugaacaacuuaagaguuguuuuaccuaauucaggaauuaccacagaguauaaauguaauucauaggaagaaaguacagaagaauaagguauguggaaaggaagaggacuaacagaaggugaauuaaugcuacuuacugauuuuggcaauucaccuugggugagaagcacgacugucuagauggaaacucuuguguauuagugaucuaacaagaaccagugugcuugcuacaagacugccuuuuagaagauagagguguguauagaugauacacagaaugcaggagaauuuuuuuuuuuuuuugagauggagucucgcucuguugccccggcuggagugcaguggcgcgaucuuggcucacugcaaguuccgccucccggguucacgccauucuccugccucagccucccgaguagcugggacuacaggcgccugccaccaugcccggcgaauuuuuuuguauuuuuaguagagacgggguuucaccguguuagccaagauggucuugaucuccugaccucaugauccacccgccucggccucccaaagugcugggauuaccucggccucccaaagugcugggauuacagguaugagccaccgcgccuggcgagaauuuuuaagaacauuaagaagaaauaaacauggcuaaacuguuuuguguuauuugagggggauaaagcaagauacaucucagaacuuagaguguuuucacaauucguugauggauauugcuuugaccuagcacugagggguuaauuuggauggaauuuuuuuuccaaucgagcuagaauucacagaucauaaaauuuaccauuuuaaacuauaugauucagugguuuucagaauauuuacaauguugugcaaccaucaucacuguccaauuuucaucacuucagaaagaaacucacaccugcuggcaauuacaaccccucauccucugacaaccaguaaccuccuuuuugucucuauggauuugccuauacuggaugagaccuucgacugugaacuuuugagcuaaugcugaaaugaguuaaggcuuugggggauauugguuuugaaaugugaagacaugagauuugggaggggcugggucgaaaugaugugguuuggcuguguccccacccauaucucaucuugaauuguaauaaccacaguucccauguauugugcgagggacccagugggaggcaauugcaucaugggaugggucuuucucgugcuguucuugcaauagugaauaagucucacgagaucugaugguuuuauaaagagaagcuccccugcacaagcucucucugucuuugccuugugccuuccaagcaagucacaugguggcuugccuuccaacaugauugugaggccucccuauucaugugcaacuguaaguccauuaaaccucuuuuucuucccagucucagauaugucuuuaucagcagcaugaaaauggacaaauacagaaggcuuucagucuucaccuugaaguaugauguugacuguggguuuuucauagaugcuguuuaucagguugagaauucccuuccauuccuagcuuguugcauguuuuuaucauaaaaagauguuggauuuuauaaaauucuuuuucuguaucuauugagaugaucauuugguuuuucuccuguauucuguuaaugugguacauuauauugauugauuuuuguauuuugaaacuaaccuugcauuccuggguaaagauagauuuguuuuuaaauagcuuuguguuuuucagcuggaugaauguagaaacuuguucuaucagcauuauuauggagacaauagaaguggaccugagagaauauagccuuuggauaaaugcuuaauuuucaagugcuaagguguaauauaaauggacauaugcaaaggcuuauauuguaauauuuuuacaucauggaaauaauuuugacucauuaaacauuauuucuuugggcuuuuaaguaacuuagugaauaauuugaggaucugugcuuaucugugucguuucucaucuguuguuaauacgccacauuaauguucucagagucuugcaaguucuaguugaguguuuugaccgagcacacauuuuaaacuugaaaauugauaauuaucaagucaauaaggaagggucagaucccucuucugacaaagauuguucuuaguuguuucucaggagauccuguagcaggaacuugucagaguaguaaauacacagacacauaucuagaaaaagacaaaagauuuagggaaaagugccuggucgcaguuuuaaagcagagucaauauuuucuucugcuuaaaaacugcuuauaacuugacauaaauucucuuacauugcauucucaucugugggaauggcuguuugguuagaugcccagguaucugucaacucuaguugagaaauugaaguaacuaaccacgugaagaaguuauuaaaucagacucugaugaagcagccuuuuaugcucuuccuuuuuccugcuacaccaguauguauauccuaaccagaaaauagcuucaagaaucagacaucuauuuuguucuuuaucuguuuuaucuuccuguaauugucagacuuccucaauuuuuucuccuaaugauuuuuuuuuccuaaaggaguuuuucagauuagaaaaaucauguaauuuuacagagaaaaauuugcaaaauucuauaagaucuuugggcuucuuuuuucuuuucuuuuuuuuuuuuuuuccgagauggagucucgcucuguugcccaggcuggagugcaguggcgugaucucagcucacugcaaccuccgccuccuggguuccagcaguuccccugccucagccuccuuaguacucgggacuacaggcgcgcgccaccacacccugcuaauuuuuuauuuuuacugcagacgggguuucagcauguuggccaggaugcucucgaucuccugaccuugugauccacccaccuuggccuccccaagugcugggauugcaggcgugagucaccgcgccccgucagccuuugggcuucuuauauacagugcauauagguaagaaacugacauuuggauuuguuucauugcaucccauucaggcugaacucugccuuauacacagcaaauuugguauuuuuauuuuuuuugagacagggucucauucugucacccaggcugccguguaguggugcgaucguggcucacugcagccucaacuuccugggcucaggugauccuccuaccucagugcugcaaggaacuaagacuacaguuguacagcaccaugccuggcugacuguuaauaguuuuuguaguagagauggguuucgccauguugcuuaggcuagucucaaacuccugggaucaagugaucuacccgcgucagccuuaugaagugcugggauuacaggugugagccacugcacuggccaaauuuggcacuucuauaaagcagcuaagcaaacaacuuuaaaugaagugacuggucuuuuuuuuuuuuuuuuuuuuuggaggaggagucuugcuuuugucgccuaggcuggagugcaauggcgcaaucuuagcucacugcaaccaucgccucccagguucaagcaauucuccugccucagccucccgaguagcugggauuacaggugcccaccaccacacccggcuaauuuuuuuguauuuuuaguagagaugggguuuugccauguuggucaggcuggucuugaacuccuaaccucagaugaucugcccgccucggccucccaaagugcugagauuauaggcgugagccaucgugccggcugugacgggucauuuuaaacaacauucuggauucuugaaaagaaugccaccgauuaauaauuuguaacuucucuuaugcuuuugacagucugaugaaagcuaugggcuuucuccagguaaaagugugcauaguucauuugugugaacugagauauaauauacaccuuaaaguuuauccaugaacuucugauuaaaaacacccaccuuucaccaugacauggugaagaaaaaaauaaucagaaacacucaccaucuauggaacaaccaaguuggugauauacacugguuucuagguuuuacaaaaucauaaaauauguguaugguucaaauacaacagaaauucauggcaacuacaauuucauguuaauuauaauuuaacuagaaagaguguagcuguuggguaugguggaugcugcgaugaucgaugcaaccuaggucucuccugauuguugaaggacuuauuuccccagaucgcuggaaguguuaucaacagaaagcccuccacuuucccuagagauugucuuagcuaaagacaccaccuugcccgagggcaagcccccucccauggacauccagugauugauccuuaugaggugccaugguuugaauuccuucccccuacuugggacaacagcuucagagcuccucgugggguugucagaauccuuugggacuucguggcagcugaaucgcucccucuguacaauccucauuuuucuccuccuaucuacugacuccgaucccaaagagcaccgucuaauaaacuucuugcauaauaaugucugucucagggucugcuuuccgggaaacccagucuuggguagaauacaggguaggauaugagugcaagucagcaucuuucaacccauaaaaguagaccuggcgaaaauaaaaauucaaugagaugaacuugaauuuaaauuaaaaauaagugaaacaucucaucauauuuccuucacaccuuauauucaaguaguuuuucagagucuugguuucuuugaauuuauuugugucucucagucuuucuuugaagaaagacuccccaaaucucugaaagcuugguuuguuugguuacacauuaugaacuugugaaagguguggguuaaauaauacaguugcuuacaugccccaaagaaaccccuagagguuuucuauguuggcaggugaauaugauaagagaaucuccuuuugcuaagauuucuuggacuguauuuagaaaauauuugguuuuggcauuaucauuaaaauuguagauguccauucuaaauauaugaaaaguauggaaaagcuauaaaaagaaaaaaaucuguguaaaaauaaacuucuccucacuugaaauugguauaauauuacacuuacuuuuuggugaccugucuuauucauguaauaguguauaauaaacaaguuuuuguauccuuaauucucaagaauaugaauuguaaugguauaauauucuuuccauccaguggauagaccauauuuaauuuggcuagccuuuuauuguuaaguguuuaauuauucccaauuuuuaaauuauuacaauacaauggauuuuuuuaaaaaauuaagccucuugugccugcuuuaguuuuuaaaaaaauauuggaucucucaucacuaaaauguagugaacugagacuaggcuaccuagacagccacuguaacugaacaacuucaagggaagccauucacaucgaugaugugaauugagggccucagugaaaucucaucauugcuacugccacagaaggauugccguuguggauuuaugugcccucuuugucuuuugagcaauuuuagcacagggaggucugucaauuuuuuauauaugcugacuagauagaaaaagaaggguuugagcuauuuuccauaauuaucuaccaggcagaucuugacuggcagugaccuuuggucuuaccagcuuuugugucauuguauccaguuguucuaaugcgagaggccccuaguuccaugaucuguaccaugagcaaaucugucaaggaacuuucuuuccuaccagcaauuaauaaaaucuaccuggagcaguggacucugaaaauauauuuucuuaagggcuauaccauuccuguauaauuaaauuugaacaguuuuaaagauaaaauauaguaguauucuggugaaguuuauuacuuuuuaaauguucucaucuuccuuagaagaauauuguuauauuuuauaauugaaagagauguuacuagucuuuuguuuuacaguuaaagugaugagaaagauuaagcaauuugcucaaugccacguaacuagucauucauugcaauaauucacuccaugaucuguacuaugagagaacaacacaacugacagggaaacccaaccaaggaaguguuacuugcuacccgacaucuuugcugggcuuauugaggaccauaagcaguaauugagaauacugauaugaaaacuuuuaaaaacccaaauugaauuuaaaacauugcuuagaguuucuuaugguuuugucagucuugcagcuucucaucgcuggaaacaaguggagaagcaaaauuuagaugucagcaauagucugggcaaaacauucuuuuuuuuuuuuuuuuuuuuuuugguaaauuauaguuuugccuuguuuguacauuuuguccgagugucugaugguggacaaacuguugaccagaaaucaggggacuuagaaccugaaaaggaaaaauucacuauuaauuacuauagaucccucuuugccaacugauuaugaccaguucauccagacuguauuucugccaucaauacugaaagguauuauuaaccaagaaaguaaaggucagagccuuuuugaauaacugauuucauacaauaaauuugaugcugauggcuauuuaaaagagcuguggaggcacccucaaaaauguuccuuucccuuaaaugauauuuaaagugagccaggggacugcaagaaguguuuugagcugucuuguccucagaacuguguccuagaggaagucucuucugcguuugcccagugauuugggccucaaaggcagaguaaucaguuccacuugacuggaaauaaaucacccagacugaaacaugauagcuccugacaacugggcagggcugauaaaagccaaaacaaaagaugucaauaaaucugugccaauguggaauuaguaugcagauuugaugaauucacucuguagcuuugcagucagcauuagacuuccucugauuuuaucaguuuuucuuucuuguugaaauaaaaauuguaugaggacaagaaagccucuauauaaaauaaccauuuuauuucuguuucuuuccacccuaguaaacagaacuguaccaugauuacagaggucauuuuaaggaauaacgucgucuuucuccaaacaguuaauuuaaaaauguuucuuccuugggcuggguacagugacucacaucuguaaucccaaugcuuugagaggccaaggugggaggaucacuugaggccaggaguuugagaccagccugggcaauguugcaguacuucaucucuacaaaaauuaaaaaucggcugggugugguggcaugcauuuguagucucagcuacuccggaggcugaggcuggaggauuacucgugcucaggaguucaaggaugcagugagcagugauuacacugucacacuucagccuuggugacagagcaagacccugucucaaaaacagaacaaacaaauauguauuucuugaguuuacuacucaauaaugauaauuauauaugauaguaaacuguauauauaaaccuguuggguaucaccccccuucuauuaucauugacggcacagauguguagaauaaaugccaguuccuuugaucacuacaaaauuuugcuuguacagaaauugaauauaugcuaauagguagugauuucuuucuaugucagggagaguuuauacaaaaaaaaaacccaugggauuauaaaauguauccuuuucuguaacaauuauuuuauuaauuuucaauuuuaaaacuaauuuauguaacagaagaaaaaccuuuuaaauguuuuauugucagguccuccuugguccgucugucuguaaauaaacuagcuuccuuuaaccuugaaaguuaggcuaaacagauuauuugaauaacgucgugguccugaaauccuuaacgucaagcaucuuuggcucugcccagcagcuuuaguguauggugauuagauguauguuucauccaugaaggauguacuuuuccauuugcagugguuugguaccucauucuuuggggguucguuuuauucuuugcuucaguaggggguacauuuuaaguacaugaucguagcaaugguauacuauauuaauaaacacuauaaucauaagaaaucauuuauggaaagaugcuuuaugugauuacuuuuucaguuuuucaccauagaacauauuauuuauagggugguaauuaagaguagauucuggagcuacacuaccuagugauuuucccauaggccuguagugaugcuuaaaucauuguuccauauaaaguccuugcaucaguaccuggcauguuuuuaaguguuggcugcuucuguaaucuaccuccccaccaccacuguuagaaucgucguucuuguuauuuuauuuuagggguucugugguuuauaguccuaaacaauggagaguuuuuaaaaacuggauauuccgagcauauuuaaaaggguauuuuucugcuaaacgugauucugaacaaucauuuuuaucuuuauguucuaguaugugcauaauggauccaguuuuucucuuggcuguucaaagcuucuuauaaaucuuauauuucagauccuauggguacuugaauuaguauagaauagacucucugcugaauauuuuauaaaaauggcauaauacauacugaaauaauaugauaugggacuaucagaguaaacagcauuuauaaccucaacauuagcuuggugaaaaagaagagaauaaugacaagaauaaugugguaacauucauucuucagcuggucagugacacauauaaacugagguccuugaucacaacgaaagugaggauaugucaugggagccuucaguggggcucagcuguuacccaucaugaugcugaauucagugagugagggcucagcuguuauccaucgugaugcugcagucaguggggcucagcuguuacccaucaugaugcuggauucagugggacucaccuguuauccauugugaugcugcauucaguggggcucagcuguuacccaucaugaugcuggauucagugggggcucagcuguuauccauugugaugcugcauucaguggggcucagcuguuagccaucaugaugcuggauaaacggaaagagaaguauuuuuaugggcacacauuucacccgacacacccaccucccacccccugcguguuucggguuuguucagugcuuacacagcugguuugcaccuaucugugucuauuucaggucuuccucacugauggcagcuugcccagaggagguaaucuuaguguccacuguucuuuuuuuauuuugugagauccuuucacuaugaaauguuuguuucuccucuuuuagaaguaaauaagagucugagaauagccaucccuuuucacuccgacucaacagucagucucucuagaguggguaauugaaaaagaaaguaacuugccaagaacuugcugacggcauuuuaccuguuucagcagcuucugcaccugaguauaucagcagaaguguuuacuagcaaagaauaauggauuccuuuaauaguuuaacuacauaucagguauaaaagugaaauuguuaacauuuuaauuccugaauuucucccuagaugcagaugauggaguagaaagaaggguauuauccuuauuaugcauguaagggguguuuguauauuagguaggcucauaaaacaaaucugucuucuuguauguaaaacuugguugguucugugaaauuucauuuuaaauaauguuucuuguauugcccuuucuugacaggaaagucuaaucaacagcaugaccauagcuuuucuuuguauaagaccuauauguuagcaacuggaaugaccugcacagcugguuaaacauguaaacaccaaggcauuguguucuguauauacagguauaccucggagauauugcagauucaguuccagaccaccacaguaaaacgagucacacaaauuuuuuggcuucccagagcauauaaaaaguuauguuuauacuauauuguaguuuauuaaguaugcaauagcauuauaucuaaaaauguacauaauuuaauuuaaaaauacuuuauugcaaaauaugcuaaugauuuucugagccuucagcaacucguaauauucuugcuaguggagugucuugccucuguguugguggcugcugacugaucagggugguaguugcugaagguugggguggcuguggcaguuucuuaaaguaagacaucagugaaguuugcugcaucaauugacucgucguuucaaaaaagauuucucugaauccugcagugcuauuugauagcauuuuacccacaguagaauuucuuucaaaauuagagucaauccucucaacccguggcacugcuucaucaacuaaguuuauuaauauucuacauauuuuguugucauuucagcaauguucacaucaucuucaccaagaguagauucugucucaaaaaaaaaaagcaacaacaaaaaacacucuuauuacucauucagaagaagcagcuccacaucuguucaauuuuuuuuuuuuuuugagacggaguuuugcuauuguugcccgggcuggagugcaauggcgugaucuugguucacugcaaccucugccuccuggguucaagugauucuucugccugagccucccgaguagcugggguuacaggugcccaccaccacgccuggcuaacuuuuuguauuuucaguagagacagcguuucuccauguuggccaggcuggucuugaacuccugaccucaagugaucugccugccucggccucccaaagugcugcgauuacaggugugagccacugcgccuggcccaucuguucagauuuuaucaugaaguugcagcaguucagucacagcgucaggcuccacuucuaauucuguuucucuugcuauuuccacaucuuuagugacuacuucugcugaagucuugagccugucaaaguuauccgugaggauuggaaucaacuucucccaaucuccuguuaauguugauauuuugaccuccuauugugaaucacaaauguuuuuaaugacaucaggaauggugaauccuuuccaaaaaguuuucaauuuacuuugcccagauccaucagaggaaucaccaacuauggccuuacaagauguauuucuuaacuaguaagacuagaaaucaaaaugacuccuugauccaugaggugcagaauggauguuauauuagcaggcauaagaaaaacaugaaucuccuuguaccucucuaucagagcucuagggugaccagaugcauugucagugagcaguaauauuuugaaaggaaucuuuuuuucugagcaguaggucuccacaguggguuuaauacaccaaguacaccauguuguaaacagaugggcugugauagaggcuucauuguuccauuuauaaagcauaggcagaguagauuuaccauaauuccacaggcccuaggauuuucagaaugauaaaugaacacuggccucaacuuucagucaccagcugcauuauccccuaacaagagagucauccucuucuuugaagcuuuguuuucuuuguuuuuuuuuucuuuucuuuuuuuuuccuuuuugagacagagucucgcuucguugcccaggcuggagugcagugacaugaacuuggcucacugcaaccucugccuuuuggguucaagcaguucucccaucucagccucgugaauaacugggauuacaggcauggaccaccacaccuggcuaauguuugaagcuuugaagccagacauugacuuauccucucuagcuaugaaaguacuagauggcaucuuuugccaauaaaaggcuguuucaucuauuagguugguguagaaguaacuucaauggcaaaacugccauuacuuuugcaccaaccaaauacauugaaaauucauuguuuguuguagccaucuucauugauugucuuagcuagaccuggauaacaugcugcagcuucuccgucagcacuugcugcuuuacuuuacacuuuuauauuauggagacggcuucuuuccuuaaaccucaugaccaaccucugcuagcuugaaacuuuucuccuuuagcuucuucaccucucucaaucuucauugaaaugaagagaguuagggccuuguucuggauuaggcuuuggcuugaggcaugcuguggcugguuugauccuguauccaaaccagcaaacuuuuuccauaucagcaauaagguugauuucuuuuuuguguguucaucggaguggcacuuuugauuuccuucaguaacuugacuguuugguuccagaggccuagcuuucagccugucuuggcuuuugacaugccuuccucacuaagcuuaaucuuuuuuacuuuucaaacucugcauguagcauuugacuuaaucauuucuaaauuuugacuaaaagugagagaugugcaacuuuuccuucucccugacuauuuagaggccauuguuggguuaugaauuggccuaauuucaauguaguuguguuucaaggaauaggaaggcugacacagagggagagagaagagggaaugauugaucaguggaacagucagaacacaugcaacauuucuuaaguucaccaucucauacgggcagaguucauggcaccccagauaaauuacaauaguaucaucagagaucacugaucacggaucacuguaacugauacaauaauagugaaaaagaaauguugcaggaauuaccaaaaugugacagagacaccaaguuagaaagcucuuggaaaguagugccgauagacuugcucgacgcaggguucccacaaaccuucaguuaguaaaaaacccguaucugugaagagcaauaaagcaaagcguaagaaauccagguauacccguauauggaguacugaauuuuugaguggcaaaauucucuuuacugguuaugaguugaccuaaguguugauccguaugagauuucaauaguagugucugauuaaaucaagggaagacuaaugcuuuccaucucggaugaacucaguucuuacaauaggcuuuggucucuuacugggcaauucagugguucacccauacgauuaucucuuuguuaacaagugaaaauguaagcuucagcauauucacauacccuauucuaaacuuaccaaaucucuuucuuagcuuuuuuguucugccugucgaguucuucuugacucuagagagguaccuuaaagagcuuguacuaaauuuauuaauguaagaaacuaccugacaauuggauccaggauuguuuuguaauuccguuauuggcaggaguuuuugugaaucccugaauauaguuuauggaaguccaaacuuauauuuuauucauuuauugauuaauguuuacuaugaucugagauguacuguauaggaagguacaaaacagcuggaggggcaggauccaugucuacuugagacauguauaaaacaaagauuacauaugguuucauacacuaaucagugcuauaaugauugauagauagaggaauggagauaugugaucaauauauagauacauggaagaauggaggaguguguauuuauacauaauauauacauguauauguaucauuacugggguacagacaaugaucagguuuuucucuugggggugagggcaacagacuguuccuagaggagauaauguuuaucuugcauuuugaaaaccacguagaaaaaucagguaguucuaguaucagcucaagaggagauggugauuauauucuccugcuucauuucucuccauagaacuuaucucugcccuacacuauguugauucauucauuuguucagucacucauucccucccuccaucauucauuugucuaccuuacuagaauguaagcuccaugaaggcagggauuuggucuguuuucauuacucuguuuccucagcaacuggaaaagugccugaucuauggugggaauuugaacuccuguguauauagugaaugaauaaacuuugugaguaguugguuuauuuauaauuuuccuuuagcuuauuaaggauagcuccuuagaauuuccucauaguuugcuugauuuuuuaauuauacuugaauaauaauuuuuauuguacuugagucuccuuguacuugagugauaacaugccgcuugcuguacuugagugauaacaugcuauuuccacaguguuaucucauaguauguugaguccccaucaucuuaccugaacugauacaaacucuaaugguuuuccaugucuauaugcgaguccucuuaaguuuucauugaaagaucagauccuugcaugcugacacugccaacacugguacuguuauuuauuuaaaguacagaacuggccagaccacuucugugcuuaaaaaucucuaagggcuuccaucucucuauaauaaaaucugugcuccuuagguuggcacacaaacuguuuuauagcuuggcuucagcuguauaaugaugcauuuucuuaccaucucaugguagaauaaaaaugagucuauucauuuuucuuuuuuuuuuuuuuuuuuuuuuuuugagacggagucucgcucugucgcccaggcuggagugcaguggcgggaucucggcucacugcaggcuccgccucccggguucacgccauucuccugccucagccucccaaguagcugggacuacaggcgcccgccacuacgcccggcuaauuuuuuguauuuuuaguagagacgggguuucaccguuuuagcugggauggucuugaucuccugaccucgugaucugcccgccucggccucccaaagugcugggauuacaggcgugagccaccgcgcccggccucauuuuucuucauauccauagugucuggcauguaauacagaauucaacaaacguuuuuugaguaaaugaaugcauguaaguguauaugaaugaauggccacaaaaauguuugcugcuuagauaaaagaugauauaaguaaaugaaugcauauaaguauguaugaaugaauggcuaagaaaauguuugcugcuuagauaaaagaugguguaaaacuaaccuaacacuagccuuuaagaacacagucuuuucuuuauauagcugauuugucuuuuucacuguuuagcugcucuauccucuguccucccuuuauucuuugugaagaaaucccucuuggcauuuacaaugucauuuuagaaguaauccuaguccucauggcuuuccucucuacauggccaucucuauacuggaucuuuucugcuagcuacuuuucuuauuuuguuagggaugugugugugugugugugugugugugugugcgcgcacgcgugugcgcgcgcgcauacacauguguacuuuuuuuuguuuugccuacaaguuccuacaaauuuaauuugccuacaaauuuaagguuuugcauguaauucugaaacucuuaggauuaaaugauuucuacagaaugcacacacacagacaacccugagcuaucuguuuucaaauugaaaugauuuugauugugcuauuguuuuuuuauacauguccucucuuuucccuuaaauauuuauguacauuuagauugaaaaucuucaagagcagcuuagagacaaggaaaagcagaugagcagcuugaaagaacgggucaaauccuugcaggcugacaccaccaacacugacacugccuugacaacuuuggaggaggcccuugcagagaaagugaguggcuggccccaacucuccacacacguuuucugcuuucucauuaaucuaagacuggauauagaauacaaaagaaaucccugugggcacaagggaaaagagcugcugugugcuauugcugacauacguagugugaagggaaacauuuuuuuuagauggagucucacucugugcccaggcuggagugcaguggcgugaucuugucucacuaaauuccaccucccagguucaagcgauucuccugccucagccucccgaguagcugagauuacaagcaugagccaccaugcccaaguaauuuuuuguauuuuuuguagagacgggguuuugccauguuggccagacugguuuugaacuccugaccucaagugauccacccaccucggccucccaaaguguugggauuacaggcaugagccccugcaccuggccaaauugcucugauuuucaaacuucuugaguaucuguugacagaaaguuuugaugauuucucuuuucuuuaccuuccuuuauauuuuaagcucaauauaucaaaaucuuucccauuccccccuuuuuuggugugugaguugugaguuguuuccauugccuugugggcaacaugugaauaauauauagagaagaaauauuuguuaguuauuguccuuaggguguauauauaagcuuuuaguuaccuggaaauugaauaaauggaaauauugcaaaagaauacuuuagugauaucaaauacuaguugagauuauaagaaaagaaaccuugggauucaaaugaauaaaccuacauccuuguuauggcaagaugaauaagaaggaugaauuauuuaaaaaauguauucuggccaggcacaaugacucacaccuguagucuuagcacuuugggaggccgaggcggguggaucaucugaggucaggaguucaagaccagccugaccaacguggagaaacccugucucuacuaaaaauacaaaauuagccaggcgugguggcaugcuacuugggaggcugaggcaggagaaucgcuugaacccgagaggcagagguuauggugagccgagaucacgccauuacacucgagccuaggcaacaagagcgaaacucugucucaaaaaaaaaaaaaaaguggauucuuuaaaaacuuaccauugucuuuugaauauagaaguuugaaauucugcuaaaagcagaauuacagucauauaagugcaaaagggaauuucuucacauguugauauauucucucaucaggagcggacaauugaacgcuuaaaggagcagagggacagagaugagcgagagaagcaagaggaaauugauaacuacaaaaaagaucuuaaagacuugaaggaaaaagucagccuguugcaaggcgaccuuucagagaaagagguuaagcuccccaaaauggaauuaguuuguuugcuuaaucauugcaugugucuguauguugguguuuacauaaugcauauaaaaaaguauucgauggaaaauuuucuuaauauucuuuuagcaggcuuuuguugaauaccuuaaggaauauuucagaaagcuuugcagagacauagcggauugguucauucauuuucuaaguauuacucacuuuguuuuauguugguuuuuuacuuacuaauauuuuuauagaccuaaaguaacugaagcucagauacauuuggagaaauagugugcuaaagauaagaaaguugacagauaaaaggaauaugcaaaaggaggaaauuuuauguauagcaacuaucaaagaacacaacagcuauuaaauuaggugacuuaauauacuuuggucuuguuuuuggagaauccuguuaauaugaccuaaauagcaaagaugccucaugcuauguaaucagaugaugauaaugcaugagcuuuagcaucuuucuguggauuuucuuucuaauaucuuuaggcaauguuauggaaguuuaaauuccuaauagaauuuuucuuuuaauagggaaaaaugugauuuuuuuuuuuucuuuuaagagacugugucucacucuguugcccaggcuggagugcaguggcauuaucauagcucacugcagucuugaacuccugggcccaagggaucuuccuauuucagucuuccauguagcuaggacuauacgugugcacuaccaugcccagcuaaguuaaaaaaauuuuuuuuugugaagacagggucuugcuauguugcccaggcuggucuugaacuccuggccucaagugaucccccugucucagccucccaaaaugcuggguuuacagguaucuggccgaaaaauguuuucuguuuaaguuaacguagcuacugagguuugacuacuuacauucacaaagcuugaucuacuuugguuuauuuuguauugacagaacucuuuacaucacuguucaauggguauuucuugagaauccaucuuauuuguuaagaguugaaagcuagagcuaauauuguuuuauauuucaugaaugaguuuccuuguaaugggaguaugucagcauuugguaauagaaaggaaauuacagcuaccaugauaaauuuaaaaauuuaaaccucuauuuuuuuuaaaauuauuuauucuagauguguguuccuucuuuuaggcuucacuuuuggaucugaaagagcaugcuucuucucuggcauccucaggacugaaaaaggacucacggcuuaagacacuagagauugcuuuggagcagaagaaggaggagugucugaaaauggaaucacaauugaaaaagguuaaagaaaaaauuucacauuuuuuugcuuugccuuaaauaagaacauaguagauaaccuuagcauguuuauauggaauaauuuaccaauggaauaauaauccgccaaacuuuaaaauaccauguauaucugaauuaauuaucuuagcauucuuauccuacuuuauuuuauucaagauaauccccaaaucuuuaaaaauugacaguucagagaaagauuaaaauaugcaacucucuuguggguaaaauaugagaccagaguguaaaaaucucuguuaccugauauuuuucucccauuagaaucagacuucugccaggugugguaacucaugccuguaauuccagcuccuugggagguugaggugggaggauuacuugaucaggaguuggacaccagccugugccacagagugagaccccaucucuuaaaaaaagaaaaaacgguggcucaugccuguaaucccagcacuuugggaggccgaggcgggcagaugacgaggucaggaguucgagaccagcuugaccaacauggcgaaaccccaucucuacuaaaaacacaaaaaaauuagccaggcuugguggcgcaggccuguaauccuagcuacucaggaggcugaggcaggagaaucacuugaacccaggaggcagagguugcauugagccaagaucgugccacugcacuccagccugggcgacagagcaagacuccaucucacaaaaaaaaaaaaaaagaaaaaaaaaagaauaagugggagcauauuuucuaauuuaacauauguaguaaggucugagacucagaauaauuguuaaauauccuguuucagauuuuaucucauuuuggagaauguuaauuuccuagcuuuuuuuuuaaagacagggcacauauugucagaaaguuuuuuuuauuuguuauauuuuuaauuucucuuagcaacuuauugggccuagaauuuuauuaucuucaccuucuacauuagggucuauuuuuugguuuauagcuuauguguagauuuacaugaaggacuauuuggcguauuuucuucuuggaaacuauuacuguauuauuaguguucuaauuuacauuuuuucaaaagccugugcuuaucauugaaauuuuaaaaguagauuucuucucuguuuuguuuggaguaggaaaugacuggucuugagguaaugauaauuggagucauuuuugaccuauuuauagcuuaagaauguauauccuguaucugaauauuggcauuccaugucuucagcaugagauaauauccucagaauuuauugaggaaaggauugaaacucaacuuuugagauaucagauuuuuuugucuuuuuuucuuuguuuuuuagagacagggucuugcucugucguccaggcuggagugcaguggcguaaucauaguuuacugugacuucaaacuucuagguauaagugaucuuccugccucauccucuugaagagcugggacuacagacccaugccacaacaccuggcuaaguuaauuuugagacagagucucacucugucgcccagguuggagugcaguggcacaaccucggcucacugcaaccuccgccucccggucucaggugauucuccugccucagccuccagaguagcuggguuuauaggcgcaugccgcugugcccggcuaauuuuuguauuuuuaguagagaugggguuucacuauuuugaccaggcuggucucaaacuccugaccucaugauccacccgccucagccucccaaagugcugggauuacaggcaugagccaccacaccuggccuuuuguuuuuuuuuaaauagaggggucuugccauguugccuaggcuggucucaaaccccugccucaagagauccuucugccauggccucccaaacugcugggagcaaggccacuaugcucagccuugaguuaucagaauuuuaaaaaugcuuaaugcuuuuuuuuuucccuuguagagugaaauauuuauuucuauacucugauuuuuuuauugaagguuuuuuuuucaccauuuuuuuaaaccguuaauuuuguuucccuugauuaucuuacucuuaaaaccauuuucuguacuuuucuuucuuucuuuucucccugaugcuucuuacugucuuuggcauccuggaauaguguggagccacucauccaagccagugagugaccuagccaaguguugccagaaagucccaguugauaguuucuuuucugacuuuugugugaaugacauuuuuaucacccuauagauaaaugaauauacuuaaccuucucaccucucccuucccgaaauaggaacucuagguuguuuuuuuuuuuuuuuaauuuauauugaggugacuacaaaauagaaaggcuucucuaagaccaaaauuuuuccugagacuuuggaaacuguuugcauuucugcugcuuuuaccuuguuuuguuccuagugaguuaauucauucaggacugcuucucuuugcuuuuauuuccaccauguuguggcuuuuagccacaccaguuuaggguacaguuucgcuaacacauuaaaauauguuucugccaauagagucuuuuguaaaggccaugcuuaguaacugaauuuugacaacugaugaaaccugaaacaaaagaaauugguagaggacuuaaucucgaaaguaccucuauugcuuccacaaagcauuuaacaaaauuuacauaaauguuucucuuuugcucaaaguacuuugaaucagagcuuuccuaaguauguguguuuuccccuuuaauauuuuuugaaaccauuuuaagggacuaaauauguuuuguugcuuauugaauaaggaaaaaaacguguguuagucuuuacucucucauuaaauagguuauguggugaaaauguugauuucuaugggaauaugauuaucugcaugguuuuguaaucuuacguguuuuacuaugacauguaugaaauacaaaggaacaaaaucuuugccuccaguguaugaguacugagguuuuaauaauguuaaagguagguguuuuucaguagaacaaggccuguggauggagagcuuaaccuuuaacucaguauuuuaaggaggauuauucacuguuacgucagccucucuuguccaaaggugauauuuuauacaaauacuguuauuucacuaaaguuugcagcuuuugcuucugaauguucuugaccuuuucacauucuaaaagcaagguguauggaguaucugcauuuuuaaagcauagguuaacguauaguuagaacuuaauggguaagaaaggggagaagaaaaugaaggcaugaaauuaaacaccuucauccagaaaauaccuuucauauugauaccaugauaagugacuauggacagaagaaaugcuuacaucuugaauuaaaugucauauuccacaauuuagaaauccauuuuaucuucauuuauuuuuuugugacagagucucacucuguugcccaggcuggagugcaguggcacaaucucgacucacugcagccucuaccucccagguucaagcaauucuugugccacagccucccaaguagcugggauuacaggugugcaccaccaccccuggcuaauuuuuguacucuuaguggagaugggguuuugccauguuggccaggcuggucuuaaacuccuugccucaggugauccacccaccucggccucccaaagugauggggugacaggcgugagccagucacugcaccuggcuuagaaaucccuuuuaaagggauguuuauaacacugauuugaaaaauaugccuuuuuuugaguuuguauuauaauuuauaaaguuguaaaggucuuuaagggguuuaaaauucuuggaauuuuauuuuaaaguacaaauuaacucagcaagaauuuagauguaaacuacucugauacagaauuuguugucauaagggaagggaagguuuauaguaucuuugauuuuuuuuuuccuagcuugauuuauuuugucuuuaaagauugucauuuaguauucuuuuauuaucuuuaucauuauuauuuuauuuuuuuuuguagaggcgaggucccauuguguuucccuggcaggucuugaacuccugggcucaaggaauucucccagcuuagccucccaaagugcugggauuagagacgugaaccacugcaccuggccucauuugauauucuuaauaauauuccagcuacauuuaaucuugcacuuauauuuaauuacugauuaauuucucuucuucccaaucauuuuucuuuuccuaccguuuaggccuaugggcuguuuuaaaucaaauggaaacuagcacacugcuuuugcauauucauuuuuucuacaaauaauugaguuuuuacucugucaguuaccacacugugcacugaggauauauagugguggacaagacagaccugucccuugacuuauauaauuuauagccucuauuaagaagauagacacuuaaaaagguaauuguaguaaaucacauggugugagggaagcuuauaucaaggagaacuaacuuaggucaaggucauggagaaccuccuaacaaaagcgacacuuucuaagcugagaccucaaaguaaggacucaccagcguguaugaaggcccagaaugcugauaugcaguaguuauauuuauauuuguggaguuauaauaaauaauuuauaauaaauuauuagaaaucagaauuaucucagugacguuaaaugccagcuggccuucacuuuuguuuacacaaucaucuuuugugccccuacaucaagcugccuccuauugccuauuucgucaccuucuuucuucguagauacuaagaauuuucucaguuacuucugcuuuuguuugcaucuucaaucucuucgccuuuguuguccccucucuuuauguguaauaugaucagcuuucuauugaaauaucuccugaucuugguacuccuuauggucuucuucccucucuccuuuucuauuagauauauuuauagccuucuccugcccaugaaggauugacugcuacaggaauuucccuccuacaauuaacaacucaaaaacugggaaaccacgugaaacaacugauuuuagacauuggacaacauucagugcagaacagugcucucaucuuaccuuccaaacuuauaugauuuuuguuucuuaaaauauacuucauauguguaucaagguuaaggguuagggaagccuauauuuaagacauaaaagauuuuuuucuacacaugugaagccuuaaacaaaugaacuugggaaaggacuuaucuuaaaaguauagcuguuacuuucaccaagcguuuaauacaauuauauaaacauuucucauuuacucaagguacuuugcuucagagcuuucugaaauauuuccuaagaauauauauuuucuccuuuaauauuuuuucaaaccauuuuaagggacuaaauauauucuguugucuauugaauaagaaaaaauaaaacgucuaagcuuuugucuucucauuaaacacauuauacauacauggcuuuagagauuccagaagacagcuagggacuugaaaauuaguuuuuaauuauugaaacuguuuuguauuccaaaaugcauuaacaauauuaguugacuuuuguaggauccugaauaaaaauuuuuuucucagaucuuagugugguucuuucaaaaaaauuuuucuuaaacaauuuuuuuuuccaauagagauggggccuugcuguguugcccaggcuggucuucaacuuauggcugcaagcagucccccugcuugggccuccuauagugcugggauuacaggcucaagccacugagcccauccuuaagugugguucucgauuucugaauucauuuguuugucccauauuauuuuguaaauucucuaauccuugcaugagggagguaccugugugaugguagcagcuguuuucuuaaccugacucacauuuuuauggcaucacacucccaguaucuguuugauucuagaugcccaaggccaugugagucacacguguuagguaaagcagcauauaggaaauggaaauggaaguuagggucuagugggaguuaggucucugcacugguccggcuauacgaucagcagugagucccugguguugccuuuugauauucucuuggagagaucaauaacaacaguucaaugacuguuaguuugucucacuaaacucugaagcaucuuuugccuuaugaugguguuugauuuaauaauauucagagauguguuauuuaaaacaacuaaucuacuuggaaccuaagauaauucuccauuuauuacuaauauuugucuauauaauacuuaagcagauaaaaaccuuauaaauuacaaacuaacugguagauauuugauaauucuguacuuaaauuggaauauaaaucauuguuugggacaugguuugcccauugccaccuguguguaucugauaggauugaaaugcuuuucuuuguaggcacaugaggcagcauuggaagccagagccaguccagagaugagugaccgaauacagcacuuggagagagagaucaccagguacaaagaugaaucuagcaaggcccaggcagaaguugaucgacucuuagaaaucuugaaggagguggaaaaugagaagaaugacaaagauaagaagauagcugaguuggaaagguaagaaagugaagcugauuggggcuuaugagguuaaaguaugguuuuaaaaguaugcuuuuggggacauacuuuuucaguguaucuaacucugaauuuagguucucgaauucuugcuauuacuguauuagcugccuuuuuucuaggucaguuguacguucuuuguugaggugucugaaaggcaacauagaaugggaauaaauugggaagcuaugggcuguaacauaauugauuggcaaaaaagagaguauucauuaauuuaaaauuaaaguuuuuuuuacuggcaaaucaagagaggacaaaugucuacuuuuuaauuucucuauauaaugaucaaaugauccucaagcaaaggaguuaaucuuuuaucacuaguuuagaccuuuguuguugagcuaaugcucuguugggcuauaaauuuuuagacuuuucacaguuuuuauuguugaaaagcacgcuguuacuucagugcauuagaucaaaauuaggaggagagacacuuugaggacaauuuaggagccacggauauguuuuuuuaugaagcugucucugacuuggaauucuucaaaauauucuguguuugaacagaucuaggcagacaggucuccuauaauuuuuuugguguguuuucuuauuauuuuaugcuaaaggucaagcaugugccucuugaccucuucuuuuacaccacauauuuaacauaaauguaaaacugugcagaaacaacucugccgguagaacuuuguuaauuaccuguauucugaacagccagaaagacugacagugacagaaaggggucacuaaucuacuuggccuuuugaggacugauccuuaagaauaauuuuuuuuuuuuuaugaucuugaaggcugagaaguauuagaguacuuccauaaauuuuuuacuaaguuuuaaaguuuugggguuagugguagacuugauacuguccucugaagguauuauuuuuuccuauucuauagucauagaauuuuaauuuucaagaaaccaaaacuauaaagucuaaccuucacaguucuccuucacuguacugaaaguguaaauaacacgggcugauuaccugcucacuuauuuccucuuauuuugguauuaacucuacucauuuuguucaguucugaauaagauauauggauaaaauucuuuaagucagaauuuuaaaauuaccauagccucaagauuagauuauguacauuuuuuaugucuucauuuuugcacugcacccuuccccacaacacacacauguacacauguguauauacccccucacccauuacgugcuuacgugaauacaugccucucuuugcuuuuggaaaggcuugaaaucugcaacaguacugcauagauacaaaaaugcggugcuuuugauugauuagugacuucccacuaaauauauuucagaaaagaaauuccuugaauaaguuuuauuuuaugguuugauuucuuauuagaaaucuacauuugaaauuauugcuugcuauuucaggcagcuugcuugaaaauguuuuugacucauuuuugucaccaauauugauuuugggagauggaugugaacugaaggagaguaagaaauaggacuaagucuguacuugauauccaaagcacaccaaauagcagcuuuuauuagccacuguauuucucacauuuugagaaagaguuguaaaugaucuacucuuuccacagaauguaacucuuauaaaaguuggaaaaagcacuguagaguucuguccucuggcccuauugcauuauaauuucguuuuaggauucagcacaguuucuuggcuacuggaaaaaaaaaaaaaaggaacagcuuucauaacucagcuuuugcuaccagguuuguaguuugcuacuugguaacauaguuuaagaugcugaauaaacaguagaaucauggaauuugugaaagugaucgagcauggcauuuuauggaagaggaaacugaggcccagagaagucauugcugaagugacguggugguugagccagagcuaguagaaugugguuuguaaauuccagaucaauuuucuuucuguucugccaaggcuaguuauguuccuuuuggacuuccuggcaacuguuauuugaagacuccuuacccuuaggugauuuauucuuuuaccccauuuggacccaaugucuuaaguagaagugguuauauuuaguauuaugacuugcuuacaaacuaagguagauuuuaguuucacuuaugcccuugaaugccauuuuuauaaacugagcucugcuuauuuuaggagauaaucagugcauucuuugucaaagacaguugggauuauguuauaccucuuguucccagauuuaguacucguuugcauauguguggcugcuguguuucuuacuaaucauuugcuuccuauguugccauuccacuauuuccuaugccugugucugucucccuauaguuuaucauuugagauucuucauuuuucuuuuugucuuaccaugguccuguuccauugggguuuuuggcgucuguguguuuauauguauaugcuccuucugccccuuggccauggcuguuucucagaaagccagucucgugcaaauuguacccuucaugccagguuucugucccuguaccaucaggggguuuuguuugggacuuccugggaaagugagcauuaaguaagguuacagucuuauacuagagugaauugcuacugcugcuuuugcuacugcuggggcuuguuuggaauuuugcuugaucagaguuaaagaacagcugauuauaugucaaguugaacuguaccucuuuagguacccuacuuuuugauauaaucagucuguguucguucugguaaacuucugauauugcuaguugugauugcuuuagucuuuguuuuacucuuuaaauaguuccucaacuaauguaacuguagugccacacuguagauucagcauguagaauuaauuucuuaaggguguucagcaacccacuaagugcaaaaaugaaaggagacuguuacaauaauugaacucaagaaaauccuuaguauucuuugcauuuuauagugcuucuuauaaaaggaucuccaauauuaaaugguucagauuguauuaugaaggauucccaggccuguucuuugugaucuaaagaaauaaauaaauagguccuucccauguuggcuguuacagaaaauaagaguucuugucagaagaugauuuaguguuguccuacucucuugacccacugcaauuuuaaaaagaagauuggauaagcccauuaauacaucuauaaauauaaaauauuuuccccaauuaaaucuuaagaaguaguacuucuaaauucauguuccauacuguggugcauauuaguuggaauucagugagaagcagaauuaguaggauacacacacacacacacacacacacauagagauagauaaauacauauauacacacauauauaaacacacacaagcauacauauauuaugagauuuauacguauauuuauauauauuaauauaugccuacauauauuaagagauuuauuacagagaauagucuuguaaaaucguggggcuggcuaagcaagacugaaaucccuguggcaggcuaucaggaagagaagaucgugagcaggauggaaccuguugcaggcacaagccaaagcugugguccacaggcagaauuccuuuucucuccugggaaaccucagcccuguuuuaaaaucuuuccaaaggauucauuuauguccauugggauuaucuagguuagucuuuuuuacuuaauuugauuagaggcuuuaauuaugucagcaaacuaccuucacaagcaccaucuagauuaauauuugauggaauaacugggcacuguaacauagacaaguuaauauuucaaaaaagucaucaucugaugguucuggauaguauacaaauaaacaaacaaaccagagcuugaaaagucguuagauaaguaaauaaauuuagaguagccucaggaacccugaauguaacugcaaauuucucuccuaaaaugagcauauuagaguuucuauuuagauuaauagugaguaggcuuuucuuugcuaucauguuuaaaauacuuagaguggcugggugcaguggcucacgccuguaaucccagcacuuugagaggccugaggcaggcggaucaccugaggucaggaguuugagaccagccuggccaacauggugaaaccccgucucuacuaaaaacacaaaaauuagccaggcaugauggcacaugccuguagucccagcuacucaggaggcugaggcaggagaaucgcuugaacucaggagguggagguugcagugagccaagaucaugccaucgcccuccagccugggugacagagcgagacucugucucaaaaaaugaauaaaauaaaauaaaauaaauuaaauaaaguacuuagaagcguacuggaggcugauacaggauugcuugcugucugcuuuuucacucacgcuguccaucuuagcugaauguucccauguuauagcaccacccugggaacauuguccccugugccguauauuguauugugccuuauaauuuugcuuuuuaaugugcuuuguuaccuuuuuucuaauaccaugacuaauggauucacagaguuuaguguuugcagcagaaauacucaauuuuacucuaguaugagauuguuagauucaauaugccauucaaaacuuguauucagagaaugacaaccaucugauuuucauauaauuuagauaacagagguugccuuugguuuaucaaaguuagaaauuuucagugauccaaagaauaauagagucuauuauugugugaucuaaagauuaauaggaauuguggauuuacuauauuuccugauuugagggaauauaagaaccgggauuuuaauggauauagauuuuuugggggcggggggcaggguguguuuugaaauucagccaagugauuauuuaugggauagucgagaaagaccugucugauaaaguuauugauauaugagcagcgauuugaaggaggggcucuauaagaaguccgcagaagccccuaaaaaaaccacaacaacuuugaggcauaauuuacauacaauaaaaugcacccauuuuaagcugauuguuugagcuuugacaaaucuauacacuuaugugacuaccaccaugaucaagauauauagaacauuuccucauccccaaaaguucccuuuugccccuuuacagcaaaucucuucccaacccuagucccagccucugcagaucugagaccuacuuuuaaaauuaauuuuauacauuaaacuucaguuucucccuuuugccuuaacauuuaauuuucuacuuucccauucuaacacaaccacaaguauguguaauucccuauuuccucagcuccagaaguagauucagauuuuuuaaagccaaucaggauaauagcauucucuuucuuagugacuaguuucgcauugagcacauaugcauuagugauuggaaggaaaaaccacagggaggcuucugggaaugauuuucuuauaagacagacuugcaagaagaaagaugaccccuuucuccugaacauuaucuugucgggaugugauacccauaauugcugcagcuacuucugccaaccuaagaugaagccagcguccagagagugacaguuaacaaaaccucagcaaagcagaguuggaacugaaauggacuauuccugaaacugccucugugcugcuuguuaugugagauaggacaauuucugauuguuuaagccaguuugaaugaggauucuccguuacuuccaacccagugcauucaaauggauauaauuauguacuuauuuccgccccccccccccuuuuuuuguaauggaagcaaucauuuugaaaagaguuaaaguuuuuugguaagucaaauaaggaucaaugcugcugaaagcugggacaacacacgggcccugaccaaauugggguuucuuugucuaccucauaccuuccaaaucaaaaaauaauuucccuaguauuuuaauuacucccccaaaucaggaauaacuuccucacugugcugauuuugguucuuuuaaaauaaggugguaauuugaagguaauaguuaaaccagucauagauuauucuaugccauucuuuucaaaucagcccacucaggugucaguccuacuuuucuuuuguuguaguccucuuuauucuccuuuguuucugccuccaccucaucccccacccaaaugccuggaacagaucucacccuuucgucuuuugagaggaauacauauagcagauuuuugccuccgacuaggcagcuacuuuaaagggggauguauuuugaaucuaaggaagauacccaaaaauuuuaaugcaguuuguuuaguuauauuuguucauuuuagcugcccugucuacaucaugacuuuuuggguuggggggguauguguuggaaagguuucuuauguagguuuuuuuuuuuuuuuugacagaaucucacucuguugcucaggcuggaguguaguggcgugaugacagcucacuauagccuagaccucccagccucaagcgauccucccaccuccgugucuugaguaggugggaccacaggcacacaccaccaugcccagcuaacugcuuaauuuuuuuguagggcuggugccucacuaugcugucuaggcuggucuugaacuccugggcucaagugauccccuuggccucccaaagugcugggauuacaggcaugagccaccacaccuggugcaugugcgcacgcuauuucucucucucucucucucucucucugucugucucucugucugucucucucucacucucucucucucucucucugucugucugucucucucugucucucuacacacacacacacacacacacacacacacacacacacacacacacacacacacacauauauauauauauauuuuuuuuuuuuuuuuuuuuuuaagacagauuuucccucugucacccaggcuggagugcaaugguaugaucucagcucacugcaaccuccaccucccgggcucaagcgauucuugugcgucagccuuccgaguagcugggaauacaggcauacaccaccaugcccagcuaauuuuuguauuuucaguagagaugggguuucaccaucuuaaccaggauggucucgaacuccuggccucaagugauccgccugccuuggccucccaaagugcugggguuacagggaugaaccauugugccuggccuagauuuuuguuauacagauguuugagguuaaacaacugguccugcauuacauaaguagguagcagagucaugccuaacaauuccagugucugucucuccuuccugaaaagaaauccuuuucagguguucaguuuucauuaaugaccucaccuccuagaagaggaggcuguagacagcuagaugauucagagucuguucacuugaggaucuuacugaggccagagucuuucccacaugcuggaaugcccacuuacaggacagguacugcauaacuggcauguggguuguuuugcugcuaggggccaguuuuucuacacaugugcuuuuuaaugcuucucucagucuggacucaguuaagggauacgucuggcucaaagagacuaagacuccaucaauacagaagcuauugucauuucauuuauagauuaugcuagcauuggcguuuaucuauagcuugucuaauagcuagaaauuccagugaugaaauuuuaguuccuuaaggucugguugagcucuacuggaagguaucacuuaacauaccacagaggcuggucaucccaguuaucaugugcccagaauguaguaguaucagaaagaaaggacuuguugaacuuuggacuauuuuuuuuguuuuguuuuguuuuguuuuuguugcuuuuuuuuuuugaggcagggucucucucauccaggguggagugcaguggcacuaucacggcucacugcagccuuaaccucuugggcucaggugauccgcccaccucaaccuccuggguagcugagacuagaggugcaugccaccaugcccaacuaauuuuuguauuuuuuuuguagagauggguuuuugccagauagccuaggcuggucucgaacuccugggcucaagugauccaucugccucugcaucccaaagugauacgauuacagaggugagccacugcagccagcccugaaauuuggacucuuaagucuuuggucuuuccauguucgaagccaauauuaaaugauaguagcuugggagguuauuugguuggaaggcuaauaaguaauuuuggauccuaaacuauuaauacuaauuucagguccuccaacucuaguagagagauacagaauacagagggaaaaccaaaauauugcacugcuacaauuauucugagaaagauagaacuggagaucaguuuuguuguucguauauacauaaaauucuuagggcuagccuugugaguaguuaugauggagguaacuuuguuuuucuauuuuguggugguuaauuuuaucuucuuugcuaaccaucuuuuccauaccucauuguauuaguucguucucaugcugcuauaaagacauacuugagacuggguaauuuauaaagaaaauaguuuuaauuggcucauguuucugcgggcuguacaggcuucugcuucuggaguagccucaggaaacuuacagucauagcagaaggugaaggggaagcaggcacauuuacauggccggcaggagagagagagccagcaaagggggaggugccacacacuuucaaacaaccagaucuugugagaacucugucacaagacagcacuagggggauggugcuaaaccaugacaaaccaccgucaugauccagucacuucccaccaggccccaccuccaacacuggggaucacaguucaacaugagauuuggguggggacaaaccaccgucaugacccagucacuucccaccaggcccuaccuccaacacuggggaucacaguucaacaugagauuuggguggggacaaaccaccgucaugacccagucacuucccaccaggccccaccuccaacacuggggaucacaauucaacaugagauuuggguggggacaaaccaccgucaugauccagucacuucccaccaggccccaccuccaacacuggggaucacaauucaacaugagaguuggguggggacaaaccaccgucaugauccagucacuucccaccaggccccaccuccaacacuggggaucacaguucaacaugagauuuggguggggacauagagccaaaccaugucacucaucuggaacuauuagcucuuggcuuuuacaucaugauuaaacuuuaauuuuguggacuaccaagacaaccuaguguguauuuauaguauuguuuuuaagggaguuauauuuugauuuauaaacaacugacuuuguuaaaaaaaaaauguuauggccaggcacggugguucacgccuguaaucccagcacuuugggaggcugaggcggguggaucaccugaggucaggaguucgagaccagccugaccaacauggugaaacccugucucuacuaaaaaauaggaaaaaaaaaauuagccgggcaugguggcaggcaccuguaaucccagcuauuugguaggcugaggcacaagaauugcuugaaccugggaggcagagguugcagugagcugauacugugccauugcacuucagccugggcaacaagagugaaacucccaucucagaaaagaaaaaaaaaaaaaguuaugugaucuguucauaggauuugggcuaaauucugagcauacuaagaacacccuugauuaaaaacaaaaaucaacaagauuagcccaaauccuaugaacagauuacauaacuuuuuuuuuuuuuggaacacaaagaaugaaugaggucauuuuccuaucaugccaguagugauuuuuaaucugggaguguuauuugcacauguguauguguaagagaaagagaacuuuucugauggcauuugggaaaauagcugccaggcuucaacuuaaugccuaaagauuauugccuuuugaguuuuuaaauuuucuuuuaaagauuucacaacuaguuucuaaaauuuuuauacaaugaaaauggagguuuuuauuuuucauaaaucuucuaaaauguguuggcaaacuugaacuaguuuauaggaugauauuaccaauuuuuggcuugauagcagucaaauuuugaagaugaaugcuuuuuuucuuaucugucuuuucuuauucuuuucucuuugacugaaaguuuuguucccuuuauuuguuugugggaaucugaccuauuuuaaauguuacuuuuuuugaaaaagaaaacuuuacugaccuccuuucgcuaguaaucucucuuuccuuuacuugugcuuuuccaguaguaacuaucacauucuguccugugacuguacauuagagagaccaauguauauauguuauaaaagagaaguagcacucuuuucucauucugcuaucuaaucaucucacauuuccuuuucuuuuuuuuuuucugaggcggagucucucucugucgcccaggcuggagugcaguggcacgaucucggcucacugcaagcuccgccucccggguucacaccauucuccugccucacccuccugaguagcugggacuacaggcgcccgccaccacagccggcuaguuuuuuguauuuuuaguagagaugggguuucaccguguuagccaggauggucucgaucuccugaccucgugauccgcccgccucggccucccaaagugcugggauuucaggcgugagccacugcacccggcccacauuuccuuuucuuaccauugcccauaauauucagacccuuuaggaguuaaaaagagagauucaguagucucccauaccuugauauuauauugaaaauauuuuuauauuucuuuuauauguacauaguauguuuacacauguacauguuuauauaugcauacauauauauuugcacguuuuuccuucuguaaaaauguaaguacauucaucugccuauauucuuauacaauuuaauauaauucaguugaauuacuuuuagauuuguagauuaaacaaaaguguagauaacuuucccuuucuccuuuuugucacaaugaaaugccauuucugaccuuguuuuuguauuuuaacaucucugaaauugggauacacguacaaguaaauggcaugguauaaucuaauugguauaacuuuuuuucuuucucaguaauauaaaauacuuuuuacuaugaugugucuucuauccuuggugaauugauguuaagaaugcauucaaagagugaauaaaauuguuuuguugaaugugggaguaggagaaaguaguauuucuaaauuaauauuauuuugucauauauuucauuuuaaauguacguguaguaaccaagugaauguauuuacuaguauaaauuguaaauuagauauuugacggguuuaccuauaugcugaguuuguuuauuuagguugaccaaaaacgguuucuuuuggaccaucuccuuggcaaaaugggcuuuaugauauuacuuuauguuaguaucccauuauauucaggcaucuguugcauaguguaacccggaaauguaaaccuagguauuuagucuuuauucugguaaauauuuuuccuuaaauuuugaauugauagucauuuacugugucuucaaagaucuaccauauagaaauuaagccguaugcaagauugacauaaacugcuauauaauucaugaggaaagugucucuuuagagaaaaauauucuuacuuuuaaauuuauggauaugcaucuucaauccaugaaguauagugucagagaauaugcucuuaaugugguuagaguggaagagagaugacuggggcugcggaugguggcucagaguaauuauauaauauguguucuugcuugagggagaauggucuguguuuaaaaaaugaaaaaacugaaaaggaaaagaaagauaccagcauauuacaacugaagaugacugguucuuuaucugauccugcuugcuucagcuugcuuucuggggaagcugcuuguuucuuucuucuuccuccuugaugaauaucauagacuuccuuuaaaaggagaguaaguuacaaagcuuuuuguagucaguucuguuagguuaucuucccaaaguuuccugugggcacagcaccuuauaguuuguuacuguggucuuacaggaaucuguguuuaauggcuacuguaguguuucaccuaaaaguauaaagauuaggauuacauauaauucgauguacagauuuuuucuccugaaguuauuucccaagaguuacaguuuagccggacgugguggcucaugcuuguaauccuagcacuuugggaggugaaaguggguggauugcuugaguccaggaguucgagaccagcuuaggcaaguggcgaaaccucgucucuacaaaaaauacaaauauuagccaguuguggugguguuugucuauagucccagcuauuugggaggcugaggugggaggaucacuugagucugggaaguagaguuugcagugagccaagauugcgccacugcacucuagccuaggugacaggugaaacccugucucaaaaaggaaaaaaaaagaguuguaauuugaugcuaaagugaaauaugauucaugaauaauaaaguagguaaaaauuaaauuaauaauuaaaguugcucucuggcaggaaugcauuccauuuuuucccauggauuuacccguguguuauguaaaaacuugcauacaaagaagacucaguuaauguccuuguucaucuaaaauuauuuugacuuccugugucacaaccaaugagauagaaggaucauugggaacaaucauuuagagaucggcuucuuucugccuuugaacauugucugcauuuuacacagcguuauagaugcuaaacguucauggaguuuuauagacuccuaaggaagcaucauaaaacagauaaauuaugcccaggugagaugucagcagaccuacauucuuacucuuuuugagacggagucuugcucuguugcccaggcuggagugcaguggcacaaucucggcucacugcagccuccaccucccugguucaaccgauucuugugccucagccuccugaguaccugggacuacaggcgugugccaccacgccuggcuaauuuuuguauuuuuaguagagaugggguuucaccguguuggcuaggcuggucucaaacuccugaccucaggugaucugcuugccucggccucccaaagugcugggauuacaggcgugagccacugcgccugcccggcugcuacauucuuauucuguaucugccacucaggcaccaugugauugccagcaagucguuuuguuucuguuuuucaucucuucauguuacaagguaacaaaucuuguccuucuuaucuguuuuuauucucacaaugacuuuuuaaaacuuguaaguacugaauuauacuuuugcaagacaucacuaagucuuagaaaacauuaaaguauaaauggaaauggugcuugcauucaagaaauagauauuuuguuucagauucuuaagguacaauuuagaccaugaagcuaauccagaugauacuggucguuagaagcccuaacuauuuggaggaucauacuaauuacagugaaacugauuacuuuuugaaaagagaaaaacugcuuguuguuguaaaagacaguaaugaacuguaagggcuacaugcugugcaggaauauuaagcaugacugcuuuauaucuccuacugcuaagcagcauuggaacugaauugauguaaacaagccuguguauucuuguucauuauugcuuuuagauugcaccauuugaggauugugguagauuuggagugagaaguacuaguuguuauuaggagaaaauuauguuuuaacauuugagaaaauuauuucaaguacauuaaaguucuguauucuacagaagcuguguuuuucugcuuuugcuuuuagauaacuuggauucucuuaauggaauggggugguuaaggcguaguuaguuauaaggugggugucuauaaaacuaagcagacuaaaauugugcaguuacuuaaagccaacucugacuacuuaaaugagaaugagauggcuaaccuucucuauuuuucuuaguguuuaagaaauuguuuuuuuuuuccugccccaggaaaugguaaauuuuagacaacuuuuuuuuuuuugagaaacuuucauuaaaauacaaugguguaaucuaauaagaaaguaaauuuguugagaguugaaaaucugaaauaauucuuuuuuagugacuguauagaauuugugacuccuucccuucucuaauccugcauuuuaugauguccaugaauaauauuucugaauauuguccuuauuaauucuuucuaacuuucuuuuucacauuuucuuccuggauuuccuguuuccuucagucucaccucaaggucaguaugcuugcacuaaaacaaagaugaugugauugagcguuguuugcgaauauugucuugaauucuuacagggaacugaacauauuucaggagagggauaucuagaaaucuagcugugaggauaaaaugucaaggguauuggguuuaucagaagaguguguucagauuuuugugcuuugaaaagguagugugaguagucagagagcaagaaccagauggccagguuuugacugagagagaaguggagaugaaaagagcauuacgaggaaagaggaggggaaaaagaauuguguuaauguaauugaacauucaguggagacauucuggcuauuaaacgggguaaagugccgcaaaaaugauggagggaaagucacaacugccuauagcuuuauagaagaaaccuugaauuauuuacugagacgaacuuucagacacacacacacccacauccuuuaaauuuugguuucauuuugugacucugcugggugguagaacuagugauaacaaaaacagcaacgauuacugcuauuuauaugugccagaggcacuguagcggaacauauuuuguuucaguugaucuuagcaacuaugaagagagauuuauuauuuugauuuuuuaguugaaaaagcacaagugcagagaccauuaaguaacuugcccaucuucauuaguaaguaaauagugagagaagcggcacaaaacaaaaaucugcauuuaaaaaguuacuuauuuugcauaugagccaugacaauauaaagugugaggauuucugauaggauucagaaaugagccuguuaauaucauauguguuuuaccuagcagcugccuaauaauaauagcgauuauauauauguguguguguguauauauauauauauaucuguguguguguguguguauauauauauauauagauauauauuugcuguuuauaaaagcaccucuuugacucaacagcuagcauauggguuacacugggauaaguguuaaaagaguuagcccgccaaaaaagaaaauaaauugaaaaaaauuuaugcccccugcccauuuugaguaagcuguauucauuacagaaggaaucuuaaaguguuuguaauaaaaauagcaaacacaaauacugcauuuaaaaaauagauuuucccguuucuaaucuaaacauuuucuccacauauuguaguagaacaguauggguaccacuuaaguaauuccaauuagguggcaaaaucugaaagcaguugaguuuuaguauaaaaauuucaugaaguguuuugccuuguguuuagagaacuuucaucucuaacuuaagcuucaagcugacucauuuuagugggaaguuuuaucauuugucccauaguuaguccuuugcacgacugguuuugcucucagucucucuaaaugaaacccugggaaaagcuucagaagaauuugaccgugaagccauugguauauacauaauucacugaguuacagguuauauuaauuguaauauuguuagcugguuuauuuuaguuaacuuuuacccagcagcaaaugccauuaaaucauacuuauuucuaaauaaguuuauuuuccaaggaauacaaaauaaaauagucauuguuuuuucaguggcaaagaucaucuuagcuguaguaugcaaaaguuuaaagucucucuucauuccagauuaugauuuagugcaguauuuuuuuucuagauagaaacauuuuaccauuuuaauugugguuuugccaaguccaguugaauaggucauaaagagaguauaauuuauuacugcuuugauacuggauuguuugggugacuucauuauaugaccuugggcaagauacuuaaccuuuccauguuuauuuuaaccacuuguuuuguguuaauagugaugcuuagcuguaguauuuguauuuuagugucuccacuaaacauuucuauuuugcagagguuuauuuuuauuccucucuucucccuugucuucuuccccugcccugcucuccucugucuuccuuugcauucaguacagaguagugagauuuuauuuagagugauacugacugaagacucacauuuucuaucuucagacauacacaucuuuuuauuuccuguucaaugacauuagcaccagagagugaauacaaagaaauuauuccauguauagaugaaaauauaugauuugguucagaauucuucuuuuggcuaacggucauucagagaugagagcuauaaaugucaucucuauucucauuaacacuuaggucuaaaauugagcucaauauuauuaauaucuauguuuuaauuaucaguuaccacuguagacuuguuuuuaaaacaaauguuuagaauaugugugauaguuccuaacaacuucauuaacccauuuauaccagagguugcacauuuuuugugugugaagaaucagagcuucgugaugaccuugagcaguaggauauaaauaacuaccacaagcuuagcauuccaguaauagaacacuaggcauaaaaggguuaagaccagagucccuauguuguuaaaaguuaaaauacuuuuauacuuugccccccaaaaaaucccauuguuauagucucuuuuauauaguuugauggaaacauuucacauuaauuucuaaaaucuaauucaaauaguuauuucucugauuacacacuuuaaaaagauuuuuuacauuauugucugauuucauuaagaaaaggcacuauacuaguugcuaaaaccucaucauaagauauaucacucacaaaaauagauguaauuguauuuuugaaaggguuaguuucuuauuuuuuuagcuaaagcuuuuuuuuauaggcccuagaaaauuucugaccccauaaaaucuauuuacaaggaguuugacuuaugggcaagaguuuauaacccaggagaaugaucguuauuauuugcauuuuuagcuuccacuuuucauuccuuucgcuuuuuuaagcaacucuauuguucaagagcguauuucuuauuauuuuucuuucaaauaauagugccuaguguuuuuguaauagucugcacaagcaaguguaacaucuucucuguuaaauaacaucugcugguguaguaguguacucuuuugaauaacucauuggugggaaaaaaaauacgugaaugcagacuugugcugaucuuccuaacucuucuacugaaaaugauaguuuuaugcuaucaugcauugauaaaugguaaauguuuuuuuagauagcaauuguagaucaccacgguuguagaucaccacaaauucuguaaaucagcugaagauggcaaauucaacagagaagggaagaaagaauaauuuuaaaguuggccaaaauuugaguuuuuauagaguugccagauuuagcaaauaaaaauauggaugcccaguuaaauuucauauaaaccacaaaucaucuuuuaguaugucuuauaauaacuauugggccauacuuacucuggcacccacccccccaucucaguaaaacgacagaaacacgucugauuucugauuacaguuugacacuguuaaaaaugcuaucaccuucuuuaucucacuucaccucauaacaacuauaugaauuggaugacauuuucccguuucacagaucagaaaauugacuuuacagagaugagaugauuuacuucgggucauagcuacuaaguggcagaaucuaggguacaaaucuaguuugucucauuucaaguuuacuucacacuuuccuuuccucuguaucaagcuuguccaacccauggcccacagcccauggccugcaugcagcucaggucagcuuugaauauggcccaacacaaauuuguaaacuuacuuaaaacauuaucagcuuuuuuucauguuuuuaagcucaucaacuauuauuaguguuaguguauuuuauguguaggccgauaauucuuacucuuccaguguggcccagggaaguaaaaagauuagacaccccugcucuauaucuuguucuguuauguguuugugacaucuagagaugacaugcagguuguaauaccuuuuuaaauuuaugcuuuuuagauccuuggagcaugggggugaaggguuggauuacuuguauuauuugguuugcacaguguccagagaagcagaauguguggucuuggaguggaaacugcaugcagcucuaucucuuauuuggcagcuguuggcguguuccaguugugucuucuuuugauuauacuaagccugucuuguaugggaaauugauuaauucugaauaaaauaaugauauugcaaucagcaauuaaauuguuuuuuuguuuuguuuugagaugagucuuucucuuguuacccaggcuggagugcaguggcgcaaucucagcucacugcuuucaagcaaccuccgccucucggguucaagugauucuccugccuuagccucccgaguagcugggauuacaggcacuugccaccacgcccagcugauuuuuuuuuuuuuuuuuuuuuuuuuuuuugagguggagucuugcccugucucccaggcuggagugcagugaugugaucucagcucacugcaaccucuaccucccagguucaggcaauuccccugucucagccuucugaguagcugggauuacaggggugugccaccaugcccagcuaauuuuuguauuuuuaguagagacaggguuucgccacguugcucaggcuggucuugaacuccugaccucagaugauccacccgccucggccucccaaagugcugggauuacaggcgugauaaacuguuuuuaaagcagucucaugauggcuuuauuugcaagggggcuauugguauguauuguucccuaugauuaucaauacauuuggaauucacauaguuaaacaaacuuaugguuucauguagcaauguuugggauuucuucauagcauuuuuuuuuuuuuuugcucuaauucuuaggugagauuggcuagucugucaccauuuguagccuguuguaugagauguuccuauaguauggacuaguucauucauuuguguuguccuauuuaucaacauuuucugccuugcucaagaaaugcucuauaacgcaacuuguauuucagauauuggguaauuugauuauuuuauaagauccuuuagaacagugcuucucaaacuuaagugucauacaaauuggaugggagcuuguuaaaauagaguucuuauuugauggauuugguuggggccugaauuuuucuaccuuucgaaaagcucccaguugguacugauacuguuggucuguugagcgugcuuugacucacaagauuuuagugaguuaacguuuuucaaauagauuuuucuccuuuuuuaaaaaauucacaaacauuuaacaauaucucuguugauuuauuuauacuagcucauauuugaacuuguuauaaaaaucgaccuuuccuuggguuuaggauaucaaggugaccguuuugccuuuguuaaaggacgucugagguuuucuauuggcauggguacaagagucagguuaagauuucaggauguuagagcaaaagcacuguuuucacuggcaccuguugccuuguugcuuuaaauguauaaaagcauauugaacaguggaacaaagugacaagaaauuuagggugaggcaacuggagaaaagagucacaaacuucagaacuauugaguuggcuucuuggguauggcuuaugcuuucacagaaaccuuccuuccaaccucuaguuucuguuguccauguauguggcuuugaggucucagaauuugagauugugcuuugggagaaacagacaaggaaaucaguggccuucacuggcagcuggcagaccuguaagugaugugguuuaauuguguguacgucaggauugcucugucuuuaagacggucuuuuuaagcugcaguguuuauccacuguuggcauuuucuuuguuggugaaguuguauucuuuuguuuuaaucuuccagcucuugucuggguugucaaauguuugagcaugauagcaaagaucucaaaacuaguucuuuuugcaagcagaucucaucuuuaagguguaguguaaugggauucagaaacuugacuccugucauaggcaggagggaaauguguguuuaauuuuucuuuacuucgcuuuccuucauuaauaugggauuguuauuauuauuuucugguguguuugggauaguugcugucaauggcuacaaaagacaguuuuaagauucuuuagcuagggcugggcaugguggcucacgccuguaaucccagcauuuugggaggccgaggcagauggaucacgaggucaagagguaaagaccagccuggccaacauggugaaaccccgucucuacuaaaaaauacaaaaauuaguugggugugguggcaugcgccuguagucccagcuacucaggaggcugaggcaggagagucucuugaacccgggagguagagguugcagugagcugagauugugccaugccuagcaacagagugagacugugucucaaaaaaaaaaaaaaauguagcuagcuguuuggccuagguauuacaaauuucaauguuuguuauuguaaguuucuauauucaaaaaucacuuaaguauguuacacaacuauuuugaaacuguuagugaaaaauaauccccuucaaaugcaaucuuuuaaauugauauauauauauauauuuugagacagaguuucgcucuuauugcccagacuggagugcaauggcacaaucucggcuuaccgcaaccuccgccuccuguuuucaagcgauucuccugccucagccucuggaguagcuaggauuacaggcgugcacccccaugcccggcuaauuuuguauuuuuaggagagacaggguuucuccauuguuggucaggcuggucucgaauucccaucucaggugauccacccgccucggccucccaaagugcugggauuacaggcgugagccaccgugcccggccuaaguugagauguuaaaaggaaaguacuuugcagaugacuuuccaagaaaacuagaaggaacaauuggcuuggggaagugaucauaaugauauaacuuggauauaaucagaacuuuuugucuuuuuucugagauggaguuucgcuuuugucacccaggcuggagugcaauggcgcaaucuuggcucacugcaaccucugccuccaggguucaagugauucuuuugccucagccucucuaguagcugggauuacaggcacucaccaccacgcccagcuaauuuuuuuuuuuuuuuguauuuucaguagagacaugguuucgucauguuggccaggcuggucuuaaacuccugaucugaggugauccaccauccuuggccucccaaagugcugggauuacaggugugagccucuguguccggccauaaucaguucuauacaauguguugugagaggaaaauucaccacaggcucuuuaccuuauuuaaggaggucaauuaaauauaaaccauaguagcuugcuuauugucauuauuaguuuauugaugcaacaguagaguaaguugauucuuuccuacauuacugcaaaagcuaucuaaugcuuccuccuguccacucucauuauguuucccuuucagcuuguuccaaauuuugggaaaucugauuauaucacuuccuuauauaaguccuauauacuuuggguaagcuacgcauuccuugcuuagcauauaauuguuuggcuuugcuuaccuuuagcuuucuuuuucucuacucucuccuccaacuuuaagcuauagucauucugaaccaugagguuuuccccaagauaacacauucuccuuuuccucagguuuuuguucguaguucuucucugccuaguacuggaucaccugccuaguaacuuggacuuaaucccuuaggaaaguucagauacuguuuuuccaggaagccuuuccugaucaucaccaccaccuccaccuccagacuagcuuagggcucuuuccuguccacucuaauagcacuuguuauauacuguauuuccuuagaugccugggaaguauuugagagcacgaacaauuuuuauucaugaaauuguugcaggaauuuuucuuaguucagcuaaagacgggguccuugucacacagccacgaaaauuuaggcuuguguacgauucgaacguugaguaggacaggguuuuauugggugaaaaggaaaagggggaaacagggccucucugcaggccagauuccuugcuagagugcuucccgccuugcagauugacucccagguuacacccgugaaaaggaggggccaggcuccucccugcugcacaaggugcagauuucuguagcuccaucccagugugcucuccucccagggcaccgcuggcuggaguuucucuggggaccccuuccuaccuggcuuucucaaaauuguauccucaguguuugauauauaaugguaguauuuaaugaaauauuugucuauuuaaugaguagugaauauguaaaaaacuuagcaggcugucaaagcuuagauaaaugugauccucuuacaucccagagccuauuuucuccugggcaaugccuaaagcuuauuuuuuaguugucuaguaaucccgauucugcccuuugugagguuagucuucuucaccuuuaccuguaaccuagcauuuagucuaguuuucugaccuaccgguauuuuuuuucuagauguaaaauuauuuccugacucuuucugccuaaaucuuuuggcuuccauuuugacuauucacauaaagagggaaaaaccccauagugucuuacauuuauuuaguaccuaguagcuuaaagugcacuuucacauucaccaucuaaugugagugaagagacagauucuguggaagaacuaaacucaucuggucauacucaucauuucaagugggaagaaagugguagcuuugaaaaggaagagugcguagaaauacuguuguagagucgaaacuugcuuucagaggaguugaguuuuaagaccgggugcgguggcucaugccuguaaugccagcacuuugggaggucgaggugggcggaucacucaagcuuaggaguuugagacuagcagggccaacauggugaaaccccaucucuacuaaaaauacagaaacugccugguugugguggugggcaccuguggucuuagcuacuugggaggcugaggcaggagaaucucaugaacccaggaggcagagguugcagugagccgagaucacugccacugcacuccacccuaggcgacauagcaagacuccaucucaaaaaaaaaaaaaaaaaauugccacgcaugguggugcaugccuauaaucccagcuacucgggaggcagaggcacaagagucacuugaacccaggaggcggagguugcagugagccgagaucacgccacugcacucagccuuggugacagaaugagacucugucuccaaaaaaaaagaaaaaaaauaaggaaaaguugaguuuuuaaaaaaggaaaugaauccauaugagaaugccaggguacuuacaucauuggauaugcugcacuuuuggaaagaaaaaagacacugaaagaugaaauuuccuaagaacagaggaauacaugcuguuaaccaugguaauagaauccugguaagguaacaacucuguagagcaguggguuucugccuucugauuuauguacuauguacaccaucuucauuucauauuugguaucagagaucucccagguaaacaguauuugcuuauaauuucuauaguagagagguuaaaaguaucguaguuacagucagacagaccugaguuugaguacuaguucuaggauguuuaaaacugauuuuggguaaugauuuaauuuuauugaagguuugcucuuuucauuuuuaguguggaguuaauaaaaccucauaaaacauuuugaauaagaugauaaauaugcugugauaaacauuaagguccuugguauauaauaaguacuuguaaggguuauuaugguauuauauuuagcauagcgcuagaguuagauauaaacauauaacacauaacuucaauaguauccuccuucccuccacuccccgccucccggccuccccucaaagagugaagaagaagcauauuccauguuuguuuggaucuuaaugaaagggcaaauuuagauauuuaaauuuauauauuaacauauaaaacauaaauaugcguguguguauacauacacacacacacacacacacacacacacacacacacauauguuuggggugaggagaaaaaggauauguuaguaaccucuugcagugugccaaaucuuacgcuaagcauuuuccaugcauuauuuuauuuacuucucacaguucuauaagagaugggcauuauucccaugucauaaauaaaaaagauaagaacacucugaagcuuagagaggcuaaagaucauauagauaaugaauagugaaccagcauuuaaccuagagcucuuuagcccuuaaaacuuuugcuuuuaaccacucuaccauuuguauuccuguuaggagucuccucacaucccuugggagaccuugaacauauucugagauuuacaaguuaccauguuaauuuuaugauuuuguauuuucauuucaaugacaauaaaaaaguuuauauacauauucuggaucaccugggugacugucuuacaaugaaauacccuauguaguuucauuuauauuuauggauaucaucucauugucuucagguauuacuguuauaauugucaugggccaaugagaaaagaacaguggugggccuaauccauacuguugcuuuuuauccaagcagaguucaaaugaugucauaauguacuauaagcagcaaacuuuuuuuaaaaaguaauuugacaaaauuucugagacaguuggaucaucuuacagcucaaaacaaaacaacuuggacaauaguaauaaguaccaugagugcacugugagcagcaauuuaacagcauauucaauuaauacugguacuuugcacuaugucuuuugguuugaauugcauucaauuugggaacucuagaucuaauauuugcauuuuuuacaguauuacaauuuaucaguggaucuagaaaauauuuucuuuuauaauuauacuauauuauacuaucaucuagauacagacccuuuagcucauggagaugaaggaaucaguucuguuuaggggagugcuggaaagcuuugccaagauacugccauuuaagcuucuucuugcagaaugagugcauguaugcucuuaugcucggcaaagacaggguaagggaaagggcagggacaugaagacaucugaaaaggcaaaaaaacaaaagaaucuuuuccucaugcuuacugcaugagggaauauuaaaaauauagguuauuguuaaagaccuuuagugcuaauuaagggaauauggauuuuauuacguaauuagugugaauccaaaaaaagcaaaaagugugggaauauaaacaacuuuuauaauucaauugugugcauauggaaucuuuguaaauuaagucauguuuuacauaaaaccagaaucuuauugguuaaagacuauuuggaaauggaauguaaauguuuuuguaugaaaauaaauuguccccaaauuuucagauuuacaaguuaccuuuuuuuuggucucccccucuccuuccuucuuuccguucuuuuccucuaggcgcauccuuuaauaaugaaaucagaaacucguaacuuuauucuucucucccaucucacugggauauuuuagcgauuaauaguauucuacccauuugauuuaaugauuuuuauuuuauuuuaacuaacauuuauugagaaaacuacauaugagauuuucugaucacuaauauuuauuugcacagaaaaagguguuacuaucauuuacuuaauagaucugcuuuuauuaaugauuuuaugccuugauuucccacaguuagccuccagcuguuacuucuguauuaugcauguuagagugaaauguccaaauuaaauuaguuuuuaagcugagcccugugaaaucaccagguggagaaauacggauggcauauuauuccugcauaugcauuuucauaugcuauuggugcaguguaauucaacuguagcauucacaacuuucaucauugacauagccuugguggggucggggaggagggaugggggguggggggcggggggaguaaauggaaugauauguacaaaaacacuuuucagcugggaagagugaaacaaguuaauaggaaauaaaaggccauauugucuauucagacuaguacguuacuuuuccagagucauggggcuagcaaccacuauaugucugacuucuaccaagaaggguugaaucccugguugauccugugaggccugaggcauauaaacaagaaacaugaaagggagaggaaaauuaaaugaagugggaguguugcagaauaauaauacaauuaagggagaaaauaauagagguagaggaagagguuauauacacuuauuucucuuacuaugaacauuuuacuuagaaguguaagguuguaugucuuguuugauacagugauaaaaauuaugauaaugcuuaacagaaaugggugcuuugcuccauaaaagugcuccgugcuuuccucugucauuaugaauuaaucagcaagaaauccagaagugaacaacauaaaaguauucccucuccuccuuuuuuuaaacagugaaaaaaguugacaauauauuuauucugucauagauccaaaaagccaagccugcguuuuaaggcaggguuuucuuugguuuucuauuucucagccacaccuucagauuucuuggcacaguacagucauagcauugugucauauccuuggucuguuuuaucagacuuuauaaauugauucugacuguaccagcaguacuagauucuuaucuuuacacaguuugggaaauggacaaugacucuuuuggaaaaacagcucuauaaauugugcugugguaugugagaauggguucucugcuuugcuuuuccucuagccugcugccauuccuagacagugucauuucucugauuuagggcauuguguagcuguucuggguagaguaaaccugccucuaaauguggaacagauuguuacccgucagaauucuccaccuuggaauggugacacugaaagauacaauucagcucuggccaacaccuccugucuucccaguucacuuacucucgucuccacuccaauuauugcaucuaauuaggaccuugaaacaacaaccuacuacuuuuuuuuguuuguuuugaaccucguauggccucacacuuccuuccuuacccgggucagauuucaugguccagcaguauaauuacucccuucuaaauccccuugacuuacuugcuuuucucuuuugucacacuugcuugcaaaaccucaauccugauuuaaagcaagugucuuccuacacugccucugcccugagcagcuuuauguuaccgggcaagaagagucacaaagcuuugcagacuggucucacauugaauuuauggccacagaucucaaauugcuccuaauucugcaggcaguccuaauuaagaggacuauuagauuugauuucccauccucagaggugacuguaucauucuguucucuuaucaaaucugcaaauccuucgccuccacucaaaguuucuggcuucacuugauauuucuuugagaaaauuaaaauaauuggaugcuacccaguuugucuccucaucaaaucuaccagccuacuugcaucuauaccuggagccuuugccugaauagugccacuauuccugaauucaccucugcugccuuuucuguuaauccuaucccaguugcccaaccuaaagaugcuucucccucauuauccuucucccuccuuucaaauuuuugcuuucuccuuguucacaaguguacuaaccugccuuuagaguuccacuuaaugucuuaaaaaaaaucguucucuugaugugaugucuuauucuaguugccacccuguuucucucuucccuucucagcaaaucuuauuuaaaaaauugacuguaguugcuaucugccuuuccuuaccuuucuucaaguuuguuuaaucaggcuccuauuuuuaguagucuuacgaaacugcucuugucaaguuaucauaaauauccauguuaccaaauacagaaaucacuuccauggccccaucuuaacuuuaccuuucagcaucauucuacacauuuccuuccuugaaacacuguuuucuucugguaucucugauaccagugucuccuuauuuucucccucuuucaccugucauuccuuuugugguguuucugauucugccacuuuccucuagaccucuaaaaggcuccacucucaguccuauucucauauauauauauauacacacacacacacacacacacauauauauauauauucucagacuuuucuuuuuuuugagauggagucucacucugucgcccaggcuggaggguaauggugccaucucagcucacugcaaccucugccucccagguucaagcaauucuccugccucagccuccugaguagcugggauuacaggcaugcaccaccacgccuggcuaauuuuuauauuuuuaguggagacaggauuucaccauauuggccaggcuggucuugaacuacugaccucaggugauccacccgccuuggccucccaaagugcuggaauuacaggcaugagccaccaugccuggccucagacuucuucaagucuaaggcauucauuaucaaaaacacagcaauagcuaccaaauuaauaauauacaaggugcuccagaauacucuacuuauuaccuacacaaugucuuuaguuaaauaucaaauuuaguuuuacucagaacagaucucuugaucuggcccaccuuuuucaaaaccucuucuuccccaguuucccacccucaauaaaugguacuaccauucacucauugugcaggcaauaaaucaccaagcaauccuugauuuuucuuacucccuacguuaaaucuauuaguaagcccgaucacaccucaaaaauguaucuuuaauucaaugauuccauucgauucucucuaugaaccauuauccguugcucaaauuacugcagcuguuuuccaauggcuaucugcuucuauaucacuucuguacuagucccaucucuguagcaaucagacugaacucucuuuuuuuuuuuuucuuuuuugagacagggucucacuguuacccgggcuagaguagccuggcguaaucucggcucacugcaaccucugccucccaggcucaagccauccucccaccucagccucccaaguagcugggacuacaggugcacaccaaccaugccuggcuaauuuuuguguuuuuuguagagacaggguuuugccaaagagcagggaguacaggcaugagccaccgcaccuggccugaacugaacucuuagacauugucaccccuuggguuaaaaccuuccuguguucucccaucauacacagugaaacccaagcuccuuccacagcuuaggcucuguauccuauggcuucuugccaccccuguaaccccaccacaaccuccccuuccauauacuccaccuaucagcuuuuuuguuguuguuaaaacaagcuaagcauuuucuauccucaaagccuuuguaguuaugauucucugugccucuucuccuagaucauuauaugucucuucccugaccauuguagcugaaauacacuguuugucacauccagugucuccauuacauugcuuguuuuaauuuuuuucuuagcacaugucacugugcuaugacauacuuuuuuguuaguuuauguucccgccucccccuuuuaaaaauaaguucaauauguuuguugaggguggggacauuguauucuuuuuucuuccuuagcuguauuuaacucuuggcaggcauucaguaaauauuugcugaauagaugugcgagggcuggcucuuuucugaaaaaguugacaguugagaaugcaugcuaguuuuaaauuauggacaaauauguggcuuuacaucaguugagagaaacuugaauguuuauuagguuacuguuauuuuuauuuguguuuuugagcaauucuuuuguacuuugugauaacaaguaauugcuuccaaaugaaaaagacuuuuccagugaccugcaaagcucuucagcagggauuggcaaacuacagcucaucuggcaccuauuuuuguaaaaccugcaagcuaagaauggguuuuacauuuuucaaggguaacaaaaaagaaaaauauaugagacagauuuuacaugauucacaaaaugugaaauauuugcucucugauccuuuacaagggaaguuugcuaacccuugcuggaggcgguggcccucauuaccugccuuccucauuaguggccugcugcaucugucugcuucaccugggccucgugcccauucgcauuugcuguuuccuucgugaggaacacucaggcucacucccuuacuuccuucacaucuuugcuuagcuguugccuuugcaguggagccuuuccugagcacuuaauuuaaauuccaaucccgccacccauuccuacacaccuuaucuccuuucuucuuuuauuuuucccauuggacuuaucacugucugacauaccauguauuuuucuuauguucucuuucuuuccaguggacaguaaacucagugagggcugagauuuuuguccguuuuguucacggccauauuuucgaagauagcaccuggcccauagaagcuuuuauuaaauauuuguugaauuaauggucauagauuaaaguuaucuugagaaccagcauuaaaaaaagucaaaacacuucaguaaacauugauuaauugccauaaaacaguccucaucucagaucuauggaguuguauaaaaucggguccuugucuucaaagaaauuaguguaguagugagaauaagcauagaaauaaaagacacuaaauguaagaugagacuaauuauccugcaguuuccuugcugauuaaaaaaauguugaauugaucauuuaaaguauuuuugcagaaguuaaaaguguuuauguaaaacuccaaguaauuaacacuuuuacguucuguauugauaucuuuucuccuuuucaucaugacuuguuuucuuuagacaguuaggaauaugguuccgugaaaauaaaacccauauuuaaaauggcuuuuaaauagucaaaagcauuuuaauuagauaaauaacaagugaaacuauuagcauuuuauuuuuaguuuuuugguuacucuuugggcagguauuuuuuaaagcacaauuagauauuuaaguaguauuauaaaauuuuaugucuuaauuuuuauguuaacugugaguggagcucuuuggaagaagguaaaaugagagagaguguguguaugugugugcacgugugcaauauauauagucaugagucauugaauaauugggaugauagguucugagaaacaucacuaugugguaucauuguacaaauaucauagcguauacuaacacaaacauagauggucuagccuacugcacagccaggcuguaagguauagacuguugcuccuaggcuauaauccuguacagcauguuaccguacugaauacuguaggcagcauuacacaguggcauuuguguaccuaaacauguaaacaucaguaacaauccaguauuauaaucuuauaugcaucugcauacaagaugcagucuauuauugaccaaagcauuaucaucaugugcuguaggacuauuaugaguguacauauucucuuuuuuuuuuuuucuuuuuugaggagacagggucucgcucugucacccagacuggagagcaguggcgcgaucuuggcucacugcaaccuccguuuccuggguucaagcaauucuugugccucagacuccugaguagcugggauuacaggugccaccaugcccagcuaauuuuuguauuuuuggcagauacgggguuuugaggcuggucucaaacuccugaucucaagugauccacccaucuuguccccccaaagugcugggauuacaggcgugagccaccacaccuggcccauauucucuauauguaacauuuuauaaauauuauagauguuuauauguaauauacacagugcuuuagcaaugucauuuuauuuuuaauuauugucuauuuaagcccuagcuuaagcuucucuucuugagugaaaacacaaauaccuuagugaaauuugauugauaauauuuuuuuuaauuugacaauagaagcauccuauuuuuucuuaaauuugugugggagauuuuaugguauaguaacguauaacacuaacuauauguaacuuccuuuuugguaaagcaaaacagccaguagaauuguagccucuggcaaauguuguuaguuucuuaauaggaaggaguaaguuaaagacagauaauaaaaauuccuuuaccaauuaauuuugcuagguguuuaagauacaaggaagauauuuauuuuuuaguaauuccauuguuuuagagcuucaaacaaacuguauuuucccucagaguuuuguuuuggguggauuugucaguaggguaugauuaguuuccuuuuuacgcauuuguucaacaaauguuuaaugagcaccuauaaaccacaaggaacuguacuaggaauuguggauuuugaaaauauaucagaggaggacuuuaaccucuaggaaggcauguucauaaaguacaguaaaacagguauguagacucccucccuaauguggagaacaagucaacaugucauaagauagauucaguuaaagugguaugggaguuaggagcauccauaauaguugugaucuaauagauuuaccuaaauuugaguuuggauuuuaagagacagaggcuuagagcagcaauaacaaaguaaauaugggcaaagccugccuggcauagucugcauugacuguuguuucuuaacauugugcauuuaguguguauucauauccccugggaaccucguuaaagugcagauucugauuuaauaggucuggcgucaaccugagauuggguguuucuaccaaacacuaaggugauauucaugauauaaguucauggaucacacuuuagauagcaagaugguggaccacauuuuguaaaacuucugguggcagagacaaguaaaaauucaacuacuauuuucuuucccaucuucguuuuucugucuucuuacacuuuuguuugcuuacaucugugugcugguggagagaguuaaaucuuuuauucaucauuucacuguuuauuauaauaguugggagcuuagcaauugugaaucuaauuuuaaagcauuaauuuauuuaugaauugcucuaauuuguccucuuccugcuugaagaaugguaaaacaucuauguucacuaugaauuaaauucagauuaguucaggcaaaacagcaguugagagaguuuuaauaaauuuacuaaaccauuaaauccauggcaccucacgauaggaauuuacuaacaucuggguuuucuugagaauuuagauucaaaucaaacuagauguuaaucuacuuauaaggaaaaagaaggaaauuccucauuucacaaguucuguuaugucucagaauguuuuuuccuaaauauacauuccagaaauacccuccuuuuacucuuuuaacuuauauuuagaugauacucccucuuauaucucuucccagagaaacaguauugaaaaggauaauaaugaggcaagaaaaucauuguguguuuucaucuuuuccaguuaauucaugaauucagaacuaugcauacauucauaaaaccaugugcaugcacacacacacguacacagacagacacgcauacacaggacgagaagguggggguaggcaagagauugauuuaauugucucacaauuuucuauacuuuucuugguugccuaucauagauaaaaccauuuuaucuugauagucauccuuuagccuauagagugaaggugaagaaauaauaguggugaaacuaaagauaggagauuuaaaauaugaaaagaaaauggauuaagaaaaucaaagaccaaaaacuuaaaagaaucaaagaccaaaaaaaugugccauacuguacuacuuuguauaucuagucugauauaggcaaacaaccuauuuugagauacaaccauaucucuuuuuagaaacaacuuuuaaagaaaauuuuaaaauauuuuaugucugaaguagaaaauuuagaaacuguaaaaaaaugauaaaaaagaaaaaaaaauaggcugggcgcuguagcucacuccugugaucccagcacuuugggaggcugaggcuggaggauugcuuaagcccaggaguuugagaccagccugggcaacauagugagaccucaucucuacaaaaaauaaacagcaauaacaaaauuagccaggcaugguggcauacgucuauagucccggcuacuugggaggcugacauaggacgaucauuugagccugggaaaugagcuaugauugugccacugcaguuuagccuaggugaguaagugagaccuugucuaaaaagaaagaaagaaagaaaagaaaagaaaaugaauuuucaaaaaacaaaaagaaaaaaacaugcuuaauuuguccaucuuaauauucuucauuauauguguguauauacauacauuugggaucaugcucuguauuccuuaguuagcauuuuauuaugucuuuuuggaguugauggagguagucauuaguaugucugugagccagguggaaugcucacaccuguaaucucagcaacucaggagucugagacgagaggaucacuuggggccaggaguucaagaccagccugggcaacauagcaaggugcugucucuacaaaaauuagcugagcauggugaugugugccuauagucccagcuacuugggaggcugaggcaggaggaucaauugagcccaggaguucaaggcuguagugagcuaugaucacgccacucuacuacagccaggacaacaaaaugaggcugucucuuacacacacacacacacacacacacacacacacacacacacacacggagugguugauuggauaggaugaggguaaugaauuucuugaauuguuuuuucugaaacacgacuaaaaacaccauaaccuaguuuuaugauuuguagguaaaguaggauuuuuaaaaucacuuacucuucgauauaauugugauggaaagugcugaggaaugaaauuggcuuugauuggauuaaauaucuaccuucuaaccaaaacauagucuaguaguuuuaauucaguuauuuauuccacaugucauaaugccccaaauaaccaggcuacugcuauuggcauuaaagguugccagcaccaucuggaauaauucacaaaugcaaggugaaaggaauuucugcaccauuuaaauuuuuuucucucucuuaaaacagagcaaaauuuuugcaucuaguaaaugaauguuaggaggaacuuaauuuugagaaaaagcaauuugauucauaaaaacagaauuuuucuccauuuguuugucuucucuaaugccaggagccagucugcuuuuuccauuaguuaauauaauugauaucagauuguuaaaaugagaaauaaaaaauuauagaguaaggagaauaaauauaaacauuauuuuucuuuuuauuuccucuagugauaacugauuuuauuauauugucuguggcugaauucuucuguagauauugaagauggccaaaaauggagaucuaaaauguaacuucuuagugugcauuuucaauggagaaugaauuaucucaucaucugugucauuaauucaugauuuuaucuugaauaauuuuucccagcuuuauugagcuauaaauugauaaaauagcaugcauuuaaguacgguguaccacaugaucugauacauguauacauugugaaggauuagcacaaucaagcuaauuaacaccuuuaucaccucacauaguuaccacuuguuguguguguuguuagaacccuuaagaucugcucuuagcaaauuucaagugcgccgaacaguauuauuaauuauagucuaccaugcuguacacuggaucuucagaacuuacucaucuucuguaacugaaaguuuaugcccuuugacaaacaucuuccacgaucucccccuuucccaacccucuagaaaccaccguucuacuuucucugaguucugugaauuugauguuuuuagguucauucauaucacaaguggcaguauuucccuuuuguucuuguuucgaaacagucucacucugucacccaggcuggagugcaguggcguagucucggcucacugcagccuccaccuccugagcucaagcaauuuuucugccucagccucuugaguagcugggauuacagguguguaccaccaggccuggcuaauuuuucuguuuuuaguagagaugggguugcgccauguuggccaggcuggccucaaacuucuggccucaagugauccaccugccucggccucccaaaguguugggauuacaggcgugagccacugugccuggccuccuuuuuguuuuauggcugauaaauauuccauuugauuauauaugccacauuuucuuuauccauucaucugaugcacacuuauguuguuucacauuuuggcuaucgugacuaauacugcagugauaugggagugcagauccugauuucaguuguuuuugauguguagcagaagugacauugcugagucauaugguaguucuguuucuaauguuuagaggaaccuucuuaccguuuuccauaauggcugugccaguuuacacucccaccaacaguguaccaggauucucuuuucuccacauccuugccaauacuuguuaucuuuugucuuuuucauaguauccauucuaacugguaugaggugauaucucauugugguuuugauuugcaucuuccugugauguugagcguauuuucacauuuagcuauccuuuggccuguugagcauuuuuccauauaccuggugaccauuuggccauuuaaagucuucuuucgagaaaugucuauucagauccuuugcccauuuuaaaaucagguuguuuucuugcuauugaguuaucuagacauuuugaauauuaacuccuuaucagauagguuugcaagcauuuuuucccauucuuuaaguugucucuuuacucuguugauugcuugcauugcugugcagaagccuuuuaguuugacgcagucccauuugucuauucuugcuuuuguugccugugcuuuuggggucauguccaaaaaaucauugugcagacccacaucaggaaguuuucuuuccccaguguuuucuucuacuaguuuuaaaguuuuaggucuuauguuuaagucuaauccauuuugagucaauuucuguguauggucagggauaaggguccaauuucauucuccugcauguagauauccaguuuccccaacaccauuuauugaagagauuauacuuuccccaauguguguucuuggcaucuuuaucaaagaccaauuaacuguaaaugcaugcauuuauuucuggguuuucuauucuguuccauugguauagaugucuguuuucaugcugguaccauaguguuuagauuuguaacauaguuugaaauccgaaagugugaugacuccagcuuuguucuucuuacucacaauuggcuauucacggucuuuuaugguuccauacgaaguuuaggauucuuuuuucuguuuuugugaaacaaugccauugguauuuugauagaggcugcauugaauccauagauugcuuugaguaguauggacauuuuaacaacauuaauuguuucaauucaugaacagauuaucuuuccauuuguauguaucuuuuucaauuccuuugucuucuaguuuuuaguguacaaaucuuucagccaguuguauacaaaaauauacaacuaauuuuuguauauuuuauauucugcaacuuuacugaacuuacuauaauaguuuuuaacaauuuuuuuaugcaggcuuuaggguuuucuauguaugaggucaugucauuugcaaauagagacaguuuaucuuguauuuuccaguuugugugccauuuaguucuuuuucuugccuaauugacuaggacuucgaauauucuguugaagagguggugagaguggacucccuuuucuuguuccugauguuaggggaaaagcuuucaacuuuucaccguuagauuuaucggcugugggcuaaucauauauggccuuuauuguuguguugagguacauuccuucuuuaccuaauuuauugagagucuuuaucaugaaaggauauuuaauuuugucaaauacuuuuucagaugauugugugauuuuuaucguucauucuguuagugugguguaugacguuuauuaauuuguguauuuugaacuauccuugcaaauaaccacuugauuauagugaaugguccuuuuaaugugcuguugaauucaguuuccuaguauuuuguugaaaguuuugcgucuaguuucaucaguacuauugaccuguaauuuucuuuucuuauaguauccuuaucuggccuugguauaagggcaauacuggccuuuuaaaaugaguuuggaaguguuccugccucuuuaauucuuuggaugaauuugagaagaauugguacuagcuugugcuuaaguguuugguggaaaucagcuaugaagccaucugguccucagcuuuucuuuguugggagguuuuugacuacugcuuuagucuucuuucuuguuauuggucuguucagcuauuaauaugucuucacuuguccagguacaguguguaaucccagcauuuugggaggccaaggugggaggaucacuugagaccaggaguuggagaccaaacuggguaacauagcaagacuggucucuacaaaaaaauaaaaaauuaacuaguugcagcggugcaugccugugguugcagcaacuugagaggcugaggcaggaggauccuuugaccccagaauuuugaugaacuaugauggugucacugugccccagccuggacaacaaagcaagaaugaaucucuuuuaaaaaaaaagucuucaauuuuguuguuguuguuguuuuaaugauucagucuuuaggguauauguuucuagaaauuuauucauuucuucuagguuauccaaguuguugguguauuaauuuucauaauauucuccuuguacuccuguggaucaguuguaaugucuucucuuucaugucugauuuucuuuauuugaauucucuuucucaguuauucuagcucaaagcuugucaauuuugauuaucuuuugacaaacaacuauuauguugauuuuuuagaauuuucuuucuggucucccauuuauuucuuuauuauuuccuuacuuuagcuaacuuugggcuuagguuguucuuuuuucuauuuuuuugagguguaagguuaaguuguuugagaucuuuauuuucuuaaaguuuauugccauaaacuugucucuuugaacugcuuugcuguauucuguagguuuuagaaugcuguguuuucauuuuauuugccugaagauacuuuuugacucuuuuuuuuuuuuuuuuuuuugaguuggagucucacugugucacccaggcuagagugcaauggcacaaucuuggcucacugcaaccaccgccucccggguucaagcgauucuccugccucagccuccugaguagcugggauuacaggcaugugccaccacgccuggcuaauucuuaauacagaugggguuucaccauguuggccaggcuagucucaaaccccugaccucaagugauccgcccaccucagucucccaaagugcugggauuaaaggcgugagccaccgcgcuuggccugacuuuuugacucuccuuuugauuucuucuuugacccauugguuuugucaggaguauauuguuuacuuuccauguauuugugaauuuuuaaauuucccuccuauuauugauuucuaauuuuauaccauuguaguugaaaaacaugcuugauaugauuuuaacauaguuggauuuaacacuuaauuuuguggccuaacauauguuauauucuggggaaugcucuauguguacuugagaaggauauguuuucugcugcuguuggauggauguuucauauagucuguuauuugcucuauacucuuauucaggucuaauguuuucuuauugacagacuguuugaccuauccauuguuaaaagugggguaguaaaguccucucuuguuauuguauugcugucuguuucucccuucaguucuguuaguauuugcuuuauauuuuuaggugcucuaagguuggaugcauauauauuaauacauuuacaauuguaauauucucuugaugaauugacccauuuauuguuguauaauaaccuugucucuugugacugaaagucuauugugucugauauaaguaagcccauuucuauucuuuuuugguuaccauuuccauggaauaucuuuuucuauccuuuuguuuucagccuguguguguccuuacagcuaaagugagucucuuguagccaacauauuguuggauacuuaaaaaagucuguuagccacucuguaucuuuugauuggagaauuuaauccauuuaaaguaauuauugauaguuaaggccauuuuguuguucucuguuuuguagguccuuuguuccuuucucucuugcugccuuccuuucugauuugauuuuuuuuuuuguaauuguaugcuuaauuccuuucuaucuuuuauauguuacuggagguuaguuuucuuugugguuacuaugaggguuacauaagauaucuuaggcuguuuuaagguuguaauaacuaaacuuuaauuaccuacaaaaauucugcaauuuuaugucucccuccuucacaguuuaugcuauugaugucacacuuuacaucuuuuuauauuuguguacccauugacaaauuauuguagcuauaguuauuuuuauacuuuugucuuuuaacuuuuaugcuaguuaaaauugauuuauguaccacgauuacagcauugcaguauucugaauuugacuguauauuuauuuuuaccagugaguuuuauacuuuaauguguuuucauguuuuuauuuaguguccuuuaguuucaacucagcucccuuuagcauuucuuauaaggcaggucuagugcgaugaacucugucagcuuuuguuugucuggaaaugucuuuaucucaucuuuauuucugaagaacaacuuuuuuuuuuuuucccucugauggcaccucugacuccuugauauuguauuauuuguuucucagagaaguaaagcaauuuuuuuuuugagacggagucucgcucuguugcccaggcaggagugcaguggcauguucuuggcucacugcaaucucugccucccggguucuagcgauucuccugccuccgccucccaaguagcugggacuacaggcgcccgccaccacgcccagcuaauuuuuguauuuuuaguagagaugggguuucacuguguuagccaggauagucuucgaucuccugaccucaugauccacccaccucagccuccuaaagugcugggauuacaggcaugaaccacugugcccagcaacaacuuucuuauguauaauauucuuggcuggcaguuuuugucuauuagcacuuugacuauaucaucucauucccuccugaucugcaagguuucugcugagaaauccacugauugccuuggugguggugguaauggugguguguauguguguugcggguuuccuuguauuauagguugcuuuucuccugcugcuuucaaaauuuccucuuugccuuugauuuuucagaauucaauuauaauguguuucaguguaauuuucuuugacuugagcuuuugagcuucaugaaucuagaugucuguauuucuuucaagauuugagagauucucaggcaacagacauucauuuacgugagcuagguauuucuucuauucuccuguugggaccuugguaaugcacaugcucauucauuuaaugcugcaucggagcuucuguaugcuuuugucguuuuuaauucacuuuucucuuuaguuucucuaacuggauaauuuuaaacgauguguguuugaguucccugaugcuuucuucugcauaacugaguuuccuauugaagcuauuaauuuuuuuuuucaguugucaguguauucuucaguuucaagauuucuguuugguucuuuagaguuucuauuccuuuauuaaacuguuuguuuuguucauguauuguuuuccuaauuuuuguugaguuuccugauuuuuguuucuggguucucuugagucucauugagcuucuuuaggaugauuaucuuuaaugccaucagucauuucauguaucuccauuccuuugugaucagucauaagggcuuuauugguuuacuucggugauguguuauauaacuguaaaccgaauacauggaaaaauaaaaaaaaaacaauagaaaaauaauuagaauuagcaagagcguuuaacagguuuucuagauagaauacccauauaggggaaucauguuccuguuuauaugccagcaaauagccacuagaaaauguaauuuuaaaaaguuacuaaaauaauuuauucaggaaaaguucauuagugcauggagccauuaggugaaagguugauaaaaggugaacucuacacacagaagagaccaggcugucacugccuugaugcacuaguuaaucuuagccucuuuaagagugagaaaaccaaggaccaggcacaguggcucaugccuguaaucccagcacuuugggaggcugaggcgggugggucacuugaggccaggaguuugagaccagcuuggcccacauggugaaaccccuucucuacuaaaaauacaaaaauuagccaggugugguguugcaugccuguaauccuagcuacuugggaggcugagacaccagaauggcuugaacccaagagguggagguugcagucagccaacauugcgccacugcacuccagccugggcaacagagugagacccugucucaaaaaaaaaaaaaaaaaaaaaaagaguaagaaaaccagacauuauauuauaugcugucagaugugaggcaaugucaguuauacaacaccauuaauuauuauuuuuaccuaaaaaugaaaauugaauauauucaagucuuuaaagcuaauauucaguaucaaaacaaacaaaaagcaagagauauagagaaacaaguugaauuucaucaugaagaagcaaacauacaauccagaaugugagucguuguauggaauaauugauuuccuuuuuaaaaaaaucacuggcauucaaaaaggguacauuggaggagguaagagacuuuucucuagauuaguagggauuugaaggaucugacaauaagcacaauguaugggcguuuuuuguauuuugauucaaauaaaguagccguaagaaauaaacuuugauucaaauggggaaauuugaauauggacuauauauuauacugauauugaggaauuguuaauuuuguuacaauuuacguuguuaaacaugcucuuuuuuggagaugcaucaggaagcauguauaaggguauaaugacaugauaucuggaauuuuaaaugauggcaaaacguauaauguacauagaaauaaaauauauacacauuuuuuauggaggaaaauauaaugcuuuguuagccuuuuaaggagaccuaaacaaauagauaaacacacugaccaguuuucaaccuaacgauagugcaaaagugauacacguucaguaaaaccacacuuugaauuuugaucuuuuccugugcuauugguauguaauaugauacucucuugugaugcuggacaguggcagugagccacagaucccaguuagccacacaaccaggagaguaaacaacugcuacuuuccagauuagguguuuuaaaugcauuuuggacuuaggauauuuucaacuuaugguggguuuauugggauauagcccaaugguaaguugaggagcaucuguaguauguuaaugaauugaaagauccaaaagcaugaaguuuuucccaaacugacauugcuucaaugugauuggaaucaaaaucccagaggcugcuguuggguuuuuuguugcuguaguugguugguugguuugguggaacuugacgggcuaguucugaaauuucuaugagaagcguaaagcgccaagaacagccaagagaguuuugaagaagaaaaagguagggagccuugccuugcuaauuacuuuuuguaaagguauaguaauuaaggugguauagaucuggcacagaaauauacaaacauagccacaaaacagguacacaugcauauagaaacuuuguacacaccagaaguggcaaugcauguaaauauuccugggaaaauucauuauaaauacauguaaaaaaugaaauauuauuauguuauaccaaaccccccaaaauggaaguauguuuuuaccucauaacauaugcaaccucgguuucagauggauuaaugacugcaacgugaaagacaaaguuaacgucguuuuaggggaauaucuuuaugaacuuugauggacaagauuuuguggaaaugucacaaaauuguauauuauaaaggagaagauugauacauuugaaacaauuaaaaguuuuaggcuggacauggugacucaugccuguaaucccaacacugggaggcagaggccaguggauugcuugaguccaggaguucaagaccagcauaggcaacauagugaaaccucaucucuacuacaaauuagcugggugugguggcaugugccuguaauuccagcuguucaggaggcugaggugggagaaucaccugagccuggggggucaaggcugcagugagcggagauugugccacugcacacuagccuuggcgacugagugagaucccaucucggaagaaaaauaaaauugaauucuaucgaugaaaagauguaaagaaaucauagacuagaagaaaauacuuacauaacauauaacggauaaaguauuauuaucuauaauguauaaagaauaccuauaagucauuaagaaaaagauauguuaauuuaaaaaguggagaaagacacaaauagcuauuucacagaaguggaaacaggaauggccaaauacuguaugauaagauauucagccuaggugguuagaaacaugcauuguaaaacuauaaugagguacuauuuuuuuucuacccuauuggaaacauuuagaaagucaguaccauguauuaauggauguggagagguauaauggccaacaguugugcacagcuagcaagaguauaaauuaauauagcuucuuggaaaauaaaauaaaauaagguguaccuacuguauuuccuagcaauucaguuccuaggccuauaccuuagagauauuccugcccagguauaucagagugcaccuagcagcauuauuuaaaauggcaagaagauggaaacaaugcaauugucaucuucuggggaguagauuaaaguaauugccauauauuauuucauaccucagugaaaguggagaagauuaaaagauacauuacacucugaauggucuaagucucgaaaccuauugaaagggaauaauauugaauaucauucuguacuaaaaagaaaaaugaauaauuauuuaucuuuauaaagcucaaaaacauguaaacuauaaaugaacaguucauauauauauauguagcaaaacaauaauaaaagcaaagggauuuuaaacauaaauuuugagauauagguuguucuuauuaauggaggauagaccaauaguagagagagacacaauagggagcuucagaaguaaauaugauguuccauuucuuaagcuagguuuauggauuuuuaugucauuauuuucauauacaucuacauuauauacaguguauugaauguuugaaauauuuaauaaugguaaaauuagaguuguuuuacaaagcuuucuuuuucuaucagccauucuaauauuucagugcgucgaugucaaaaauacugcuuccguauuuccaaaaucucugacuugguuucuuuuuagucauuucaaaugaucccgugccuuucuuuuguuuuaugauuucauuguucuucguagaauacaugcugaaauacauguucuuuaugggaaaacuuauuuuuguaaacgaaugugcuaccauugagaggaacgaauuuggaauuguugaaaaauuucgcagcauguauuuauucguugguuuucagccauuccuuauugucacugguguaagucucuagauaaacauauuuguuucuauacauacauaugcaaagcuugauuuuucuccuucugucauuaggcaagugaaagaccagaauaagaagguagcaaaucugaagcacaaggaacagguggaaaaaaagaagagugcacaaauguuagaggaggcgcgacgacgggaggacaaucucaacgacagcucucagcagcuacagguuagaacacaaggagaaucugaaaggaucgggugaagacauuugauccguaaucgcauguuguuuuucucuucaucuuuauccuccucuuuuuucucuuucuaacccugcuugcugccuuccucucagaccaacuguuuagcaaugaaggaauggcuuuaaguagaaaaugcaaguuuuauuccacagcuuuaugaggacaccucagcauaggagaaaguucaucuugcuucaaguugaucacacuuaauugguaaguucaaugacaguuuaaugaguggguuauauuaggcuucaggguugucaguauaccucuuugccaguuccauucauuaaaauggauugcuaaucuugguuugugucuuucuuccuuuuuucuauucuuccuuucucuuuuccuucuaccucucuaaccucccucuaucuuuccuuccuuuccucuuuuuaaauauucaguuuaguaagaauauuuuacagucauacagaaugugacauauaaacuguauuuuuucacuucaguggagugauaauugaugccuaaaccuaauuauucacagauuaauuaaaccaggcucaacaacagcaguagcagcuaccauauuauaagugccaguuagguccucaguauuugaaacuaggcucuggucauucauuuuguucuaaccuucacaguaauccaaguggagcaggugguauuguauacauuuugcaccgggggaaauagauucagagacauuguguuacuuacguaaaugcacacagcuucuaaauggcucagccaugauuuuaacugggacuuccugaaucuguagacuguccucuuugucuugaucauaaugcuucagaaugaagguguagauuauagggaagaauaccauaaaugugcuggagucucugaaagccaugcuaagacuaagccacugccagauuguuuuucucuaguuaacaauuucuaauugggucugauacuguguauaugccgcaauuacaaucuuuacuggagagauuuggaggguuuacuauguagaagccauucugaggcuuuacaacaaauucuuuuaacauaugaagaagacucuacuuuuuacuucuuuuucucauuccucuuuuauguaacuuuuacugauuauguuuauagaaaaaguauaaauuuccucaaaugcaccaaauuuugcaaaaagcagcaugcccguuuuuccucauccuugccaauaacaguuaauauuggcaguuuucucaucuuucuguucuuccuccuuuuuuuuuuuuuuaacaaaauacaaaucugaugagugguaaauauuucauucuguguuaauuuauauuucucugauuaccaaugacauuguuuuuucaagucuugaauuuucuuuugcuuguuaauguaauuuaaaucucucuuccauuguuagguuuuccucccauggauuuuuugcuuaguuuauccacauuuugagaguauauauuuacacauaaauacuuuuaaguuguucugugcuuucauauuuuugccuuuacuuuuuaauucauuuugugguauuuguguggugaggauauuuuuucuuuauugcuaacaacuucacaagaauguuuauagggaauuauuucauugcucacaaacuugaauugaugucuuuauauuucaugaaauuaaugaugagucuguuucuaggauuucaguuuaaccucccuucuugaacuauggccacauuguuguuuaauucuagaaaguauuuauuuuaugauaaggcaagccucucuuuauguuagcacuuuaacuguuucauuugucuuucuuacccugcucaucauuuaauguuuucuauuagcagucucucucuauaaaccaaagauacucuucuaaucuucucucaguuguuauaacaccaaaagugcuuucauauguaaucucuuauuuccuuuuuauauaaacuaaaagauaaauaagauagauuauauuauuuauauuuuaccuauagggaaaacuaauuuagaguggaugacuggcuuccccaaggugucuaaguaaaugauagauaccaaaguuaugaaaaagauagcugauggccaugugcaaauuacacagagauguaauucauucaaauaccgugaaaagagcacuggacuacaaguuaggauacuuaggaucugaucucaguucuuuuacuaacuacucaguuacuuaaguauauuucuguuuguuuauuuauuuauuuacuuauuugacagacagucuuacucugucaccuaggccggagugcaguugugugauccuccugucucagccucccaaguagcugggacugcaggcuuguaauuuuuuaauuuuuuguagagacaaagucucacuauguugccuuaggcuguucucgaacuccuggcuccacacgaaccuccugcaucagccucccaaagugcuaggacuauaggcgugagccacugugccuggcccuauggaucauauuuagagauugcaaucuggguguuagggguacuccccaccacugcguugucauuuacaacaacauaaugaagaaauacagccggccaucguggcuuaugcuaauccuagcgacucgggaggugagaugaaggaucacuugagaccagaguucaagaccagccugagcaacauagacccugccucuaaaaaaauuuaagaaauuagccuggcaggaugguguacacguacggucccagcuacuguagaggcugagacuggagaauugcuuuaucccaggaguucaggguugcagugagcugugauugugccacuauacuccagcguaugugacagggcaaggcccugucucuaaaauaaauuaaaugaaaauaaaagaaguuaggaauucuuggagaaguuacucauuccaggauuagagcaagaaauguacaagacaaaccuaaauuagugguucucaaacuugugugcguuggaguuacauggagggcuauuagaaaaguagauugcugucuccugucccuagggguuuugauucaguaaguuuggggaaagccccaugaauuugcauucuaauaaguuccugggugaugauaaaauuccuggaccaggaaccacauuuugaaaaaucacugcgcuauagcaucaugcgauaugaaaaauuaagaaccuaucaaagacuacuggggucauauaaggauggacagaggagcaagaaugaaggggcuaucacuggccuaggauagacaguuugagcauaagaaagacuaaugagcacaguuguuuaaaacaaaguauuuuuaaauccggaaacuucauugugagacuauaaaaauaauuuggagauugcugggacaccagugcccuaacacugggauuuacuuuuuaaaauuccaaugguaguaggggaaacauuggccauuuuuugauaguuuauugaagcugagugguggugacaugggguguaugauauuaucuuuccuauacuuuugcauguuugaaauugucccuaauaaaaugcuggaaaagaaagauaucacuuaaccacuugaaacuuucguaucuguaaaaugagucuuaagacagauaagacuucacucuuagacuuuagugugucuuucaguucuaaacuagcuuuuuaaccauauuugcguagcccuggaguggagccugugacucuggguucauuucuuagccaagcuccuuauuuguguuuucccuuuacuugagaaauauuuuccguauuuuccaaguaacucuuuuuucauaucuuugcuugaauuucauggaguugguuucuucuguuuuuaaacugaaggucauauagcuuuggucguauaccuuugcuuuugucuaaaaauuauaaauuuuaauuaacauacuagaaaaauuaauccauaauauauauuuguuuauaucccucuacauuuucuuuuaaacuuuaauuuuacuuauuuguaauacuaauauauauacacucuuccguauuuugcuuuuuaaaaacuuuauaucauuuaaacauuuccaugaguuauguguuucauaaugaugcuuguacuuacuauuuucaguugaauccagaguucaguagcuuuauacacguuccucuuuuucuggacauuucuuaauuuucaauuuucacagagcaaauuuguacagauaaauuguacccaauuuggugauuuccuuuggcuauuccucagagcaaacuuacucaaaguauaugaaguguuguagcuuuucuuaaauuuuuguuaccaaagaugaacuaauuuauaguacuuccagcaguuugcaggcauucuguuuucccuauagccacuuugguucuauuuaauuuuuugcucauuuuacauauaauggcgucuucaaguuguuauauuucauuucuucagugacacuguccguuuuucacauguaaugaucuauuaucugaaauuuccgugucaaauuuuaauuacauuugcuaccuaucaugaaaaucuuuucauaucaccuccuuugaauugauauguuaugaauuacauugaggaaugaugauuguuacauauuuuuucuuuuucagucauuuuucuuuugaaauuuauuagauuuuguuguuuaaacaucuuuucaaaaaaaucuuuuaaauugcuuaucuuguccuuucaaggcaauuuuuucacuuaauauccauuugcaacagagucaagcauacuaguuucuuuuaguucuuuagcuguguguauguguuuguuucuuguaaauguucauugcuuuaaugcauguggaauuuauuuaacuuaacuuacaaaacauagauuuaaaguacucuuucuuuacccugauacccaguucuccugguagcacuuaguaaauagguauucuuuaaaaaaauuuuaaaucuaccuaaucauaugcuacauaaucacacagaaguuuccauuucauucuagauucauuguuuugucuuuaauccaauuuuuugcauuucuucuucuucuuuuuuuuuuuuuuuuuuuuuuuuuuugugauggagucucuugcccuguccccaaggcuggagugcaguggugugaucucgguuugcugcaaccuucaccuccuggguucaagugauucuccugccucagccucccgagaagcugggauuacacaccuggcuaauuuuuuugaauuuuuaguagagucgggguuucaccauuuuggccaggcuggucuggaacuccugaccucaggugauucagccaccucggccucccaaagugcugggauuauaggcguaagcccagccuuuuugcauuucuuuugcccuuuguuuacaaagucaguaggucaucuucaacgucauuaacuuuaucucaaaacuuuuuuucuagguaaauuuaucaguuuuuucaacaaccuuugaaacaucauuugagugucuuuaguuuguuaaauuauacuaauaacuuaaagaauauuaucacuuguaauuuauuuagucaucuccagccaggaacuaaauucauuccucuuuauuccuauuuauguuuauuauuuaucauguuaaaaaagauuuaaggaauauaaaauauuuucuaaagaaagcuaauauccagauuacaaccaaauuauuaaagauuugugguagauaauagagaagaaaaaggcaaaugaaacuucaagccauaaaaagaugaaaaaaguauuagcaaaugcucuuuauuguauucaccuauaaaauaaccuuucuucuuaugaaaacggagucaaauuccuuacagagcuccugucucuaaagguugugagcauuaaugagaugauacauguaaaagcuucuauaagagcaaauguuaacaggauuggacuagguaguaguaacauaacagguacaguggguccuccauauccauagguucugcauuuuuggauucagccaacgguggauugacaauauuauggaaaaaaacaccaauaaaacagaauaauacaacaauaaaaaauaaauagaaaauaauauaguguaacagcuauuuacauaguguuuacauuguauuggguauuagaagaaaucgaggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccaggcgcgguggcgggcgccuguagucccagcuacucgggaggcugaggcaggagaauggcgugaacccgggaagcggagcuugcagugagcugagauugcgccacugcaguccgcaguccggccugggcgacagagcgagacuccgucucaaaaaaaaaaaaagaaaaaaaaaaaagaaaucgagagaugauuuaaaauauaugcgaagaugugcauagauuaucugcaaauacgacagcauuuuauaucagggacuugcgcaucuguggauuuucauauuccaggggaguguuagaaccaauccccagaagauacugaggugcuauguagggauguaaugaaacgugagagauacugaggugcuauguagggauguaaugaaacgugagagauacugaggugcuauguagggauguaaugaaacgugagagauacugagguccuacuguagggauguaaugaaacgugagagaugcuauaauuuucuuguaaaaggaggcacucacuucauuaggagagaacuuuuaauuuuuccgguaggauuuugugagaaauuugccucguguuacuucauuuagagcagugguucucaaguaaggcucaguuuuggcgcuaaggaaucuuuggcacugucuggggacauuugcaacuugaggggugcuaccggcaucuagugaguagagugcugggugcugcuaaacguccuguaguucuccggauagcccccacggcaaagaauuucucggcccacacugcaaauagugcugaaguuugaaaccacguuuagaaacacuuugaaugccaguucuuuauccgaaguguuacuguggaugaaguuuucaugaauagcuuuggaaaccuaauacguauggccauauuuauauuuuuuucuauguagagcuaagaccaaagcuguuaaguuaaaacucuguaguggcagugccacaguacccaguaauaucgccuagguacauaguuuucugguaccguacucuaauuugaugugaaauaaugcuaggagaguuguggugagugaguaauuuacauaacauacacaauaaccaucauucucgggcacauaauuccagauugaaguuaauauaccacgugauugaaguauucuguauuauuguuaaugaagacuugguacucuagaaguauuuaauaauugucacacaaucguaaucgaaugacugguuauauuuuuggugugucauagaauaguagaauagcaauuaauuaugucuucuuauuuuaaucauuuuuaucacaauguuuuguguuuuaaauuucuggcuauuuaggugaucucuugauguuuucaugaaauaggagaaguaaagggaaacacuacuaccuuauuucuguuuuuugaaggaauuauuuuaguauuucuacguuaaguauaauaauucuaguauuaaaauauucauuaaguguuuuguacuuaaugguuuguuuguuuguuuguuuguuuguuuguuuguuuguuuuuaagacagggucuugcucuaugacccaggcaggagugcaguggugugaucucagcucacugcagccuccuucuaccggauucaagugauucucaugccucagccacccgaguagcugggauuccaggcgugugccaccaugccuggcuaauuuugugugucuguuuuuauuagagacgggguuucaccauguuggccaggcugguccuagcaucaugugaucugccugccucggccucuacaagugcugggauuacaggugugaaccagcacaccuggccuuauacuuaauguuuugaauaguuuauguuuaaucuuuaucagaugccguuuugauauucaaaggucaguuuugcuaguuacguuaaaaagcacguaguaaauuuauuuuauuugugaagauuaacacuugaccugcaggguucauuuucacuuuuuguuauucagcgacugccacuugugauguuaaguucaucacuggcuucacuguuccagguagaaguuacaguuugccagagagcaguaguacuacuuuucuauuuuuucucuuuuuuaacucugaaaaauaaaauacauuuuuaaaguaugcacaugcacauguagaugugccguguaaagaauacuuauaacaugaucaucucgagaaauuggaguauuguuggcaucccagaaaucauauguguauuucuuugcuaucauuuuucucuucuguuccucuagagauuacuauucugacuuuucuucuucuuugcuuuucuuuaugaccugcacauauaucaaaaaguauaauuuaguuuuguauauuuuguacuucaauaaauggaauuacuguauuuauucuuuugucacuucuuuuguugaucauuauuugugagauucauuuguauuaguuauauguagcauccauuccuuuauuguccuuguacuguguuuauuuaauucagaauuccacauuuauauugaaagugcucugaaaagaugauucauuucuuuucaauuuuccauucuuugaauacuucagauaguaccaaaaguaauuccuuuuggcagaaagugaguuuagaaguaagugguuacuuugcuuuuuguuuuugguucaacacauuaaaaauguucugauuggauuaaacacugucuuacaugugaaaugaaaaugauaccugaaaaacuaagagaaucugaggaucccagagauucuaaacacuuuuuugucauuuaucauggccuuagauaugaauacucuuccuuacgaugucauggugccacucaguuguauccuauuucuaccuuuguguuuuggacaguuaauuacugugauuuauaguaacuuaucucauacuuuuuggucucagaagccucuuugcauuuaaacauuauuaaaguucccaaagugauuuuuuuuucuuuuuuuaaauagagacugagucuuaacuauguugcccaggcuggucucgaacuccuggccucaagugaugcucucaccuuggccucccagggugcugggauuauaggcgugagccacugcaccaggccucaaagugauuuuuuuauauggguuauauaugauauacaugugcagaucuuuugacccagcuaucccaugucguagauuuauaugcauauacauguccaaaaauauaaaaauacauauguacaaggugacuuauaacauuauucguaauugcaaaauuuugaaaaccuaauugccuauaggugggagagugcuuaaauucaccauggugaaucuacacaaaggagacuggcaguuuuaaaaaagaaaugaaacgugagcaaaagaaaaaaaaaagauaguauuuuaaucgugaaugaaauacauauccaugaguuuaugcugauauaaauaaguaaucaaauacauaaauaaauggcauauggacagacggcucuuucucauagaagaauuucaguuaauaaguauagauggaaauagaccaaaagaaaaucaccaugagacaaacugaugguugugaaaguuagugugugaaaguuugagguuaaacauggcuuucauagucucaaaauguuuucucuaagguguuuauuuauuuuaacagaagacuaacuuuucagugaagaaaccuaccaggacaccuuaacaaaguguuuagaguuaacauuaccaguaauaaagagacauugaccucaugaaccccuugauacaaggcacugagagggacacaauaucauuucuguguuauucuuuccaaaaauguguagccucauuccaguaaugagaaaaugccagacaaaugcaaauucugggacauuuuacgacauaacugagcaguacacuuuaaauaugucaagaugaugaaagacaaggaaagacugagcaguuacagauguauucgaggggaaaugucagcuaaaugaauugugggaucuuggauuaaagcagauuucaggaaaaggaacagaaaauuagcuggguauaguggugcauaccuauagucccagcuacuugggaggcugaagagggaggaucacuugagcccaggaguuugagguugcagugagcccaggaguuugagguugcagugagcccaggaguuugagguugcagugagcccaggaguuugagguugcagugagcccaggaguuugagguugcaguaagcccuguuugcgccacugcgcuucagccugcaagacagagugagacccugucucaaaaaaagaaaaaaaaaauccggaaagaaaggacauugguggaaaaacaaugaaaggacauugguggaaaaacaaugaaaguaagguucucagguugguaaauagcauuguaccaguguuaauuucccaguuuugaucaucuuacuaugguuauguaaaccauaaacauuacaggagccuguauaaggagcagaugggcacuguucuguuuuugcagcuuuucuguauguucauaauuaauucagaauaaaaguuuuauuuaacaaauguauugacacuauauuucucagcacuuuuaaucacccaguucacuuugccaucucuuugaaauaaguaugcuuuggaauuuaaaaaugucuuacuaccaaaauuaacauaacagguuaguuagcucaggcauuuuuccugaauuuaggaaugcagauauuauguucucauauuguugacuucguaaacccguaguuuaauuaggaauguagcugaucaggccgggcacgguggcucaugccuguaaucccaguacuuugggaggcugagguggguggaucaccugaggucaggaguucaagaccagcaugaccaacauggagaaaccccaucuccacuaaaaauagaaaaguagccgggugugguggcacaugccuguaaucccagcuacucaggaggcugaggcaggagaaucgcuugaaccugggagguggagguugcggugagccgagaucaugcaacugcacucuagccugggcaacaacagcaaaacugcaucucaaaaaaauaaaaauaaaaaggauguagcuaaucaaguugaucguucuaaagauuagacucaaauccucaagccaugaugauguaauauggcuauuaucaguagaguuauaccuagaccuagagaugaaccuugaccugucuguauccuucaaguauagaagguuuaauuuuacucauuuuuaaacauacuugagaugucuuucauuuuuucaauauaaauuuaucgaaugcuuucuaagugucaggcacuguugcuaaucuuugguuauacagcagugaaaagacauguucuccgcccuucuggaacauugucucauggaaaaacaauaaaacuaaacaaauaaguaaauaucaaucaggguaaguacuacaaagaaauaaacaggacacugugauagaugaugggggagggaaauauuuugggcaacaaauuuagguagugacaucagaggaguccucccaaaggauauugagaucugaaaaagccuuauaaaaaguggagaagacaaaaaauugagguuacccauauggcagugaaaagcuuggcauuuucaaaguagagaauagguaagggucaggucaaaagggaccuuauaggccaugaaaagaaguuuagauuuuacaaguagugaaacagucuacgugaaaaguugacaggaucugauucgcauuuucaggauacuguuuuuugcaauaucuggaggaugauuggagugggacaagagucauacaaaaguguuugcucacuguuucauaccuuugugugcugugcaguuuucuaugcuagaaacaguaauguugcacgagacaaacaagcuucuuucucuuaagaagcucacauucugguaagggcucugugagaauugaggagagagguuuuuauuuauauuuaaaaaaaaauuuuuggagacagacucgcucugucacucaggcugcagugcaguggcaugaucauaguucacugcagccucaaacuccuggacuuaagcgauucuccugccucagccucuggaguaucugggacuauaggggugugccaccacaccuggcuaauuuuuuuuuucuucuuauuuuaaguagagacugagucuugcuguguugcccagucuggacuugaacuccuggccucaagcaguccuucugccuuagccuccaaaaugcauggauuauacuuuacauuacuuauuauaacuuuuuauuucugcuggcugucaaaagauguguuauaauacaaguacaauaauuucaauuauaguaauugcuauacgcagaacugaaauuagguaaauuccagcaacagcaagaaccuuucaaauaaaacauauagaagcauagucuuagcugauuuggcuguuggugaauuggggauuaaaaaaagcuuucucuugaaagccuacccaucuuuuaagggucagaugcuuuuucuugcgaagcugccuaaauccucgcaguuggaauuaaucauaccuucuguuguaauuucauuaguuuguuucugcauugauuuggggauuauuuuauauuacuuuguauuauaugcuaauugugugcugguucuucugcauacuugagcuuggggaccaugucuugguauuuuacauauaguugguacuucauaaaugcuuauugauuuuaauuguaucuauagaugucaagaacguucugucacaugcaucuuagccuggucucuuagucuauuugggcugcuauagcgaaauacuguaaacuggcuagcuuauaaacaacagaaauuuauuucucacaguucugugccuggaaaguccaagaucaaggaaccagcagauuuggugucugguacagguccacuuucugguucauagguagcaccuucuuguuguguccucacaugguggaaggggcaaggcagcucucugcagccucuuuuauaagggcauuuaaugccauucaugagggcucugcucucaugaccuaaugaccucccaaaagcuccaccuccuaauaccaucacauuggugauuagauuucaacguuugaauuuugggagcacacaaaauucagauucugauucugaucugaucugauucagaucauugcaccuggcauuuggagccuccuauuaaagcaagcucuguuuuaaccucaucuugaggucagaugcuuggcuucucuguuuuacacaagcugacaguguugguuucuuugaauauaacacguuguuuuccuaauguaugcucuucuacuucugcagaaucuuuuuccuguggauuuccaguuuuacuacauaaagauucugccuucaaauuaacuuuuguugaugaacucugccuggacuuguuauugccuuauccauuguuccuuagccugaauguuuaaucaugcuuuauuguuuacauacuuuucaauacauuguuuuauaauugccccugugugauuuaacccauuuaauuuucccuucucagcuaguuuauaucugccauaagugaagaauuacuuuaaaauuucuuuuuaguuuuucuuaaacacuguuuugcauagguucauuaauuauagcuguacuuauugaguuauaaauaauaaaauuuaauuuaguuauaauuuuuuuggaacugaaugauauuccauucagcauccuaauaaauauucucuaaaauucuguaggcuauccuuuaagagccuuguauguuuuaacacaggaaaugccaucuucccuuaguugagaauauuaauucuuugagcagugacacucagauacaccuuucagcaaggcuguaaguuuuagucacguccuaauaaugcaaaguagaguggacugaaaggaggcuccuaucaauagugguuuggggcuuuguuuuccuuuauaacaaagauaaguaucugaauuuaaccuugaaagagguuguugugagagagauuaauggaaugcuguggugcugugagacagcucucccgaaaccaaugaauauuaagaauaaaguucaaagaaagugaaaacaauggaaauagagccggggaaaaucagcuuuacauauauuuaagcauauucucuucuuagauauauagucaaugaaacauuuguguuuuucucuguaauuugauuuaacucugucuacaaaaacaguuucuucauuuugauaagagauuuuuuuuccuuucugagaaugaacacuacuuauccuucauuuuuagauuugccagggggauaauuauuuaagaaagccuuuuauaaacauuaagauugacaucuuuuuaggaauacuauuucuagaaauaguaugugauuugucacaugcuggauacaucuaauauauuaauguuccuguuuuugcaaaaauaaauuuugauuuccuguuucuagaacuuuuccuucaccuauuuaaauguuuaauccuguaucauuucuuccuuuuuaauaaaaauuuuuucuuaguaaaacagggcuuuuucuauauagaauauugucguaggugaguuuuuaugguguucuuaaugaauauuagaguaacggaucacaauggaaaagugugcauauaaaucagcaucuguuuuuacaucccuguggauaguugcugaaauuacgcaugaaaauucucuuuuacugcaggugaagcaccuacacaaauuguugguuaugugugcagcuuuuaaaaacuccuaucucaaacugggccacuuuuuaccauuuagaaagaaagcaaaaacacggcuuaacauuacuuuuuaaaauucugcaguguuugaaauggacucuguaguacuuuucccucuggccacaugucaguucaauuuaauagcagugaaauuuauugaaagacuuuauugauaggacuaaugugcucuccauaaaaugaugaauaaaauuacauuaggcacuaaaauuauuaaaaacuggacuacuaaguucucacuuuagugaaaugaaugguuuacuccuuuccuuuguguugugugagcucuucuugguuugcauuuggaaggaaaagucuccaaugagauucuuuuuuuucuuaaauuuuauuuuuaauuauaauggauacauaauaguuauacauauuuacgagguacacaugauguuuugauacaagcauguaauguguaaugaucagaucuggguaauuaggguacucauccccucaagcauuuaucauuucucuguguuaggaacguuauaauucuauucuuuuagguauuuuaacauguacaacaaaguguuguuaguuauaguugccuuauuaugccacugaaugcuaauccuguuauuuuuuaagagaacagaagcagguaugcaaauaguccauuuucuaagaccucagaagcaaaggucagccucuuaugggccacaucaguugucuguuauuuuaaggaaaagauauuuuugggauuuuuugguaaagacuuugaaaagguaugcuuguucuuuuuauaagcauuacagaucaaagauuuauaguguccuaggauuagguaaacuccauguccuugcccaaguuucucauacucagcuaccaugauuuucaagaugagacccuucccagucuguaugggauauuuguacucuaugcucuguaaaauuuauugauauaaagcaucauuuuuauauguguacuuuucuguuuauuuaaugaaauacaucugcuuuuguuuugacuuugguuuuuaacaauugggguuauaacagagcaccacucuuaacugaggggagacauuugagguguuuuaaggagaaggagggagagaauauuuuuaaauuuuaacccacaguauugccuuaaaguaguugguguguaaccaaauucugucucuguguugugcuagcuuucacuucaucagugcaucuggcuucaauuuuuuuccccacaaagcaucugagaaguugguaaaugaauucugacauguugaaugauuuuaaugaaaucuucuggauguguauauaugcuuaggggauggggaagagggaggcagaauaagcagugggguugaagguaacaaagaauuacugucucuuuacguuaaggauaauggauaacaguuaacauuaauaucuuucagaacagguuaaagucugucugguaagugguguuuacuuccaaggaagcagcucuuauuauuaauucaaauaaaugacuuccauuaccgugucagaaugagagcugggagagggaggagagaaugugggagauuguuacuuuggauaaucuuugugaaaucugaauuggccuucuuucugcugcagaaaaaggcaaaagcuuagggagaucuaccaucaucaaguagcucuuuuuuaugugacuauacuguagggccuuguuaacaauuuuugagggagauguuugagggaacaacaaauuaaauuuuaauugcaguuucuccucugccuuugcuuuucugauugaauguuugauuggaaagaaaggcagcuagcugggugugguggcucacaccuguaaucccagcacuuugggaagccgaggcgggcagaucaccugaggucaggaguucgagacuagccugaccaacauguagaaaccuuaucucuaugaaaaauacaaaauucgccaggcgugguggugcaugccuguaaucccagcuacucuggaggccgaggcaggagaauugcuugaacccaggagguggagguuguggugagccgagaucacgccauugcacuccagccugggcaacaagagggaaacugcaucucaaagaaaaaaaaaggcaguggaggguagagucuuacagcucagugauguguagcuugguguugacagagcugacaucaagaaguaaaguucugagagauguauugggagugguaucaugggaguugcuauagaguccagucucucccuguuaaucugccugagugaagcuauaguuaggcugucccaacuucugcccuagucucuuugaauauaggagucuucuucuuuaaggagaugagggauucuuugaaaggucuuccuucuucucccucuaccagaccccucaaaguagucacacaaaccuccugccgugaacccuguacucugugagugaaguauucguauuugauuucagcaaauaugugaggcuggcaaaaguaggcuucaguuacauaauccaaugguaggaaaaauggucuggguucguuuuggugagugcaaaugugguuaauagcaguugaaguaaaacucuaaagauacugcuuucauuuuaggugauaugaacuauuuaaaaugauaaagcauguuccuuugcuaucucuagauagcuauuaagugagaugucugugacacacaguacauuucuaaauuuuggguugccugaauuguuuaagcagaguaaaauagccaaguuagggcaggugcauggaauaaaacucucucucuacuuagucuuauuccccuaggcugccaauuuaaugcuuuuuucuaauuagugagugcuauaaaauggcuuaucuccaaacaguaccuguguuaauggcaaaaaccacaauuacuuuggcaccaaccuaauaauuccccuuuguaauuuuuuuaaauuuuauuuuuauuuuauuuuauauauuuuuuugagccaaagucuuacucccucucccaggcuggagugugguggcauagucuuggcucacugcaaccaccgccuccccgguucaggcaauucucccugccucagccucccgaguggcugggauuaccggugugcaucaccacccaggauaauuuuuguauuuuuaguagagaugugguuucaccauguuggccaggcuggucuugaacuccugaccucaggugauccacccaccuuggcuucccaaagugcugggauuacaagcuuaauuuuuaauugacaaauaauaaucguacguauguauggugauguuugaauacauguauacauuguggaaugaucaaaucaggcuaauuaacauauccaucaccucacauacuugucauuucuuuguggugagaacaucucaaauccacuuuuuuuuuuuuuuuaauacuuuaaguucuggguuucaugugcagaaugugcaguuuuguuacauagguauacaugugccauggugaguugcugcacccaucaaccugucaccuacauuagcuauuuucuccuaauguuaucccucccccagccccaaacccccccaacaggccccagugugugauguucuccucccuguguccauguguucugauuguucaacucccacuuaugagugagaacaugcgguguuugguuuucuguucuuguguuaguuugcugagaauuaggguuuccagcuucauccaugucccugcaaaggacaugagcuuauccuucuuuauggcugcauaguauuccaugguauauaugugccacauuugcuuaauccagucuaucgcugauggacauuuagguugguuccaagucguugcuauugugaaccgugccacaauaaacauucgugugcauguaucuuuauuauagaaugauuuauaauccuuugggguauauacccaguaaugggauugccgggucaaaugguauuucuaguucuagauccuugaggaaucaccacacugucuuccacaaugguugaacuaauuuacacucccaccaacaguauaaaagcauuccuguuuuuccacaaccucuucagcaucuguugcuuccuggccuuuuuuuuuuuuuuuuuuuuuuuuuuuuugagacggagucucauucuguugcccaggcuggagugcaguggcgugaucucggcucacugcaaguucugccucccggguucacgccauucuccugccucagccucccgaguagcugggacuacaggcacccaccaccacuccuggcuaauuuuuuuuuguauuuuuuuuuaguagagacgggguuucaccauguuagccaggauggucucaaucuccugaccucgugauccgcccaccucaaccucccaaagugcugggauuacaggcgugaguuuaaugaucgccauucuaacaggugugagaugguaucucauugugguuuugauuugcauuucucuaaugaccagugaugaugagcauuuuucaagucuguuggcuacauaaaugucuccuuuugagaagugucuguucauauccuuugcccauuuuuugaugggguuugcuuuuuucuuguaaauuuguuuaaguucuuuguagauucuggauauuagcccuuugucagauggauagauugcaaaaauuuucucccauucuguagguugccuguucacucugaugaaaucuacuucuuuaaaaacaauuuugaaauacacaguuguaauuuaaaauuagacucuguuuuugccuuuuuuuuuuuuuauaacuuuuucccuugucuacuuuaagacuagaagcaguuauaaugaaaauucaugaggaaacaggaguuuaaagagggucuuuauucagugggggccaauagacucugaguauuucguucucagacuaaaaaaaaaaaaaaaaaguugauuccccaaacagucaaaugugaggauucacucaaaugugaugacuaagcuuauugauaaaccuccauuguauaucucuuaaaacauuugcccaauuuuuuuucagcugaacuuugaugauuggccuaucacugaguauucuugguguugaacuauuuaugaauacguuggauuacucuaauuuauaaucauagucacaagaaaauauuuuauuagaguucaaaucacuugcagaguuuauucugaauaauuccugacauaaugcauaucuugcugguuucacauucagugaaaugcugagccauaucucaauucuguagucuccauaauaucugccuuuauauuuuagguauguuuggguuccauuuuaauauagucucauaccaacagcuguguuuuuauaauugagguccuguuagccuaaaaggcauuuuucuuggagaagaaauuuugucuucauugauaauccaguuuuguuauacuggagcuacauccucagguucuauaauacccauccuucaguuugacuccaagucauccuuaccuccuggcguucaugcccuuguguaguccucucccgcacccugucaggauuggucuguaugaaccguacaagaaggcagaagugauggcgccggcuucugaagcuacaucacaaaagauacugaugcaacugccuugcacuccugaaucacuugcccuggugagagccagccuccguguuguaaugacacucaagcagcccgguggagaggaacagaggccucuugccacuagcugcaccaccuugccagccauguaaguggaagcaaaggacugaauccugguugacaucuugacuaccaccucauaagagacccuggcaccagaacuguuuagcuaagcugcuuuugaguucuugacccacacaaacugugugagauaaucaguauucacuguuuucuuaagcugcuaaguuucgaaguaacucauuaauacaacaaugaacaaugauuacagauauuuuauauuuuuaguauuaaggugaucuaccauagucugauuuuuccccucuaaauccacaguuugguuuucucuguuagaguaauaaaugcuauuuuaaauuguuuuauucauauuaucaccaugguaauuaucaggguuggguaacauuggagcuuuuguugguguuuauuaccuauauaacucauauuugucugcugacagccuguaagcugggaaaagaguuacaaauguauguaaaacaugaugugucauauagccuuuuauagauuuauuuccuauguaaaaaacugcucuaacuagugccacauucuccaguagaaauacaaugugagccacacguauaauuuugaauuuucuaauagucucauuaaaaaaacuaaaaggaaacauuaauuuuaauaauguuuucuuuaaucaaauauauccaaaauauuauuucaacauauaaucaauaugaaaauuauuaaagaaguguuguaccuccuuuuuuuaagacuaaguuuuugaaauuuagguguguuuauagcacaucucaguuuggacuagccacguuuaaucacccaguagcuaguuguugcuaguggcuucugcauuggacaguacaaauaguauauuagcuaaagaagaauauuuucuucuaagcuagcggcagauuaagaaugccuauaaacaacagguaugauuuucucaaauuaaguguggcauguccuaucuuaaucucuagcuacauuuaguuccaguaagucaacuuccuaauuuccagaugcuucagauccuucaaaccuaaggaauauagggauaggaggaauuagggauaguacauaguauauguagauuucuucagcauuacagacucagaauggcucuuacugucucauaguuuaucaugaagguuggugaauauggacuuuuugaaggagaaaauguacuuuagcauguaaagcauguauuccaagccucaggcuacacaugguagaaucacucuuacacuugggccaccaggaagcacuuuccagggguuuuagcacauccccuuacuucaucgaugugguccucagagcagaaguaugugaagucuguugcauuucaugauucucaagucuaauaugacaucuuauuggcucacucacuuucaaggaagcuggugacaacugucacuucuucaacucaaagucuggcauugacagauuagagauuuuuaaaucuucagaaucuucaggauuuauggaagaacuuacugugauaauauugucccuuuuaaaaaauguuguuauuuagaacaucccaugguuaucaaaagacuugaaaggaauuucuuaucauaauucugacccacuucuguaaaauauugccgugaagaaauucauaggacuuuugaauaaaaagcugaagagcacaaugauguauaauccauacauguuuuguucucuuuaccuuucuuuuuucugaucaugagcacugccugaagauguguuugccuggucugcuuuucucuuuucacaguaaacaguuaacuuacauauuuagauaucaguuaucuaaacaaugacacuuguaacuauuuccagaaggucuuuagaucccuauugauuucuucauagugcaagauacucuuuuaacauauuuuucaauuuucuuuugauuuuauaucagaacuauguauuuuauauuauuuacacaaauaauacuuacaugucuuagaauaauagucacuucucuuauucuuuucuaacucugauuccucuuccucugagaugaccacuuucaucucuuuugguuguuucuacuguuguuuauuuuuaucuuuccaaaugacauucuuauauuauuguuguauuauuuuucuuauuugggcguugucuguugacaucuuaucauagaugaugaggaauuaguguuuuuacacaaaccaacacacacacuuacuucuuucuguccuuccaauauaauuauaucuaggucuacauuuuuaaaacugaggcacguaguauauuaugauuuacauuuuggucuuuccuaggguaccuuaguuuuccuuuuuguuuuuccugucuuggguaucucuuucuuucuuucuuuuuuuuuuuuuuuuuuuuugagacggagucucacucuguuacccaggcuggagugcaauggcaugaucuuggcucacugcaaccuccaccuccugguucaagugauucuccugccucaaccuccugaguagcugggauuacaggcgcccgccacaacgcccagcuaauuuuuuuguauuuucaguagagacgggguuucaccauguuggucaggcuggucucaaacuccugaccucgugauccacccgccuuggccucccaaagugcugggauugcaggcgugagccaccacgcccugcuuucuuggguaucuauucccagauuccuuucuacacccauaaaauuccuccugauaucauugcuacuauaaaaacacaucaucccuuacuaauugcccuuggauaauccauacaucugcuguuuuucuuggaaacauucauuuccuuucucugcuguaguguguaguuagucucuagguugugucaugcuugugguucccuucaccacucaccuaugguagagcucuuuuuucuggaucccacaucuucuuuccagguuuaccucuucauuuucauagaguauaccguaguagcuuccugagagagucguugagugagauacuuuuuuggggggauuuugcauucaacucccauauuugauugguaguuuagauacagaauucuagauugguaaucauuuguuuucccuuagaguuuugaaaccauuacucaaauugucuucuacuuuccuguguugccuuuaaaaacuccagugucuucugauuuguugaucugacaagugaucauuuuuggccuuucuaaaaguuuucaagauguuuucuuuccucuaguguucuaaacuuuacagaaagaguauucauauuaucaucuaagcaccaaaugauggauuuaaucuuuuugcaagagcgaggacaagaaagagugauuauaaauauuaccuagcagugcuguugauacucugguauuuguaggacucaagggcuuuccuguuuauuucuuacaguggcucaacauuuuauuaaauuaaauaggagauucaagcugugguucaacacaagagaaacuucuugguuuauuuuagcagagcucucaaaauuccaaaacuaaaacuagugccagauuuuacccacucgauagauuaaguaauucuggacuuuguaaaugaaggugagagagauauuugccgucuucuuucucuuguauuuuacuauccuaguuugauacaguugcguuagagcaaaugcuuccauacuuagcuuuacaucgaaauguuaugugacuuauaauaucacguaaauauuacuuaucagccauuuccuuuuauuuguaguuucacuuggcuuuuguuuuucauccuuauuaucgagaaagauuuugaaccaggcuuugucauuaauuccagaaaucuuuuuuaaauaaggcugugaacacugagcucauggaguacacucugguuucacugccggcuucagguaaagucaugacaugaguuuuauaaugaaacacuaugaaacuugauucucugcauugugacagauuacuaaucauuuucucccuaaaaguuuuuuauugauacagccacaaagcuauuuuugccccacgcagauguacaagugaaguuguuugcuugaaauagauuccugggaaguuauuuggaauuaacuguuugagccucaauuuuagauaauagaagccucucaggagacuugcaaaaaacaguuuaagagugggauaggauagaccgcacaaagacauaauacugaguuuuccguaaguugcuaaugagaaacguuaucaacuuuauguauuaauaauguuucuuuaugcuucuuuauacuuacagcaaucuguauuuuagaaucccacauuacuccaaaauagucauucucauucauuagaggguuugagaagacugaacuaaucauugcauccaucucuuaguucguaauccuucuuuuauguuuaguuuucuuugauucugaagaaaccaccuuggccuuuguuuugacgggcaucguuccuugucucugcgcgcggcgucccuuuaaaacccuccacuguacugugcugcucauggcaagucaacagagggaaggaagagcucaacaaacaacguuuguuuucuuuuguuuuguuuuguuuuguuuuguuugauacagauaaacugcccuacauaaaacagaaccucacuuaugggaauagaucacaguauuuuauaacuguggagaaacacaguucucugagaagaaugaaaacuuguaacaugaacaucacguacagcaccaaaaugugaauuuuuuucuaaaucucauuuuuuaaaauuuagaaaaacgagagaggaaaagauuuaucaacuguucauuaagaagaauguuaaauaauagaugcuguucuuccaaaguggggagaaaaaucugacuuaacuuugacagauuucaaguucuagauuuuugaagguacaguugucaaaaaggacuuacaaaagugggcugugguauaauugaguuucuuagauaaaauaaaaaauucuuggauaucuuuuccugauaugaguacucugaaaauuggagaaugguuuagcaaaucuugcucuuuuguuuuauguauuuuuaaaaggaagcacuuuauucuuaauccucuaguuucauaagaaguuaaagaaggaagugccuauaauaaccugaugacugcaguucuccaucccacuugaacucuucuucauguugucuucuuaagaucucuccuaucuuacaugaacucagcguucuguaggguuuuguuugacuuucugauagaucaacauucaccucuccggaagcuguguuuuaaacuuguguagaacaucagggcugggaauugcuuaguuggcugauaaaauugcucauucuuagccagaccggucacuuauauccaguugucauuuuugguuuucuccuaugagauuaugagaaaaccauacauucuugaaauacuaggaugcaucacuugcuuuucaaugucuuuuaagaaaucguuugcugacaauugucuaugaagaauaucaucugaaagaugaugcugcuuacugcacuuuuucauguaggcuuaacugcagggaaagaguguuuugauauucggucgaauuacuaucucaucaaagcuggcuuuaugcuuagagaguaguucaaaaacaacuuugugcuuuuaaguaaucaagcccuugccaccucugcugucuaacacaguuuuguucucucuguuacagagagcaaauuucucacauuugucuugcuuaacuaacuugagccuuugcuguuaaugauauacuucuucagccuccuucuuuccuuuccuugcuuucuuuauuguguccucugugacgauaucuuguugaccuggauuugcuucugauggaaagaacauuuaauaagcaaacagcccuuucuuaauaaauaggcucucccuggguuaaguaauuaauccacuucaccuagucuuccaucauuuucuaggacagucuccguaagaaggaugacaggauugaagagcuggaagaagcacuaagagaaaguguacagauaacugcagagcgggaaauggugcuagcacaagaggaaucagccaggaccaaugcugaaaaacaggucugcuauuuuauacaguuccaagcaaugcugcugguuaaccaaaagguaacacacaaccaguauaguuuagguaaacuauacauauuguauguuuauaggguuucaaaaacacuucauagaggagaagucccaaggaguuccuucauagcgguauuagauacaaggaugugguuucuuuugugucaaguauagaaagaaagaccaacuuuauuagcaaagcugagagagaauugaugaacauuuugcagaaugagugccuuucagugcccuguuccuagauaaaugccuugucuacucuuucuuaaauaagaauugaaauaaaguuguaugagaauugacucauguuaacacagaagucccugcauuaauaacuuaggucugaucccauauauauuuauguagcaugugcuaauguauuggacgagaugaaauggagcuugucugucugcuacaagacugggcacaacccuggcuuuuaaacggaaagaaaaaacaugaacguuucucuuuuuuuucuuuuauuauuauuaauuuuuuugagacaaaaucuugcucuugucccccaggcuggagugcgauggugugaucucagcucacugcaaccucugccucccggguucaagugauucuccugccucaaccucccgaguagcugggauuacaggugccugccagcacgcccagcuaauuuuuguauuuuuaguaaaguugggguuucaccauguuggccaggcuggucucgaacuccugaccucaggugauccaccugccccggcuucccaaagugcugggauuacaggcgugagccacugugcccggccaaaaaaaaaaagauacaaacauuucugacugaaaaacguuaauuucaaauagcuaauauuuuauucauuucauacccugccucauugaagagaagaguuaagguuguaacaaguuaagguuaacagugaguaugaaggacauagaaaccaugcacuugagucccagauaagcagccucggagggacuugcugaagaguucugcuguggcaguuugugaugcuuguuuuacauauauccugcaucuuuuaagaucuccagacucuugcuuuugacuuuucauuaggaagaauaacuacagaugggaaaagugaauggaagaaauaguuuuaacaagugaagguuauaaucccagcucccauuaugagaaugugauuuaagauuucaaaccuaggccgagcgcggugguucacgccuguaaucccagcacuuugggaggccgaggcgggcggaucacuugaggucaggagaucgagaccauccuggcuaacacggugaaaccccgucucuacuaaaaauacaaaaaauuagcugggcgugguggcgggcgccuguagucccagcuacucgggaggcugaggcaggagaauggcgugaaccugggaggcggagcuugcagugagccgagaucgcaccacugcacuccagccugggcgacagagcgagacucugucucaaacaaaaaaaaaaagauuucaaaucuaucugacacagagguucauaacacuuaauuuugcaguaguuguuuccuuuccauuucuuugugggagaaauauaaauguuaaacaggaaaaaaauacucaaugagaggguggcaggaaucuuucuaggaaccccuuggucagaccaagguguuauuuugaguuaagguagcuauaguaaagaaggguauguuuccaaggcagacauaguaugugccccagggagucccuucauagcugugugagauagaaagauaugguuucuuuugugucaaguauagaaaaaaagaccaaccucauuggcaaagcugagagagaaugaacuuuuugcagaaugagugccuuucagugcccuguuccuagauaaauaccuugucuacucuuucuucaaauacauuccuaaugcacagucacauagagcuugguuaguggagagcuucagagaagggauggugacagccauugugucacccaaggguggagaguaauuuccuuuaaucuugauuuuacccuuuuuauauucucuccuuuauuuuucaaagaaagauuuuucuucugcuuuggccucauuauuuauugacaaguauuaaacaucagagaucaugcagagauuuuggcaauuaauaaucaugucauuaugggauacagacuucuguuauguauuuuccuuuuugaggcuauugugugaacugauuauaauaugcuuuagggguauguuuuauuuaugguuaauagacuucgcaguuuuuagguuugcagaaaaauugagcagaaagugcaaagagcuuccauuuacgccuuucucugccucaguuuccccuauuauuaacauguugcgccaguguaguauuuguuaaaauuaaugaaccaguuuuaauacauuguuauuaacugugugguccauaguugaggguucacuuuucgugacgcacagucccgugaguuuugccaaauguauaaugacaugcaucugccauuacaguauuauacagaguaguugcacugcccuuaaaguaucaugccccaccgauuuauuccuuccccgucuccccaguccgugaucuuuuuacugccucuguaguuuugccguuuucuuuauugguaguuggagucauauaguauguagcauguucagauuggcuucuuucacucagcaucugcauuuaagguucuucuuuuuguggcuugauagcucauuucucuuuaucucugaaugauauuccauuguauggauaugccgcaguuuguucauuccuucagcuguugaaggacgucuugguaccauucaguuuuuggcacuuaggaacaaagcugcuguaaacauucacaugcagacuuugguguggauauaaguuuucagcucauuuggguaaauaacugugagugugauugcuggauucugugguaagaucauaugguaggaguuuuggaaaaagcugccaaacagucucccaaaguggcuguauguauuuugcuuuuaauuguaugcuuuuuuccuuuucuguuuucuuguccaccuuucugcuacucacugccuaucugaagcuguugcgugaaauauugcaugagaccaguuauuugaacuuuaagugguucaagguaugaagaaauugcuuuuauguuuauacuucugaagccuuacaaccuucaucuacuguccucuccucucccauuuuuuauuauuauuuuuaucguuuccugucuuuuuuuuuuuuuuuuuuuuuuuuuuuuuuugagauggagucuugcucugucgcccgggcuggaguguaauggcaugaucucagcucacugcaaccucugccuccaggguucaagccauucuccugccucagccucccaaguagcuggggcuacaagcaugugccaccacgcccagcuaauuuuuguauuuuuaguagagacgggguuucaccauguuggccaggcuggucucgaacuccugaccucaagugauccgcccgccucggccucugaaagugcugggauuacagguguaagucaccgugccuggcccaucuuuuccugucuuuuagcucuacuauuaauuuuacuuauguacguuaauuauauguacugagauaaucuacaaauguucuuuugaaaugccuuaaaugaggcuuuuuuguuuaggaacauuaucuuucucagauucaaaaguuaccuguuucucacuuaaauuuagcuucugggaaagaaugacuuuuucugauaaagguaggauaucuacaucucuuaauuccuccaagagcaaaguaaaauuguaugggagccauagcucuuauuaaaauaagauguagaaccuuccaaaguucgagcaaggaagaacucccauaagaaaacaucucuugaugccuuuucuuuauucucacgggauccccuuacaguuuauuuauuccuaauacaugcugccccacgcugagcccaugcuagaaauuuagagaaguuguguaaugaccuaaugaaggaaggugcccccuaaccugugugagcaaauuggaagauggaagugaaugauccccacaggggagaacccaacagcuccuuuacuuuugcuuugucccuuuccacguggggauucuauuucuggaagcuuucucuguuuaacuuuugguggguuuugugcuuuauugaaugugagugucacuuuucuuaaacaaggucuccuaaacaagucucagaauugccaggggcuaaggagcaguaugcuuaguucagcuaugauguuaugaaauuuaaauuuuugaauuuuaacauuuuaaaagagugauuuaaauaucuucacugggccgggauacaguggcucaugccugugaucccagcacuuugggaggcagacgcuggaggauugcuugaagccaagaguuagagaccaaccuguacgacaaugcgaggccucgucucuacaagaaaauaaaaauuaauuagccgggcaugaggggguaugccuauauucccagcuacuugagggacugaggugagaggaucaccugagccuaggaguuugaggcugcagugagccaugauuguaccacugcaucccagucugggcaacagagugagacccugucuuuaaaaauaauaauaauaacaacauauuugcacauaugaauuugguuguucuuuuaaaagccccauuuuuaacagugauauucagugauaaacaguaauauuuuuucaaauugccauuuugacauuauuuggcuuauaaaguauaaauucuugauguucaagguuauaggauuauaucugugguuugcuagguaaugauacauuaaugagcauuuuuaaggauuacauauuuuuuuguuguuguuaauguauaaaguucuucauuggcugaaaaucuccucugucauuuaugcaacaguuaucaccagaauacccaaguucauuuucagaaugaacaguugccacuacagaagcaaaacugguagagggguaugucuguagaagauaauguacacuaauagaacuauaauuguauuccuucgucuuucuuauugccuuuuuuacuuuuagcaauuuauucuuuacuuuuauaaacauaauucuuuacuggucugaauauuaaguuauauuucccucauuguuuauuaaauggcaguguugcucugaaaauaaaauuauacuuucacuuguaccuuuuucccugcuaacauuuaaaaaaaucuugugcuuuuccaaaugccacauuaagcacugaaaaugaaaagguaauagauacagccucugucuucaagaagcuuguaguuuauugggaaagacugaaggaugaacuuacaauuaugguucuguuugacaacuaccaugguagaggucuuaauacagagcuuuaggaacagaggaagaggggcaagccugaaauccagauuugggaggucugcagaaggcuucccggaggagauucuaugugugaauuaaaaaauuagccaggugugguggcggguaccuguagucacagcuacucgggaggcugaggcaggagaauggcgugaaucugggaggcagaguuugcagugagcugagaucgugccacugcacuccagccugggcgacagagcgagacuccauauaaaaaagaaagaaagaaagaacuaggcaaagaaauggaagauguucaacauguuccauguagagggagcagaagugaaagcuagaagcgucuaggaaaccaaguugugguuaguagcuacaguugaguguaaauaggaauggcaagaacuauguaaagaagagaaaaagaugagagaguaagggagauccuuuguacaggugugcacagucagaucaugcugaaugaagcauguucaagcuuauguucaaggaaguagagaaccuuugaacaaagaacaauaguuauuauuaguuuacuugcucauuuauucauucaacagaucuuuauaacuuauucagugggugcuguuguaguccuggacaauacauacugauaaacaaaguagcuguaauuucaugccugagaccuuacaguucagauagggacacagacacuaacccaacagauaacauuuaauugcuaguuaugacaaaggaacagguuuucagaaauacacaauaauuucuugaaaguuggaggguuagcagcuauuuuagauuaagugcucagagaggguccucugugaaagcggcuuuguccugggccuugaaggcuaagaagcuuaccaugugacaagugggacagaagcagcaaucauaaugguaauaagguggagaagagcugaacgugucuaaggaagacuaauaugacuggcgggcaagaacagugcaagcuaugcagggccuuuuauauaaggccauuccauaagaggaauggaagccauuaaagaguuuuaaagagggcgugacaucaucugauugauguuuuuaaaagaucauucuggguguuggguggaggaugaauuagagggggguaagauugaaagcgggaggaucagauggacuauuaaaguagccuaggcuggaugucuucuaacugagguaugcacacaccugaaagugcaugaacacuuucccaaaaggcacaugggcacaggcucucagccucuaaacauacguaucccugaaauugaucugcucaaaaggcaccuaaggugugcagauucuccuuuuucauuuuccccuucacgguucugcaccccucacuugacaacucuccugacucuuacuauccucuauuccucagaggugaaaaaacuuuggaauguuaacaaagggacaauucagcauauugguguuaagauaauggaugaguccgucagguuguuuucaacagaauugaaauaaaaccuaauuaaguugccaguugguagauuaugauaaauaauuuucgaugacacguuacuaucugguuugggguauguaauucugaaggaaugcaaagaguugaguuauauugcuacaacaaaacuccuuccauuccuauccauuuauaugaugaagguuucuuagugcuuacaucuauagaagugaaacauaccgauagaauugaugcugaacccuuaucuuccuuuuuuuuugagauggagucucacuucuucacccacacuggagugcagcggugggaucuuggcucacugcaaccuccaccucccggguucaagcgauucuugggccucagccucccaaguagcugggacuaaaggugcccaccaccacgccuggcuaauuuuuuugcauuuuuauuagagacgagguuucgucauguuggccaggcuggucucaauccugaccucaggugacccacccgccucugccucccaaagugcugggauuacaggcgugagccacugugcccggucugaaccuuuaucuuucuauuaauaguaauauuaacaagggguaucuaaacuaauaaaaguauaaaagucccauuaaucucauuaagauaauauguuuaauaagauacauuuuaauuaaaauguauucauguuuaauaauaauuuucuuauaauauuuaauauaucuauugguuuugauugauacuauauaacuagugauucuaaucauaacucagugcacaagaauucuuaaggguuaugaccacaggaaaauauuaaaauaucaaauuuaaauuuauauaaauauuuuuauugagaaaaguacaagacaggaucugugcaagccaucuagcacaaaguaaauuacauuaguauaaaauucuaaggagaaguagaauggaaacaaggucaaagagaaaaaggaaaauguaaauaauaauuuguccuuaacgguuuuugaauagaugaugauggauaucaaguaugguauuuguauuuuauuggauacuuccuuuucuuuaaaaaagugaugcuuuuuuaaaaaacagucuuuaauacccaagaaauuagaucuuugcaacucuuuaaauuuucgacguaaaacauuuauauaucaaguuaaaaucauucugucucaguauguuugugagcagaaaaaaagaaguauaaaaagauacauuuuaaaaaucauaguuguauaaacucuuuuaggagguauagaagcaaaaauguguagagagacuuuuggucuaugcaagagguugggcagaucaggcaauagcugaagagauuccacagugacaguggagauaaagagaaauagauagauuuaaaacgucuuuuggaaauagagcuaaaaggauuuggugaauuacauguauggauaaaggauagaagagaaaacaaagauggccauuggauuucugguuggccaacugggagaauagugguauaauuuuuugagaugagaaagccugagggaaaaauuugaggauaagaagcaagacaugguauuaaagaaauguuagcuacauuaucgucaguuuuagaauuguuaucagauauuuuuauuauugauuuagagaugaguucucgauauguuguucaggcuggacuguaguagcuauuuacaggcaugauuauagcacacuauggccucgaacuccugggcucaagcuaccuuuccacauagcuggcacuguaugcgugcacaauuuauauuuuuagccaaguuuucucuucugagauccaaaguuaugaaauagacaacaacccauuucauaucuuuacaccaauauuuccuugauaucucaaccagaaacuaaguucaaucuuuugauucucaccuuccaaccaguuuuucccccaggcuugcucaucucaucugagaggacuucuuuguaaucuuacaaagcugaaaguaggcuuacugaaugugagggaagucgagucugagagaggcagaagugauagguuagguacagaaauuuuuacacuguggcuuuccaguucaaaaggucguuccagaaccuuagggaagcuguauuccauaauggcgaagaagguggacucuggaguuagaaaccuugguuggaauuaggcucccaucacuuagaaauuaugaccuugggcaaguuacuugugggucaguuccccgagcuguaaaagaaauaguuacuacaucugccacauuaaagagaugguaucuguauaaagcaccuuuaacagauucugacacgugguaaagccauaguaaacaucuaccacuauugguacuucuguugucaccaccacugcccucugugguuccaaggggaggcacugcucucacugguuggcugaaggccccagagaaaugucguauuuauagacccugucugguugauucagcaccagcagugacaaacuuacuguuaaauucuaauuuacauaugucaaguguuaauacugugacucaaggaaauucuuguccucuccccaaucuggucucauauucuagaaguuguagauuugcaucaacugagaauaacacagucaccuaauauguugaucagauggacauuauucuuaucaccagauuauuuauucucugagagucugucuuagaucaauacagguucuuaaucuguacauuauuuccuauuuuacauccauggucuucucauaaaaagaguuugaguaggccgggcgcuguggcuuauaccuguaaucccagcacuuugggaggcugaggcagguggaugacgaggucaagaguucaagaccagccuggccaagauggugaagccccaucucuacuaaaaauacaaaaauuagcugggcgcagugcuaggugcccauaaucccagcuacuugggaggcugaagcaggagaauugcuugaacccgggcagcagagguugcagugagcugagaucaugccacugcacucuagccucagugauagagugagacuccgucuaaaaaaaaaaaaaaaaaaaaaaaaaaccuugaguagcuuuaguaaacugcuagaaauauaugcuauaaaauccaguucuaaugcugucuuucaguuuuacuaagccagauguucuauaguuuccagaaggaagggagggaggggaaaaauacuuucuuagcauuauuugaaacuaagcauugguuuuagaacguuauccuuagauguuauuccuagaagcaggaagauacggaaauuuuaaaaccguaaaaauauuuuaaggguuuagucuuuguaaucuuaaauuggaauuugaaacauuuguuuaaauuuaugacuuuuuucucuuaaacagucacacaugcauuuccuauguacugcaaauaccuagaaaacaaaucaucuucuuaguagcaaugcucacucguaguggucagauacgguuucuaaauacuauucaauauuagaaggacuugaaaucuaaacaaaaguuacuuuuuuggcauaaagugaauauuauaaguauacauuuuucuucacaagugcuuauuggcuucugaaaccucuguagucuuuauagcagcacugucaaauagaacuugcuaaaacagugguaauguuuuaugucuguucuaccaagaugguagccucuagccacguuucuguugaacacuuaaaauuuggcuagagcaccugaaaaacugauauuuugcuuuuauuuaauuuuaaguaaauuuuaauggccauaucugccuaguggcuacuauauuggacaguucaacucuauaguauguuggacagauggguggguggauggauggauggauggucggucagucagauggacagacagauagauacauggauaucuaucuaucuacauauacauaguuaguagauacuaguuaguuuuuccuccuaagccugacagaguugugacacuaggauauucaaauacaagcauuuucugauauaguuggucauuuuuuaaauuuuuguuuuuggaaaaacauuugugacauaaaaccauguuugucaaaaguaauuuuuccuuuaagaaauaaugguggaagacuagaucacuuucaagggauauuauaauugcaugugaguguuuucuuccacauucgugugguagcaucauguagaugcuuaaaguuaugacgugagugauggaauuaguggaggaaaaaggaguggaauaguuacagaaaugagagucaucuacauuagauguccauagugagaacaugccaccccagcauuguuaaaaguuuauguaucauccauucauuucgcuguucauucauuguuuaucuagauccuccuaugugcuagaaacugagaauacuuuacugaaccaaaugaguaugguccuuuuccucauggagcuuauauguuaguaggggagauugaucacagaaauaaacauauacuuuaaaauuugauccaugcaaauaaaaaaaguauaguauuuuauaaaaguguguaacaggggaccuuauuuagagugaauggucagggaaagcaucucgucuauuuuauuuuauuuuauuuuauuuauuuauuuauuuauuuauuuauugagacagagucuugcucuguugcccaggcuggagugcaguggugcggucuuggcuugcugcaaccuccaucucccagguucaagcaauucuucugcuucagccucccagguagcugggauuacaggcaugcaucaccacacccggcuaauguuuguauuuuuaguagagaugggauuccagcauguuuuucaggcuggucucgaacuucugaacuugugauccgcacaccuugaccucccaaggugcuaggauuacaggcaugagccaccgugccuagcuggagggcaucucuuaacacauugauacuuaaauugagaaaugaaaaugaaaaguaaguaggaauuagugaaauuaagaauggcagguaguuuacuucagcaggaaccacguguguggagacccuaaugauggaaauaguuuggcauaguucggaaaucaaaagaaaaccagaguucguggaguguacuaagucaaagugagccgguagcucuauggauaguaggugagugauugaauaaaugagugaaugaauggaugguguggcaugaaacuggagagguaggcagaaaccagaauauauaggauagucauguuaaugauuuuagguuuuaucucaaccacagugguuaucuuuuaaguaauuuuaagcagaagagcgguaagacuuauuuccuguuuuaaaaagaguauuccaggcugggcacaguggcucauaccuguaaugccagcacuuugggaggcugaggcaggucgaucaccugaggucaggaguuugagaccagccuggccaacauggugaaaccuugucucuacuaaaaauaccaaauuuagcugggcgugguggugcacgccuguagucccagcuacucaggaggcugaggcaggagaaucacuugagcccaggaggcagagguugcagugaguccagauugcgccaucucaaaaauagaguauuccagcaauuauaugaagaauaaauaggagaguaaggguagaaagggcugaggacauguuaggaaaacauauaauccaaggacauguagggugauggcaaaggagauggagaggucuauuuggagauaaacucagcaagauuugcuggucaauugcauguugaugaugagggagaggagagggaaguggcaagguugauuucuacgcuucuuaucacgaggaucuuuaaguggaugguugucuuauuccauuuaguguugcuauaaaggaauuaccuaaggcuggguaauuuauaaagaaaaggaguuuauuuggccaugguucuacaaacuguacaaggagcaugaugcccgcaucugcuucuggugagggucucaggcuuccacuugugucagaaggcagaguaccuuuuauucuuaauacaaacuacaauucuuguagauuuacugacacuuacugauuaccuacugucugccagucacucugguacauucuuucuuuauaauauuauucaguuguuaaacaacagauucucagauauauguaauguuuucuaggucgaaaacaagugccaguucuuguuggguccuuuuucagaagaguaaagaagggcuuacaugucuuaaacuacauguuccuucugagugaagcaaucucuucaaccuuaccuuauucccuugucuggaaaaauccuacuucuuccauaaaaccuuuucugaccuuccaagucugaguuacaugucucucucauguuuuuguuuuucuuuuucuuuuucuuuuuuuuuuuuugagauggagucucucucuguugcccaggcuggagugcaguggcgugaucucggcucacugcaaccuccgccucccagguucaagcaauuaucccugccucagccucccaaguagcugggauuacaggcgcccgccaccaugcccagcuaauuuuuuguuauuuuuaguagagacgggguuucgcuauguugaccaggcuggucucgaacuccugaccucaggugaucugcccaccucagccucccaaaugcugggauuacuggcgugagccacugugcccagccucucauguuuuucaacugcacuuguacuuaguccuguuuuuuuuuuuuaauaacacugcauuauuauuacguauuuacuaccuauugcuuuaagagacugucuccauuuugucuccuagaaugaaagcuccuugagggcaggagcugugucuuauuuacuguuguauccucagcgucuaccauugcaccugguacacaauggcauucaaugaauauuuacuaaguaauuaaauuaugagcgaauaaaugaaauuuuguccugacuuaauguuugcagcaucacuguacuuacuaaacaauuuaggauuuaaugguaauuuuaucauauuuuuauacuuaucuaaacaguguuuugaaauguuuucuuuguugcaauugcguuuccacuggauuugauaaacuacuuuuucaucugaacagaagaacuuaaaggugucagaauuguagauuuaaagaauuagaauagauauuuaugugaaaguuauuuacauuuuugugcuugauuuuaaagaaugguagccagaguggaaaaauacaauuuagaaaucauuauuaucccugaccuguccuucaguggcaaaacagagggcuuauaugucucaaaaagugaaugugcaaaauuguaggcccacuguuguugaccucuuagcuagugggaacuagcugaaagucuuauguagcagugagccuuccacucggaaguaccaggccaccauguuuaugaaaacauguaauaauucaaaacauucugcagagcagguauaaacugauuagaaucauuugaaaaucuuuuugauccuacuuuauuuccuuuuagugggacugaugcuucugaucaucacugguaaauuugacauuagguuuuucaagauuugccucaucuuucccggacuuggaaauagguucauaauauuauuaagacugauucauuucauauagugcuguaauggguuacauuuaauaguuuacagaaaucucuucuuaacauauccuaaauucauuuucuuugcuugcucuuauaagucuuaacugauuucugugagacauucuugaaaugaguagcuaagcaguccaaaaguguuacagauacaaacguuauucagaacuauguagaaucauucugucuuacaaaaaaaauagaguguuacguugguaacauaaacggugcuuguaaagcaguuuacugguuucugcagaaguucaucauguuuggucaaugcacagauuguagauacuguuguucaaagauacuucauuuuuaaaauguaagauguuauuauggaacaugauauugauaagcauauagaaaguauauuuuuaauguuucagguaccuaagagauaugacaguucacgaucaucuucucuuugccguuguguaaucaguucagucuuucaaucaaauucugucaagaggaaccucguagguuucacuguagacucucgcucugcugucaaggaguuugaauccccuuuguuaugguggcugguuaugaaaucagucacuugacagacccugaagugagacugcuggaaauacgucaugucugccuucauggugacagcugguuacaaaacaaaccccaccacagccauucugcaauugacaagggacuucaaaagccaacagggcugccacuucaaagagaauucugccaucucuggcuuguugaaagaaguuguuaaauggcuguacccugcccuaccagaaaucuccauguuuagacuucuccuucuuuugaucuuugaaagauguaugaaaugacuuaaguuagaggaaugauaaagucucuaguaauggcaacccagcacucugcauuuugauccauuuauuaauggaaauuacccagauauguucuaaugacaggagguuuaaaaacucaaugucucagagaaugaauguccaaaaaaagaguugaaauuucauaguauuguuguagccaccuuaaaaaaucuggaaauaguagggaagaaaaugaaacucaguguguuuuuaaaaccuuccauuucuucguguaauuuuuagcccuuuuaauggaaucagauucugaauauugauagauuagaaaacaacacaaaucuuuaaucauaagauuaaauuucaugguuaaaacggacauuucuccacuuuuaguaacucuguacuuaaaguuugaagcuaccuuguacuauauuuaaaguuauauucaucccuuucugcugaauacaauuuuaaaauaauuaccuuguguuuaucuuaaacaauaaaaaaagccuuagaguuuuaauagaacccuuaauaaaaggucagagugcuaacaaucaagggaaaaggcagcaacaugaacucuuucuuuuagaauacggauagcccuaaaagauggaguaauguuuaguauacuugaaaaagaaagcagaaaacuuuauaaauaauauaacaguaaaaaaaaaguggagauuuuauacucaacaugaacuuggaguguaaauuaguuggaauuuaaaauccuucuaagugaauggcaugaccuuuuccuaauuguauguuuucucucucauccuauguguauaggaagauaaagcuaaagaucuuuagauucauuugcccugaucuccuauuuucuuauuucucuuaaaauaucucuuuacauaaaauuuuuagaaaucgaguugacagaagcuuuaacgacuguaacuuccucuauaauuuuaccagauggggucaguagauaacuacuaaagaaauucugaagcagaacugaagcccccaggaaauaaccccaugacauaguaugaccaaaaaauucucuagaaacaugaguagucgcucuucaaguaaugcauuuggauuugucuuuuuuuguuguuguuaucuuaguuucuuccucuagaaaaaccuccagaaaauuuuuuugacaaaguaguacaugauauuacuguccuggaaguccaggaaauaucuaugccuuuaaauuuaggcucgaguuuucauuuuauucagcaaaaggacuguaucuguguuuucaaaaguuagagcgaugugaaaaaauuaaguccaguggaaacaaaccuuuggcacauccaaaauuaaaccccagaaaugacugccagaagucuauggauacugguuuucaaagcagacuuuuuuuuuuuuuuaauuuuauuuuauuuuauuuauuuauuuuuuuuugagacggagucucgcucugucgcccaggccggacugcggacugcaguggugcaaucucggcucacugcaaccuccgcgucccggguucaagcaauucuucugccucagcuucccaaguagcugggacuacaggcgugcgccaccaugcccagcuaauuuuuguauuuuuaguaaagacgagguuucaccauguuggccaggcuggucucgaacuccugaccucaugauccacccuccucagccucccaaaguccugggaugacagaugugagccaccgugcccgaccagacauguuuuuauacccuauacucuaucuaaacugcagagcaacuucuguagcaggaagcacucuuggagucuaugugguggaucuauaccaagggauauaucguucgcuuguaaugaguucuugggguguuuggcucuuauuucuuuucuccuacugagaaguuugauaaaccaaguuauugaucauagaagcagucauccaagauacggcugaaaguaaagccuugggagccagauggcuucccgcugauuuuuauaugcaguuuauauucuccuuggcugugucuuccuggauguuucaaugaaagauauuuuuuucuggagaaaugugcacggugggauuuauccuauucaacagauaguuuuugugugugucaugucccaagcccuauuuggacauucaauugucccuuccucuugucucuacccucuuuaauaaaugaauaaagaugcauuaaaauuaauguaaagugcuucggauuagaagucaagugacguggauucuaauccuuguucuguguacuaacagugauuuggcauaaguuuuguaaucucuccaaguaucuguaaucucaccuagauggaagaaauuauuauccccacaaguauccacucaccaccucacauugagauaaguauuugcaaggguuuuagucgcuuacaaaggcagcauacaaguguugagccuuauuauggccaaaaucacacacacacaccagacaugcgcaaacauacacguaucauauaugcacauacauacacauauuauacacgcacuuacgugauguuuaugaguuucccucuugguguccuaggguuaccagacauaaaaucccauccuuuuacuuuucucccuuggcuaauaguauacuuuugauaaggucaaguaagugucauuuuauuugccaacauuguguuucuaacaacuguccaggguuguguugaaauaaauuuucuccacaaaaugugugucuaauuaaugaaaugucaacuuuauuuauuucuagguggcaguuugguuuuuuucaccauugcaaaugagaagaauuaaaauuuccaguuaaaauggcagugaacuuuuauuuuuguuaaaaacuuaaggaaaguguuugagucuguuuuacucacauuauuucauuugaucuuagaagaagggcugaaucccuacauggucuguuuuguuugcuguuuuccgaauaaaaugcaauaaauauuuucuccauuugagaugaucagauuauuuaaacuaagaaggaaauuucuuuccaaaaccuggacaaauuauauagccauucaacacuugcuuuauucuauuguguuaacucccuagcaaagcaaaaaaaaaaugccuuuucagaagagaaauuaucagagcucagaguucuagggauggucuuugucauuccaccucuauucauauuucauuuccuaaauuagacauuugucacaaacccuaaugaaauauuaagagcucucagacccagaugcagaagaaagcauaaaauggugguugccacaucuucuuuguuacuacugcuggaggaagaaaaugcaaucuauuacuuagauuauuucuguccucccuucuuccaggagcuuauguguacccaguagaucauuaauuuuuuguguuaauugauuccauuacaaucuguugcugaaauaagcaaaucuugggagauaaauaauauuuugcugucaaagcaugauguaggcugacuuaaaaauagaaaaaaugaaauaauauucugcugaaaagauaguuuguuuucagggcauuaauucagguauuuauuuuuuaguuuugaugcugugcugucaaagucaccuaaauagaauuggcagugaugaaacacuggcccgucuuagccucuuucuaacaucagugacgcaagauacugagggucauagcagcagggggauguuugcuuugaaaaugugcauccacauuuuauugugucuuauuuuucaaacccuacuuaggagugaugagugcuuauuacgggauuuaucuuccuaagccuucugaguugauuuuuuuuuuaaauaaaaggaaaauugagauggcuugaaaaagaagcauuucuuucacacugauacguuuccacucucuuuuaaaaagagugggaaugggaacacuccccagagugacucaugagauaccauugugggugauuuugguaaacacugauacaugguagcaaagcagcgcucaguguguacagcaggauggagucggacuacucagcuuggaauccuagcuuugcuuucucuguaugaccucggacaaggcacuuaaacccacuaacccuguuucuuuugccauaaaaaugaggauaauaauacuuuauacccaccauauaggaucauuuugaggcuuuaaugagacaauacaucuaaagcacuuagaacaguguacuucaaaguagacaaauaauguaaguaauuauuauugcaauaacuauaguuauuccauaguuauaaaauacuguacugccgguauauaucuugucaaagaauuaccaugaguuggcaaaaagaacguauuggaaaaaagagauuucuaguguaaaugauagccuaaagcucucuugggaaauguaaauucaaauuuucauuagcaauaguugugagauccucuaaaggaauuuccuaggaaaggaugauagaauuuauguauguagguauauguguauauauguuuucacuaauacuucaaaaaugcuccuccacucaagagcuuguuaccuuuuuuucuucauaauuauaaaacaguagguuuuaaucuggaacuuuguucuagucagggaaaccaguggacuucucaagugacaaucuggcuugcauggugacugcugaaccucuggauaaucuuuuuguaccacucccuuuuucuucuaauuguuuucuucuuguggagacuuacgccuuuuacucucccaagagaguauaacaagauuuuccauacgcaucuuggaaacuacaaaaaguguuuuucuccugguuguggaacagaagaaggugggaaacuugaagaagcgggcuuugccagccucugaagcccccuguugugcugcuuucuuaaggaaaauaggucugugguaaagucauaauuuguucccuucuuauucugagcaaaaguuuauuagcuugugauuuaagcaaaccaucugguccugcuggcacugcacacugucaggccccgugcuuucugcuuauuauguuacugaaggcaguuacauauuugagucccagcucuggccugagcuuuucuguguuuuaaaacgucugcuuuugaaaauugugcugugaccuggaguauauuuuuaaaguguggauaaauucuucauuguuuaguauaggauuuaucucuucuuuucuucuacucaucggucuuuacccucguuucucuggcuguacccaauacuguacaacugcucagugguaggcaugaaauggaaccaagugauucuagcuggaaguguucuccuggauuguggaaacauagcagaaaaugaaguaauuaaauuugacuuugaaacuguuucccuggcuuagagccagagagcaaaucagaugauugauuggaaauaccaggaauguaugguaccauucuugccuugaauacuaaaaugcuuuagaacuuacuuggauauauguauaaucugaggcagaaauacuuugagggucucacacucaaauggaugggaaaauuaagcaaucuuuaagaaaaugauuuuacuaacagauaaaaaucugaaagguagagauuuuuaaauuuuuuaacaauauguaauaguuguacguauuuaugggguacaugugauauuuugauauauguguacaauguguaaugaucaaaucuggguaacugggguauccaucacuucuaacaucuauuauuuccuuguguugcaacauuccaaaucuucuagcuauuuugaaauucacaauaaaugauuuaacuauagucucccuacugugcuauugaacacuacaacuuacuccuucuaucuaacuguauuuuuguacccauuaaccaaccucccuucaucccccucucccuccuacccuucccagccucugguaaccaccauucuguucacuaucuccaugaaaucaaauuucuucuagcucccacgugugagugagaacaagcaacaucugucuuuccgugccuggcuuguuucacuuaacauaauguucuccaguuccauucauguugcugcaaaugacaggauuucauucuuuuuauggcugaauaguauucguguguguguguguguguguguguguguguguguguguguguguauacauaccacauuuuauccauucauccacugauggacacuuagguugauuccguauuuuggcuauugugaacagugccacaguaaacaugggagugcaaauaucuauuugauauacugauuuccuuucuuuuggauauauaccuaguagugggauugcuggaucaugagagaguucuauuuuuaguuguuuaaggaaacaccauacuauuuuccauaguugcuguacuaauuuacauucucacuaacaguguaugagugcucucccuucucugcauccuugccagcauuuguuauuuucugcuuucuugguaauagccauuuuaacugggaugagauaguaucucauugugggguuuuuuuaggagugguuugagggagagacagugucuuguucuguuacccaggcuggagcgcaguggugugaucauagcucacugcagcugcaaacuccugggcucaagcaacccuccagaauggccgagacuacaggugugcacuaucgugccuggcuaauuuuuuguagagaugaagucucacucuguggccuaggcuggccucaaaccccuuccuccugccuuggccuccuggaauuacaggcaugagccaccacucccagcuucacugugguuuugguuugcguuucuuugaugauuagugaugucaaacauuuuucauauaacuuuuggcuuuauuuuuaugucuucuuuugagaaaugucuauagagaucuuuugcucauauuuuaaucgaauuuuuuuuuguuugcuuuggaaguaagaguuuugaaugaaggguaaaauguguccuuaaacaugacagacuugaugcuggggaaguaacuuucacagaaacaauugaagauagucaauaaaauugcauuuauaucuuggcaaaaagguaagaaauucucaggucaggggaugaacagguagggaauucaaaaauaaguacuugauaauuauugaacauuggguuuuauaucuucauaggauaaaagaaaagaucaaggcagcccaagauagucaagugggaaaccaaaucccugucacucuuuuauaaaacaaauccacaaagcccaaaauucauucuuugaaaacaccaagaaagucagcuggucuuuggugagacuaaaagaaaaaagaaaaauggcacaaugaacaauauuuauuuuagaaugauagaggguucacaacuacuagucuuguaggugcuagaaagauauaaagauaucuuugccagcacauuugaaaauuuagacuaaaugaccaaaugccaggaaaaauugaacuuagcaaagccagcuaaauaugaaaaagaaaaccugagaaaaaugaggcaguaauaaaaauuuuuccuacaaauuucaagcccagagauuuauauugguaacuuuuggcaaauauacaaggagcaaauaauuucaaucuuacagacacaauuuggaaauauaaaagagagggaacaaucacucaacaacauauuuaauaagguucacauaacuuuauaucaaaacuuuacaaguuaauacaggaaaagaaaagcuuaggccugucucaauccugaacauguagaaaaauuccuaaacauaaucagaccaauccaaaauuaguguacacaaaaaagaaaaaugugcaugagcaaguuuuauuccaagaguucaagguuggcuuaacaguagaaaacuacuguaauccuggcuaggcgugguuaauuuuuuguagagauggagucccagcacuuugggaggccaaggcagguggaucacuugaagucaggaguucaagaccagccuggccaacguggcaaaaccccgucucuacuaaaaacacaaaaauuaaccagacgugguggugcauaccuguaaucucagcuacuugggaagcugaggcaggagaauugcuugaacuggggagauggagguugcagugagcugagaucacuccacugcacuccagccugggcaacagggcaagacuccaucucaaaaaaaaaaaaaaaaaagaaaacuaauuacuauaauccaucacaguaaaagaugauagaagaaaaguuaaguguucaucucaagaaaugcagaaaauuuaacauucauuuauaauuuucaaaaauucuuaacuaccuagcaauacaagggaauuuccuuaacuuaauaaaggguaucuauuaaaaauuacacuacuuguagauaaaacuuauaaaggauucuuuuuaaagauaggaauaaaauagaaugcaugcuaucaccaugucuguacagcguuguaguagucauucuagauuaugcagcauggcaagugaaagaagugaauauuauaagaauuacaagaaaagaaagaaaacuaccauauuugucuauauaguaaacuucaaaaucugucaguaagagcauuuaagaagacugcuagauacagauucaauuuccguaaucugcacugaacagaaaauuuacauuuuuuguaaaaacgauacuguuuacuagaaaauuaagcauauaaaguaccuaggaauaaauauuauuaggauguuuaacauuuuaaugagaaaaauuauuaaacuuuaugaaagauauuaaaguucuaaaaauauaucuaguucauuacguguucuagaacaguaccuggcauaugauaaaaucuaaauauuuuugcagaaguucaagaauagcuaagaugcucuugaagagaacaagcugagacuuauuagauaucaagccuuauaaagugauaauaauuaagauaaugaauguaguauugguacaggacuaggcaaaagaguggaucauaauagaaagugcagaaauauccaugcuugugaguauacuugauauauaucaaagguuaagauagaauagauuuuuaaauaaaugguacugcacauuggcuauccauauggggaaaaaugaaaucagaccccugccucauaccauauacaaaaaugaauuccagauggauuaaggacuaaacaugaaaagcaauacuuuaaaacucuuacaaaguuuaucaaucagauauuguauaacgaacaaccacaaaauaucaguagcauauugugaugguuaacuuuauauguugacuugacuggcuacggggugcccggauacuugcuccgacaguauucuggguguuucugugaggguauuuggggaugagacuaacauuuaagucagcaaaauugaguauaguggauugcccucccugaugugggugggccuuauccagucaguuaaaggccugaguagaacaaaacucugaucuuucccaagugagagagaauucccucugccugacugccuucgaacugggacauuagcuuuuccuugcauucauucagacucagacugaaacccuggcucuuccugggucuggagccugcucgccuucagacuggagcuauaccauuggcucuccuggcuuuucaagccuuuggauuuggguuggaacuaugccacuggcuuuccugggucuccagcuugccaguucacccuauagaucuugugauucaugagccaguuucuuauaauaagucuuuauuuacacauauacacucuguuucucuggagaauucugacuaagguacagacaauaccaagcauuuauuucucguucacauacauggagggugagcaugguuggcucugaguuuuuuugcagaaauugacaagcugauucucaaauucacauggaaauaaaaaggagccagaauagccaaaaacaucuugaaaaagacaacagcucagauuuucauagagauuauguugaaccuguagaucaguauagauuaugguucuuauccauuacugauuuuauguuauaaaaacauagcuugguguauuauuuguacccaguuuuagauaaaauuuuacaugaauuaaacugauaaaauggaaucaaugguauauguucauguaaagcuugcagauaugcaaauacauaucccaguauauuacauagcaauauauucucuuuuuuguuuguuuguuuguuuaguagagacaggguuuugccauguuggccaggcuagucucgaacuccugaccucaggugauccaccggccuuggccucccaaagugcugagauuacaggcacgagccacagcgcccggccguaacaauauauucuuauggcaacugggacugugaggaugcuguuagcugaagacauuuaacuugcucacuucuggaaggauaaaaaaauucaggugccaaaaaaacuaaaugcauuugcuuacuaucauuguuuaacagcuguuaccaaucaacguggaaacuuuguuuagguaggaagcacuaauuuccaagggucagugaaacaacuuugauuugucaugcugauuuuugacucuagguuucucuguuuuaguaucacacaaaugggguuuauguaggagucaaugaauggcaaaugccccaccucuaccugcccuaccuucuacuucugaaaagacugguuauuaccaagauuauuucuuggcaauuaacaaccuaacauaaagucuuguaauugaugcaguuggcuguuugauuacauuugcuucugaauuaaaaugaacaaguuuauuuaaauaauucugauuugguagccaccuggaauaaguggaaauuacugauaaaguacuuaccuugcucucuuaguuucuuuuccuuauguuuuagcauuuugucugucuucucugguggcuuuuuguuuguuguuuuucaggucuguugcugucaaggcuuuuuuuuuuuccccaugucauuuuuaaagcauucugucuccuuucuaucugguauguacacacacacacacacacacacacacacacacacacacacacacacauaacuauauagguauauagggauauauuuccuuccugccuauauaauauauaguauauauauaauauauauauauacacugccuauguaguauauagguauauauaugccuguauaguuauauagguauauaggguuauauuuccuuccugccuuccuuaaaaaagaaacccuaccuaccuggauuuagagcaagaaauugucugauugaauucuagcaguuucuuuaaaaagaaauucuucuuaaugauguaaauaggaaaauuuuaguuuagaggacuaaaaauuauucgucuauguauacaggaaaucuguuauuugccaaguuuaugucuuuuauuuccuaaaaucguucuguauauuuuuuuauauuuguauuguauuauuuccauggaaauuucugggucauuuccaaagaacuuccuuaaaagguauugucuguggcagcgugcgacuucuuaaacugauaacuuguaugcccuugcauguauuaaguucuuucugaccuaagcugaaaagaauuauacuguagggauguuauuaucugcuauauugauucuugauauauacacacacauaacugauccagaaagaguacagaauuuucaauguguuccugcgucucuucaauuuucuggacccaggaguugcguguuacccagguccucugacucugauugaucaagacacucuguuguucucuuucccauauuuaugauagguggaggaguuacugauggccauggagaagguaaagcaggaacuagaauccaugaaagcaaagcuguccuccacccagcagucucuggcagaaaaggaaacucacuugacuaaucuucgggcagagagaaggaaacacuuagaggaaguucuggagaugaaguaaguguuuguagucuuauucuucaagcauaugcuuaguggaaauacuuuuucucccugcauucaucuucuggcucuguguuuuaccccaauacacuuacuuaauuuuagugcuaacuuguauuucucacucucuagaauaaauuuggucaaagguggaacaaauccugaucaaauagaaauauuuuugguuccucuuuaaugauuuuuaaauccucuggcuuauacauaucuguguguaauuaccucucugaaauuccuaaaaucuucuggaaaguucaggcaaaauggcgagcuuacuggggaagagggcuguugguucugagguuguaugaagacuaggcaauuuuuaaacacauuuuuuauuguaaacauuuccaaagguacacacagguagagagaaugaacccccauauaccugucuccaagauucaguaguuaccauuuugccacacuggaagccaauuuuuagaaaauugucacuuuuagcagagcuuugcuauacacauuuuccugcuucccccacauuuuguagguugcugagaccauaaucuguugugaagcauguauacaucugcuaauacauaguagauguuucuuuuacuucucagugaccuucuguuuaaaacaaacaugugucuuuugaaaauccaguuguacccucucauuuaccauuccuaauccuuccccuuaccuaaagacccuacugcuauuuuacugaaaccaggucuauccugggaucccucaguuacccucaguuacccucguucugugagcaguuaucuuuauuuuuguugucuucuuuucugucucagagaauagguuuuuuucuccuucauaaggccagauucuucuuucugucacagauuucaaguccccgccucagcagccuuucacugucaguucuuucucacgugacccuugcucacuucuucucugcauaaaugcacagucugucuuuggccuaaaauaaaauuuuuucacuccaacuagugcuuuaaacugacaucaguuuacuuuucugcuacuuugaacuaucaguaaacuuugaauaccugaauaauagagcuguacagaaucuugccauaauaccuuagcaugaauucucaugggacaugaugauugugauauugugacugcaacccaagaauguugagguguccucugugcuuucacguucuugggcuauagugcaaggcuacgagauucuguccuuuuagaaaagcauuaugagugauaugucuuggaaguaauguguaagugaagccggaaguggauuggcauagggggagaauuaagagagguuagaguuccgaguagcaucaucagaaaaaagcuugcagguuuaaguagagaaaggaaaguccucccugugacuguuggcaaugacacuagauucuucacucuguagucacugcaggacccaccauauuuuaaagguuuaaauuauucaauuauugaucauugaacaagugaaaagauuuagucuaccuagagaacuugagaggcagaaauaugaggggaaugaagugugcagggagacugaaacaugcguaugugugacucuggagcuagaauaagacagagucuucccucaggaaaagguaguuggcccauuugcauagaaaauucuucagcaaagcacuagaauagcuuuguuuucuggaauaauccugacuucaucaagccaagagaaaugauuuaauagcuauuuuccauuccuagcauauauuaauguaauuuuugagcgucuguuacagauaaauggugaccguaaguuuggggagacguaaaacgguucacuugguagccugccaguggugcauuggaaacauuugcguugguuauagccagcccuggagaggaggaacguuuuaauuggcagaucccacaaugggucuucucuuccuuaugcugugguuuuguuaaccauuacuuuuuuauuccacuuuuauguuagcguuuuucccuuaagaaagaaaggauaaaagggagcaggggaaaaauaauaaaauaacaacuguaauaacuguaauaaauuuuaaguaucaguugaggucaugagguucacuguuaagaauucuagaugaacuaguucauucgacacugcccugcauucaaacuccuccugcaggcccacccuacauuagcauucagaauaaauuuuacaaguccauuuuuuauuuuuaauaaaauuuuuauuaagcugugaauuugacugcccugacaacugguuuguucagggaagggguggcagagcucuuugguuucauugagaguuuagagcuauucaauagguagccuccuauaugcaggcaguuaguuguaagucauucaaagaaugaaaccaacgaguagaaguuaaaucacuauacucauugggagcuuaaaaaauaaauaaauaugauuuaaaagaugaugucaacacaggugaaaaaggaaaaauauuagaaucuccugaacugacuagacagacauguuuagaagacuggucuucucuggaaacaaguaaagcuggcagagaaauccaaauaucucuguguuaaauuauauacucaugagaugcuuucuggccaaaaaaaggucucccacaaacagagaauaaauuuucauauguaccuaagaagaguccaguacuaaauucugacauuuaaaaaauuauugacuguuaggagagaaaaguagaguacaauugugauuaagagagcuguuaacaggccgggcacggugguucacaccuguaaucccaacacuuugggaggccgaggcggguggaucaccugaggucaggaguucuagaccagccuggccaacauggugaaaccccgucucuacugaaaauauaaaaaauuggcuggacgugguggcucacgccuguaaucccagcacuuugggaggccgaggcugguggaucacaaggucaggaguuugagaccauccuggccaacauggugaacccucgucucuacuaaaaguacaaaaauuagcugggugugguggcgcacacuguaaucccagcuacucuggaggcugaggcaggagaaucacuugaaccuggaaggcggagguugcagugagcugagauugcaccauugcacuccagccugggugacagagcaagacuccaucucaaaaaaaaaaaaaaaaauuaaccaggcauggcugggcacgguggcucaugccuauaaucccagcacuuugggaggcugaggcgggcagaucacgaggucagaagauugagaccauccuggcuaacacggugaaccccgucucuacuaaaaauacaaaacauuagccaggcgugguggcgggcgccuguagucccagcuacucgggaggcugaggcgggagaauagcaucaacccaggaggcggagcuugcagugagcugagaucgugccacugcacuccagccugggcgacagagcaaaacuccaucucaaacaacaacaacaacaacaacaacaauuagccaggcgugguggcgugcgccuguaaucccagcuacucaggaggccgaggcaggagaaucacuugaacccaggaggcggagguugcagugagccgagaucgugccauugcacucccgccugggcaacaagagugaaacucugucucaaaaaaaaaaaaaaaauugugggguuguucacauucuaaaaaaaucucauuagggauuuaugacaugguguuccaaauuaaccacaaaauuguaaauaguuaaccaaauuauauccuaguaacaauuuaggggggaaaauaaaaaugaaaaugcauucugaguuacauaagagcauguuuacucuucacaaagccauauuuauuuauacuuccaccaaaagccauuuuuuuuaagucuguagacauaugauaaaggacuuuuaguggacuuggaagcauuuuucacaaugggcuagaauacugagguugaauguuauguaggaaacccacauaauauaaaauuauuuuacacuugaaaaagaaaacaauauguuguacaguauagcuauaaacaaauagcauuggugggucugggacuaguuaaaauuaugaagcaaaguuuauaucuacaaucaacuaucccuugggacuccuccucaguuuugcuuaacucucucauucugcuucccuuuuuucugcccugauauucagugcuuuuauacggcccacccuauagacauuucuuuacuuucuugugacaugaauuggaauaaauuacaaauaacccuaaauguucuuugccuuucuccuucuuuaaauuuuaaacuuauuccacauuuuagcuuuuuaagaucagacauaacuuccaaauagaagaaaccauguuuaaaaaaaaauccaugcuuuuuaaucauuuucuuauguaaaaagccucaaguggcuggaauaaggucuaaguaacaaauaaagaacuaaacuuuucagauaaaggcuccgaaagucccucuuguuuucagcuuucaaaauucuuucucucucucuaucaauauaugguucacguguaaaaaugugcuuaccuguguagggaugaaauuaagacugucugucaucuacuccucacaaaaggaaggaagugagauuauuguccuacuuuuuccuuaucuuuucuuuuuuucucuguuggagguauaggaucaacccucaucccuuuuguuaaauauaaaugaaucauuuaaaagguuaauuauuguagguagguaaccugaugcguuaaccuaauugcaauacccaguugaagaaaaucugauauauaauuuaccaguauggcagguuuuuuugguuuuguuuggauuuuugauguuuuuuguuuuuuaauuuuccuuucaggaccaucuuuuucauuguucuccagaguguaccuuauagguagcuacucacucuccaaauagguaaaacuccccucaagcuauggaugucaaagauaguaaucuauccauuuaaucauaagcuuuucuuccagaaguuacugaaugaaagaggauuagaagauggucuguguagcaaaggauuugcuuacauuuugggccaguuugcuuacccgugaagcaggcauaguaagacuuagacccaccucaugaaguuguuguacggaucaaaugagauuuuaaaaaagcacguugaaguugguaaagcugaaugugcuugcaaagcaugacauuuacaacugaaaauccaauuugugcuuuuguguucguaccuggagaaaucacuuagcuuuucaggucugcaguuuucucacucagauucgaaaggucccccaucgauuuaaaaauuguggacuuuggccagaugaccuccugagguccccugauucuguaguuguaaauguccuguguaaaucagggaaguaauucauauacaagcacaguauacugaggagaaguuggaagccagguaucaugauuccuggcugaggacuaggcuacguguucacugaaugagacugcccaaggcuuaccagagauuagaugcuacagaaugagaguggaauuguaauauuagagauagagccguggggaaucuggaguuccaacccagucaacauggagaaauccuuguuaacuucaguuaucuagcugagauaacacaaaagauagguuugaggaacaaggaccaugcucuaauauaaggccuacucuagacccaggcuaagacuaguaaaagaaggccccaauuaauucuuacaggguagaccaaauuuggacaaugagucucaccgagauagagaagccugggaaauauccugagcuuucagcagaucagcauaccaaagguuaaauccaaaccuauacaaguucaaggagucaacuauuaacugacuuauauguacuagaauaaaaaucacugcuccucagaagaaauuaacagaaccauauuugcaauauaucccauguugaacuuuuaauuaccagacaugcaaagaaucaggaacauaugaucuauagagcagaaaagagcaugcaguagaaaucaccucugaggaguccuauuugguuuaacagaaaaaaaaaaaaaaaacaacuaaauucacccuuauacauuaaagaauuaaagaaaaaugucauguugaugauggaauagauaggaaaucucaacagagaaaggaaaaguauuuuaaaauggaaauuugacauagugagaaccugucucuacaaaaauguuuuuaaauaccagccaggugugguggugcacaccuauagucccaacuacuugggagggugaggugagaggauugcuugagccugggagauugaggcugcagugaacuuugauugugccagcauacuccggccugggcaacaaaaugagacccuaucucaaaaaaguaauaaucauaaaaugaaaauggaaauuugauaauugaaauagaaaugaaacauuuauuggauagucuuuuuuuuuuuuuuuuuuuuuuuuuuuuugagauggagugucgcucuugucccccaggcuggagugcaguggcgccaucucggcucacugcaaccuccgccuccuggguucaggcgauccuccugccucagccucccgaguagcugggauuacaggcaugcgccaucacagccagcuaauuuuguauuuuuaguagaggcgagguuuuuccauguuggucaggcuggucucaaacucccaaccucagguuggccucccaaagugcugggauuacaggcgucagccaccgugcccagccuauuggauagucuuaauggaaaauuagagcugucaaaagaaagagucagugaacuucaaaauagaucaauugaaauuauucaaucuguagaacagggagugaaaggauuuuuaccgaaugaacagagccucagugacauguaggacaauuucaaauggguuaacauacauguggaacacuagaaggauaaaagagugagaaugaagcagaugaaagacaguuuuuaaaaauggccaacauauuucuauaauuuaauuugaaaccaugaaucuuugauuuacaaaucccagaaacuaagugaaaccaagcaggauaaauacaaaaaauaaaaaaaucacaacuagaaauaccauaguccaguugcuggaaacaaaauaugcagagaaaaauaaaagcagccuaagaaaaaaggcacagugcauaaagggaaacuaugauagcugaguccuuaucagaaacagugaggaccugaagacaauggaacuucuuucaggguacuaaaaaaaaaaaaaaaaauuagccuaaaauucuguaagcaaagaaaaagauccuuuaaaaacuaggauuaaauaaagacaauuucauauaaacaaauaugaaaagaauucaucucuagaaagcacucuagaagaaaugcuaaugaguguucuucaagcugaagggaaaugaauccagaugggagcaugaaucuacaggaaggaaugaagaacaccagacaugggccgggcacuguggcucaugccuguaaucucaacgcuuugagaggccaaggugggaggaucacuugaguccaggagucugagaccagccuagacaacaugacgaaacccuguuucuacaaaaaaaaaaaaaaaaaaaaaauuagcugaggaugguggcucauacucuuguuccaauuacuugggaggcugagacugaggauuccugggcccaggacacggaggcuguaguaagccaagaucacaccacugcacuccagccugggugauagagugagacucugucccccugccaaaaaaaaaaaaaaaaacacagacaugguaaaucaguugauacauauagaaaauguauuuuuucuucucagaauucccuuaaaagacaacuaaccauuuaaagcaaaaauaacaugaugaguuggcauuuauaauauguguaaaagugaaagaugggacaacaguaucccaaaauauuaggagguagaauuguaagguucuuacguucgugaaguagaaaauaugaacuguuggcugggcauggugacucaugccugugaucccagugcuuugggaagcugagacuggaggaucacuugagcccaggauuuugaguuuacacugaguucuguuugugccacugcacacuagcaugguugacagaguaaaaccuggucucuaacaaaaaaaagaagaaaggaaagagagaaagaaagauagauuacgaaguguucgaugugaaguaguacaauuucuaaucuaaauagacuuugauaaggugcauguuguuagcuguagagcaacuaccaaaauaauaacaacaaaaauuuuaaaaacccugaagagcggccaggcaccauggcucaggccuguaaucccagcacuuugggagcccaaggcgcacggaucacuugaggucaggaguuugagaccagcuuggccaacguggugaaacccccaucucuacuaaaaauacaaaaacuagccgggugugguggcgggugucuguuaucccagcuacucgggauucugaggcaggagaauugcuugaaccugggaggcagagguugcagugagccaagauggcgccacugcacuccagccuggacgacagaacgagacucugucacaaaaaaaaaaaaaacaaacaaacaaagaaaaagcaccugaagagcuaacagaggaaauaaaaugcaaugcuaaaaauuguuucauuuauccaaccaauaaaggcagaaaaggaacaacaaauaaagaacagaaacaacaaaugaaugacauaaauucaaccauaucaauauuuauggcaaaaugaaauauaguaaacacaccaaguaaaggacagagauacuagauuagaaaaaaaaaagcaaggcucaacuguaugcuguacauaagaccuguacuaucauaaacacuggcuggaauuaacggaaaaagguacuucuuggaaauaguaauccuaagaaaccuggcauagcuauauuaauaucagacaaagaguauucccagagauaagaaaagaccauauaauaaagauaaaggggacaacacauccaaaugacauaauaauccuaauaaauauauaucuaauagagcuucaaaauucaugaaggacagaccgacagaacuaaagguaaaacaaaucuguggucaccagucauuacuggggauuuugaccucuauuccuuagaaacugauagaauuacuaaacaaacaaaagcaaucagaaauauagaagaucuaaagacuauuaacuugacuuauuuaacauuuauagaauacuacaucuaacaacugaagaaaauauauguuuuuuaagugcauauggaaguuucacagauacagaccauaugcugggccuuaaaaguaagucucaguaaauuucagaagacugagauaugcuaaaguuguucucuaaccacaguagaauucaguuagaaguuaauaagauacuuagaaaauguuuggaaauuagauaacauaauucuaaauaccauggcuuagagaagaaggaauguuaggacucguuuugaacugaaugaaaauucaaaugugaaguuuuguguuucacaguugaaaaagugguuagaaugaaauuuuuacccuuauauaccuguauuagaaaagaagaaaaguugaaauucauugaucuuaguuucuacacuaagguaccagaaaaagaagcagaguaaaccacaguaaguaggauaacggaaauauuaaagauaacagaaaucaaacacauagaagacagagaaucaacagaaaauucacaaaauucauaaccggguucuuuaaagaauuaaaaaaaaauugauaggucccuaccaaauggaucaagggaaacaggaaggcacaugaauugccaauaccuggaacgagagagggguuaucacuccaguuucuaaagacacguaaaaagauaagacaauauuuugagcaaacuuauaccaauaaauuuaauagacaaagucuuugaaaaauacaauuuauuaaaacuggcucaagaaggaauagaaaagugagcaggccuuuaucuauuaaagaaauugaauuugucauauggaaccaaaaaagagcccaaauagccaaggaaauccuaagcaaaaagaacaaagcuggaggcauuaugcuacccaacuucaaacuauacuacaggacuacaguaaccaaaacagcaugguagugguaguaaagcagacacacagagcaaaggaacagaauagagaacccagaaauaaggcuguacaccuacaacuaucugcucuuccaccaaccugacaaaaacaagcaaugggggaaaggauuccuuauucaauaaaugguccugggauaacugccuagccauaugcagaagauuaaaacuggacucuuuccuuacaccauauacaaaaaucaacucaaaauggauuaaagacuuaaauguaaaacccaaaacuauaaaaacccuggaagacaaccuaggcaauaccaugggcgcgggcaaggauuucaugacaaagacgccaaaagcuguugcaacaaaaacaaacaaugacaaaugggaucuaauuaaacuauagagauucuggacagcaaaagaaacuaccaagagaguaaacagacacccuacagaaugggagauaauuuuuccaaauugugugacaaagguuuaauauccagcaucuguagggaauuuaaacaaauuuacaagaaaaaaacaaccccauuaaaaaaugggcaaagggcgugaacagacacuucucaaaagaagacauacauguggcuaaugagcauaugaauaaaagcucaaagucacugauuauuagauaaaaugcaaaucaaaaccacaaugagauaccaucucaugcuaguuggaauggcuguuauuacaaagucaaauaacagaugcuggugagguugcagagaaaaaggaacucuuacacacugucggugggaguauaaauuaguucaaccauuguggaagaugauguggcgauuccucaaagaccuaaaaacaaauacaguuugauccagcaaucccaucacuagguauguacccaaaggaauaucaauuguucuaucauauauacaucaugaaauauuacucagccguuaaaaguaacgaaauaauguuuuuugcagcaacuuggauggagcuggaggccauuauucuaagugaaguaacacaggaguuaaaaaccaaaagccuuauguucucacuuauaagugggagcuaagcuaugaguauguaaaggcauacagagugauauaaucgacuuuagagacuccgagggggugggggagggaagauauggauaaaaaucuauauauuagguaccacguguauauaguacucaguugaugggugcacuaaaaucuuagaauucaccacuguauaacucagucuuguaacaaaaaaacacuuaaaccccaaaagcuauuugaaauaaaacaagacacauguacacauauguucauugcagcacuguucucaauaacaaagacauggaaucaaccuaaaugcucaucagugguggacuggauaaagaaaauguagugcccauacaccauggaauauugugcagccauaaaaacgaacaggaucaugucuuuuauaggaacauggauggagcuagaggucauuauccuuagcaaacuaacgcaggaacagaaaaccaaauaccacauguucuuacaaggggagcuaaaugauggcaacacauggacccauagaggggaacaacagacucugaggucuauuggaggguggagaguggagggugggagaagggagaggaucaggaaaaaugacuaaugaguacuagaccuaauaccugagcgaugaaauagucuguacaacaagacuucgugacacaaguuuaccuauuuaacaaaccuucacaugugccccugaacuuaaaaauuaagaaaaagaaagaaaaagaaauagaauuuauaaucaaaaacauuccuacaaagaaaacuccaggccccaauggcuuuacuguugaauucuaccaaauguuuaagcaagauguaauaccagucuuagagaaacucauucacaaaauaaagaagguauuauagaaauacuuaccaagucagcuuagaauugugacccuccugccuaaacuugacaaagacauugcaaaagaauaaauuacacaucagugucacucaugaacauugacauaaaagucccuaacaaaaccuuagcaauuugaauucaauauaaauaagaaagcuaauauaucacaaccagguuggccuuauuucuagaauguaagguuuguucaguauucaaaaaugaauuaauuaaacucacuaccugaacaaaauacagaaaaaaaucauuuagucaccugagaacauucagaaaggcuuuuaauaaaaggcaacacccauuuaugauaaaauaucuuagcugacuagagauagaagguaauucagcuuaguaaagagcaucaugaaaaauuuacagcugacaucauaccuaaugauguaagcugaacccugagauugcaaaagagauaacaaugucuauaucccccuauucaauacuauauuggagauccuaguaaugcaagaaaagaaggagggaaaaagcauaaaauucaaaagaaaauucuaaaacguauguauucauaaacaugguuguuuagggcauuuuaggcauaguuuggggauacugcaaguuuuguuccagacuacugaaauaaagugcauauuguaauaaggcgagucacgcaaauuuauugguuucccagugcuuauaaaaguuauauguaagcaggguggaaugggucacgccuguaaucccagcacuuuggggccauggaagguggauugcuugagcccaggaguucaggaccagccugggcaacauagaaccugucgcuacaaaaaaagaaaauaaauagcggggcaugguggcacacaccaguggucccagcuacucgggaggcugaggcaggaggauugcuugagcccagaaagucaaggcugcagugagcuguaaucgcaucacugcacuccagccugggugauaaagugagaucuugucucgaaaagaaaaaguuauauguacacuaugcuauagucuguuaaaugugcaguagcguugugucuuaaaaaaugugcauacuuuaaaaaugcuuuauuuaaaaaaaauucuccugaucaucuugagccuucagggagucaugaucuuuuugcugguggaggguccugccucuaucuugauggcugcugacugagcagaguggugguugcugaagguucggguagcuguagcaauuucuuaaaauaagacaguaauaaaguugccacaucaauggacucuuccuuucacaaaagauuuuucugaagcaugggaugcuguuugauaagcauuuuacccacaguagaacuucuuucaaaauuggagucaauccucucaaucuugaugcugcuuuaccggccgggcgccguggcucacgccuguaaucccagcacuuugggaggccgaggcaggcggaucacaaggucaggagaucgagaccauccuggcuaacauggugaaaccccgucucuacuaaaaauacaaaaaaaaauuagcuggguguggcggcgugcaccuguagucccagcugcuggggagacugaggcaggagaauggcaugaacccaggaggcggagcgugcagugagcugagaucucgccacugcacuccagccugcaugacagagcaagaguccaucucaaaaaaaaaaauaaauaaauaaaaauaauucuaucggccaggcgugguggcucacgucuguaaucccagcacuuugggaggccaaggcggggcaucaccugaggucgggaguuugagaccagccugaccaacauggagaaaccuugucucuacuaaaaauacaaaauuagcugggugugguggcgcaugccuguaaucccagcuacucaagaggcugaggcaggagaauugcuggaacccgggggcagagguuauggugagccaagaucacgccauugcacuccagccugggcaacaagagcaaaacuccaucucagaaaaaaaaaaaaaaagaauuccauuagcuauauccaagguuugauauauaucuagauuuuuuuuucucauguaugaugaagucucuggauuccugaguguuucuuuuuaaccuauuuaggguguggugguuucauuucauaaaauugggaguugggagagagguauuuguuguggaguucacaguauuauuguauuguggugaaaaaacauagucuauaaaaggaaaacacaggagguguaaauaccacuacagucaagauuuuaaaacuauccacugaccagauguacuggcauugaacuguugauuuuuguccucaggcuggugucaagugaugccauccuuuugaguguuccuaggucucuuccuuagauauaugaaaauguuucucagaaguccugauauccagccucccccaacaguagacuuuuacucacaucuguuaggcuagacagagucccgugccaagucauugaggagggaaagugggauuaucguucuuggccuaaucuaaucagcaccuaccucugagguuuagagauagucuuuaaggcacucugcgaaggcaagauacaugaaaaacaguuggaagcacaacugguuaagcagccaaaagagucuucgguugucucugaguugcuaucuuucaauaugccugggugucagccaauuuauuggaagggagaaagaauauugguugaucuggagagucugauaauuggcauucuguuaggagaaccucuguuaugcuuauuuaaaggcccuuuaacacaguucuauuauuucgaguuuuuacaaugugaagucuucuguuuguuguaacucuuuuuuuuuuuuuuuuuuuuuuuuuuuugagacggagucucgcucugcugcccgggcuggaguacaguggcgugaucucggcucacugcaagcuccgccucccggguugacgccauucuccuaccucagccucccgaguagcugggacuacaggcgcccgcccccacgcccggcuaauuuuuuguauuuuuaguagagacggguuucaccguguuggccaggauggucucgaucuccggauccacccaccuuggccucccaaagugcugggauuacaggcgugagccacugcucccggccuguuuguuguaacucuuaaacgaggacuuguuuucuaaucuuugguagcugugcuucuguggagcuacuuuccuugggaguccuguuccuucagagcagcguccagguucucucucuggggacuuaguacacucacucuuucuggaccaguuuuuauguuaauuucugugcuugggauucugugugucucucaugcaucagugauuucuaaugaguaauucuuuuccuacccauagccuaagagucuuuguugcuucauugggcuaguaaguaaaguuuuucuaaaggucucuauuuuuacagggauagucaaccuuugugacuuucuuuaacuuuaugcagaaagguuaguuccaucuccuccugagccccaguccugggaucuccucccuaaggcuuauaacccaguuuuuaaccuaccgcucccucgccccacccccguaaguuauuuccacuuaaacucaucagcuauaacugaauucuuuguuauuagcacuucuccugcuuuggcuaaagcucaauaccuaauuauuauuuucuuuuuaugcacuauuuuuaugaguuuggagcaagaggggagggucauguuggguuccuucacaauauuuaucacaaguacaaguuccaauuuaagcuaauuuauuuucagucuguuaggauuuuuuucuccuucucuccuaauuuuugucaacuguuauuuuuguaaucauucuuuuucuuccugaagucuucaaaauccaucagauggauuugauuguugcuuuuuagauauauaucuguugcaaaguuuuugccauugcuuaugggaugggaugaauuacagcucucuuaaacaacaguuuucuguggaaaggcagcagaaggcaaugaugaaagauguacuuccugcucuucaucucuauuucugaaaucuuauuuuguuuccugaguuucuguaagaguuacuucugcuuaaaacuucugccuuuacccaaacuuuauggugucuucuggaauaguuuauuuuuccaguauacuuuaaagaaaaaaaaaccuucgguucucagccugcucaugacauccagcuccuguugcuuuggcucagaguuccauucuaccucaugauaaacaccuucguaucucauuauaucuuaaauucucuaagcucuaggagcagacuuacagagggagcauacuguacuauuuaaaugagccaugacaggccugggaguggaacuuacugcugggaaguagaccaggugguauuaaaggggcuuguuccauguggcaauugcuccacccguuaauacugaaguagaaaauuggaggaguaaaccacguucaguugcuaauuuccuguggagauaagacagacacacugugcuuguguauuuccaucucuccauguaaaacuguauuggaaaacauuucuuuuuauuucuaggucugauuuuuuuguuguaguuuuauuuuauuggcagaguucauguagcuaaaccccucagugcuucaauuuaagacaucgggagaugaaugaaauuguuauguuauuaaguagaugcugcagcucugcuugcuagggaugaaauccuauuuuaugaaauaauauagugugaagcugucaguaauuuccaauuguagaagaggccuaaucagaaaguuggguuuuuuuuguuuuuuguuuuuuguuuuuuuuagacaggcccagacaguuuuuugaccagacaucuauacauguuucagugaguuaauuacucauuuuauuguaauuucaucuguuagaaaguacccaaauaauugcaaaguuuauguauauaaacuuuuauggauauaucacaggcaaacaauaggugaucuuuggcaugguuguaguugggagguuucagauggagauacugugggcacaugcccucuucuucccagcuggcauccugggaagugcugacgggcuccggagcaagugaggcccuagagacuguuuaugacacgucaguguucauuugugucucaucucuuugaucgcuaagaagauaccuguuuuacuaaagcucagcuguugucaguuucuuuggauugauugucuuaaagggaaagauaaaucaacuuuguuuuuuuccugaagauagcuaaucaggucauuuaauuuuggaccaauaaguaaaagaauaacugaguuuaaugaguauugcguaaaauaaguucuuggugauuugacccuggguugacuuggcaugaauuuucuuucuuuucaacucccugcugcccacuuugugguguuguaugaauaaugaguccacaggcccuguaaacauguuaggugagguguuuguuguuuauuaguaguugggauuaaauagaaguugcacacugaaauugagugaagugacuuuucugcaguuaacuuggaugucauugguuugaaggaguuuuucuguugcagcugcuuguccuacuacuuuuagcugugggugcauccuuucugcguccugcuaaaaauuauauucuuguuuucacuuuuaaaaccuaagacgguuccagagcuguguuugguuuuugcuuuaaacuaaugcccgagcgccccuuuaguuagucaccaaucacuguuuagguaaguugaugauuccuuuuugcuacccaagauuuuuuuauuuaaaauugagcauuuuuaacuugcuuuuuaggucagaggaucaauguccucugugguauuccuccuccaucuaagcuucuuaaagcaguauuauaaauagaggcuuucaaccuaaaaaguacuguguauuucauugacuagaacugaacugaacuguaggcuaauaaaaaguaccaaaugaaaauauuaugguaucucauugcacuccauuguagauguaauguagugugaccagcaguagcuuugauucauuguaaaucccaucugaauacugacaacaguucaaaacaucaggagauaaaccucaaaggucacauuugugugaauggucauugugcauauaagacaucauuuuauuauuugaaaacuaguaguguagcucuuaagacagggcaguguccuaaccucugacagggauagaggcgagaggagaaucagugggcugccaaacagucauguguucauaggugagguucuguuucuucuuuagcuguuacuauuguuauuauuauuauuauuauuauuugcaugaaugguagcaguuacuucacaggcaaauuuccuaugaaucccagaguauugcaacagauuagcagcaaauaaagaccugagauaaagaaaaaaaaaaugcuuuuauucaguuauauuaaaauuaggacauuucaauaaaaaacuaaagcagcuuauguuguucugcaugcauaaauugaaagaauacuugaaaauucuucaaacuugaugguagacauuaucuuacagcuuucuuaaaggaagucaguuucuuggcaguaggacagagguucccaacauuacuugguucuagcacaaucacuaaauuuuucgugacuuuuagaccaaaauaaauacuuaacaguuccuaacaguuuguuguguuccaacaguuuguaaucaugucaaaaaauaauagacauauuaguaauaauaaauugaaagaaaauauuuuaauuucuuauuacuuacucaucaaaugugugauuguugggcauggcacaguuuuuuaaaccuuggaaucagauuggccacugccaacuucauuucuuguuccacgcuaauuucugugcagaacugugcugugcuuuuagucacagugcugcggucugaaugguuauguccccccaaaauucauguguugagauucugaccccaaggugaucauauuaggagguguggagccuuugggagugauuaggucuugaagguggaguucuuaugaaugggauucguguccuuguaggagagaccccagagaacucauuugccccuuccacugugugagaaaagcugugaguagaugccaucugugaaccagaaagcggacugucaccagauacugaaucuuacagcacuuugauuuuaggcuuuccagccucuggaacugugagaaguaauuuuuuguuguuuauaagcuaccuaguuuaugauauuuuguuacagcggcuugaauagacuaagauacaccgcaaccaucaaaaacucaauuucgaagagauggaauaucaugaacaauaauuuugcaugaugucguauugaacugugaaauaccacaagcuaguaauuugcacacugucugacagcacuguguuucucaaaauuuaaaaugcucugcaguaccccugugaguucccuggggugcugcagugcacaauuugggaacugugguaguauuguagauaguaagauuaucuaauaauaaguauugaugacaucuuaguuuaggaauaauuauuaguaugucagacuauaggggaagugaguaaaucauauacuagguuguuaucagaaugauuaugaauuucuucacccaccuguggagagacagcauggccuauuuuuuuacucugaccccaauaagaaaaguauucuguaccuucccccuucucucucccuuuuugucucuucguuaucucucacucuugcucuaacagacacacacauagugaaauaaguauuuaacaaaacaguauucucauuaugugcacucugacuuuuuuuuuuuuuuuuuuuaaugucuccuuaagaccuacugaacugacggaaacuaguuaaggucacagacucgagagacugacgacuuuaaaauggccuucaccauuuccugucugugugacuguaagcaaguuauguaaccucucaguuacucaguuuccucgucuauagagugguaauuuguaauaguaccuagugcugaggggauuuguuuucuuuuguuuuguuuuguuuuguuuuguuuuguuuugagacagagucucgugcugucgcccaggcuggaaugcaauggugcgaucuuggcucgcugcaagcucugccucccggguucacgccauucuccugccucagacuccugaguagcugggacuacaggcacccgccaccaugccuggcuaauuuuuuguauuuuuaauagagaagggguuucaccguguuagugcugaggggauuuuaaggaaguuaauacauguaaaacacuuuaaacaguucuuuuuuauuuuauuuuauuuuauuuuauuuuauuuugaggaacaguuuugcucuaaucucccagacuggagugcaaugggacgaucucggcucacugcaaccucugccucuuccucagccucccaaguagcugggaauacaggugcgcgccaacaggcccaucuaauuuuuuuguauuuuuaguagagaugguguuuuaccauguuggccaggcucgucucgaacuccugaccucaggugaucugccugccuuggccucccaaagugcuggaauuacaggcaggagccacaccgcgccuggccauuuaaacaguucuugaucaguaauuacugcuuuauuacuagaaucucaaugaauaaucagaggcuaaaacauuugggaaauuagggagaugcaguaguucugugcucuaaaggguacugcauacagucaaaaggcuuuucugaauuucugcucuugggcagauagauuguguaucccuugccaaagauuuuccguauuuauccucuugaaucuggauccaguugaguaguaaacgggagucaaaauaagggagaugaaaauacuaucgucauuacugacaaagcugauuagagaacaugacuuuauauuugcagccaaguagcuucacuaguauaucacuccugccaccagcacagcugcauaacugcaggcuucuuacugcguggcagagaguagaacaggauggaccuucugcauaagcagccaggucugaagaggggagagcagaaggggcugaacugaguguguucaccucuuucuucaaaaucugccaaugauauaacucacaagggagggagacaagaaacauaggcacagaaaugugaagaaugagaauaucaccuuaacaaaggaaacauuuuauaaggauacaggagguccauaaucaaguucauguuuuguaacuuuuaguaguuagguauccuuucuggcacaaacuuuaaaaacagauacaccaggguuugaauucugccugugucacuuaauugcacuggcuuaggcauccuagaauuucuaagagccguaaaacagacaaaacuacuuggcaagaaaaauugaccacugacuucucuccccuguucuguugauacaacauuaaauuuaucaauguuuguuuuugucaaacuucaguaguguuagagguaugagaucagccuuaguugauuagagguaugagaucagccuuaguugauuaguaaaaaggauuuuauaugccuaagauagcaagagagauaugccuuugaucuuucuuauuuauaggaaaauaauuuauuaaccuaauuuuuauugucacuucuaaccuaaauacauaguuguccuauuaauggggaccuuuuuuucccgugagcaucugaaacagucuuuuuuuucuauguaugugaagugguaauaguuuuucucguguaucaggcaacuaccaacuuauuuuagaccagaaauucuuggaaaugguaccgauccaguuggcauaaaaugugcaagcacuauucuauugauuccucaaaaagaugcaauugcuuuacucauagaguuaucaguuauuuuucuggcuauuucacuugaaguagccaugcuuugucuuuuuuucuauggagauacguggccaaaacuaagucuuuucaccagcuggaugauaggaaauuugauaaaauuugagcaguauaaaaacuuucccauugacuuuauaugauugaauuuccacuauguaaaauuaaacuaauuauuucuuaugcuacccaauauauaguuuauuauuugaaaacuauguccccauuuuuccucaagaacaugauuuugucuuuugcaucucagugcagggguuggacagcauaauuucuucuccuagaaacacauuuucugcugcuuguagcuacuauuucuauuuuuucaucaacagcuacaggaguaaguggaguuccugacaucucuguguaaucagugguaugaucacauaccccauauugacuuuuucuuuugaaguuuaugcugcugucucuucaguaccuugagcuugaccucuagcuuuaagcaguaaagguaucaaagaaaaucaguugccagagucagucuguuugcuuguguccuccuaacccacugauggcaccucugacuccuugacauuguauuauuuguuucucagagaaguaaagcaauuuuuuuuuuccucugucacccaggcuggaaugcaguggcgggaucucggcucacugcaaccaccucccggguuugagugauucucaugccucaguuucccgaguaguugggauuauaggugccugccaccaugccugacuaauuuguguauuuuuaguagagacgagguuucaccaugugggucaggcucgucucaaacuccugaccucaagugaucugcccaguuugcccucccaaagugcugguaucacaggcgugaaccaccacacccggccaaagcaguuuuuuuuacauauagacauuuaauauauugacuuugguugauucuuaccucacuuccaagauaauuguuucuguuaaauuacauguauuuuuaggcuugagucauccacuauauuuaugaguuggucauuucuuucaugaguugagcuuguuuuuaaaaguucuacuuuuaaaguccccuucugucucuccugcagccacuuucacuguaacauuuaucauguuauuccuggcagccagucuucuuaacucuccaucauuacuuuuggcagguuacagcaguaucacuuaggguucucuuaguucauuuuuaaugaacauccaaaagaugcuccuauugcaauaaaaccauaagaaaagauuaauagaauaaggguuuauucuauuaauaggcaauuuggggcugcuacaguggcuccaugauaccaaugguucugggcucuuucuuuuccgcuauccuuaguauauggccuucuuccuccugcuugcaaaaugguggcauacagaagccuuuccuacauauuccagaauaugaagaaagacaagggggaaaagggacgugccaacugguuaaacaacaaucaccauaucaaagacccacccacuagauuucuucuucuuacuggccagaacuuuguagcgugcccacccucuauacacaacaggcugcaaaggaggcuggaauaucacguuuuaguugggcagugacuauccagugcaaaauccagauuccguuaguaaaggauguugauggaguggauggauauuaaacagagauucaacuuuccuguucagaaacguguuauaacuccauauauugcuuuaauucuaucuauccuagauagacuuacaaggcuagaauaagaccuuuagaggcacuaaccaaccaccaaaaagaggcuaaucaccucccauauguaaaucaaauuguacaaaaaauugaaaaaaauacauguaaagaccgaaaacauuuugauuuauccuaugacguuucaguauuuuucuggaaguauuaaauauucuaaaauuuuuuuuuuugcccggguacgguggcucaugccuguaaucccaacacuuuggaggccaagcugggcggauccccugaggucgggaguucgagaccagccuggccaacauggugaaacccugucucuacuauaauacaaaaaucagccgggcauggugguaggugccuauaaucccagcuacucgggaggcugaggcaggagaauugcuugaaccuggaaggcggaguuugcugugagcccagaucacaccauugcacuucagccugggcaacagagugagacucugucuaaaaacauaauaauaauaaauuaaauuaaauuaaagugugugguagugauaaugggcuggaggguauggugagucuauguugcugacaugcuaacccacauccugucuacuucaucaguauuuccuauuguauuagaaagaugagaagguuccuuaaauuuuuaacuccauagaggugauucauuuacuauaaagccuuaagaaaaauacuuacccuaucugggccucuguuucuccauccaugaaaugagaacauugaucauaauagaaaaguaggcaaagaauauaaucaagcaauucacaaaacuauacacgcagaugacuaauaaaauuauaagaaaauauuaagccucacuuaugacaaaagaagauuaaauuuaaauaaaaaguuccuuucuaaaaauguaacauaguagcagagauguaauacccaguggcaauaagaauauaaagaaacaaguauuugaguguaaagauagucugaaguaguaaacgagggcaacuagguguauuuaucaaagguuuuaaaaaaugcgcaaaaacuuuugacccugcaauucuacuuugaggaacuuuccuaccugaauuuuugacaagcacacaaugauugacccugguaaauugacauaagguauuuuuaacuccagccaguuuuuuucuuuacuguaguaauuugugugaagcuuucuaagaaguaaauauguaauuuacugucaaagcuuuuuucuuuuagaaaaucuaagccaugaacauuuaauauguuuucguuuuaccuuauauuaggaagauaauggcaaucuuuuaaaaauaaaaauuauuucuuuguucauaucuuaauuuuuguuucaaucugucuguccauuuuggucuugucuauuuuaccucugggcucuaucuuuacuacaaccagucuuccuaacucuucucccaacuuucagaaguaguuuucuaacuaugucaaugaaguauuuccaaaugaaacuugccaaauggucuaaugccauaaagacuucugcuucugucuucauuggauuuuagucaguaaauuuucuuucuuuuuuauuuauuuguuuauuuauuuauugagaauggagucucacucucucugcucacugcaaccucugccucccggguucaagcaauuuuccuuccucagccugccaaguagcugggacuacaggugugcaccaccacauuuggcuaauuguauuuuuaguacaggugggauuucaccauguuguccaggcugaucuugaacuccugacgucaggugauccacccaccucggccuuccaaagugcugggauuauagaagugagccacugcgcccagcccauauucagaaguuuucuacaguuuuuuuguuuuguuuuguuuuguuuuuuugagaugaagccuugcucugucacccaggcuagagugcaguggugugaucuuggcucacugcaaccuccaccucccagguucaagcuauucuccugccucagccucccaaguaucugggauuacaggugcccgccacaacgccuagcuaauuuuuguauuuuuaguagagacgggguuucaccauguuggccaggcuggucucgaacuccugaccucaggggauccgcacuuuuggaggccgaggugggcggaucuacaggauuuuaaaacaugaaguugugccucuucccaaauuuauucucagacuuauuuuuuuacuaguuuuauuucugaauggcacauuagagagagagaaagccagagagagagagagcgagagagaggaaagaagagacaaggugggaccgaugguauaauugaguucauagaaagacagugaagugaaucauggguguuucaucacuuuacaaaacugauaacaauaauaucauuucuagaaacgugaauuuacaguaugaaaugguaaacauuuuuuuuuuuugagacggagucucacucugucgcccaggcuggagugcaguggugcagccuuggcucacugcaagcuccaccuccagugagccauuccccugccucagccucccccagcagcugggacuacaggugcaugccaucacgcccgacuaauuuuuuguauuuuuaguagaaaugggguuucaccguguuaggcagauggucuugaucuccugaccucgugauccacccgccucggccucccaaagugcugggauuacuggcuugagccaccgcgcccggcugguaaacaucuuuuuauagcuaaugggcacuuuuaggcuaacugagcagugaacacuauuaaauauaugagaagcuuuuuaaaccaccuuccacuuaauucauaacuacuugucagguugagacuuucuuuucucuguuaaccaugccaauuuuugcucagagcaugcugaaaaagcuacuagauuacugucacauauaccaggcauggcucuguuaaccuguuuaguuguauuauugcugaaaaguuauuuauuccagcuauucuugauauuuuaauuauauauuuuuauuauuauaagaaaccaaugacauacucauaugaaaaaauaucucugugaaauaaagcaaaauguuuuggaaaagggaugcagguaagucauuucaaaauugcuguuguuaaugcgggagaggauuuggaaaaauaggaacgcuuuuauacuguuggugggaguguaaauuaguucaaccauuguggaagacacuguggcgauuccucaaggaucuagaaccagaaauaccauuugacccagcaaucccauuacuggauauauacccaaaggauuauaaaucaugcugcuauaaagacacaugcacacguauguuuauugcagcacuguucacaauagcaaagacuuggaaccaaaccaaaugcccaucaaugauagacuggauaaagaaaauguggcacguggccaggcauggcggcucaugccuguaaucccagcacuuugggaggccgaggcggguggaucaccugaggucaggaguucaagaccagccuggccaacauggugaaaccccaucucuacuaaaaauaccaaaaauuagcuggguguaguggcaggcaccuguaaucccagcuacucaggaggcugagacaggagaaucgcuugaauccaggaggcagagguugcagugagccgaggucaugccauugcacuccacccugggcaacaagagagaaacucugucucaaaaacgaaaaaaaaaaaaaaagaaaauguguaacauauacaccauggaauacuaugcagccauaaaaaaggaugaguucauguccuuugcagggacauggaugaagcuggaaaccaucauucucagcaaacuaacacaggaacagaaaaccaaacaccgcauguucucacucauaagugggagcugaaccgugagaacacauggacacagggaggggaacaucacacacggccugucgggggaucaggggcuaggaaagggauagcauuaggagaaauaccuaauguagaugauggguugaugggugcagcaaaccaccauggcacauguauaccuauguaacaaaccugcacguucugcacguguaucccagaacuuaaaguauaauuuuaaaaaaaguaaauccaaaaaaaaauugcugcuguugaauuagguuaacaguuacugaauauugggagacuuuuugaaaccucacaguuugaaauuggcauuguauuucaaaugucugcauacugacuagccccacuuucacacaaccagagcugaaaaggaugugaaaaagacaauacugaaccuaagucaucagauuauauggugaucuuuggaucucgucuaaaugaaaaaccagcaaagcagcuucaaagcagcaaaacacucucuauauacuuucuuuauucuuuaagaaauauuuuaguuaaucaccuagcagacuugagugucacauaaaggggcuucuucuauaguuucucauaaauaauuugcugauucugggaacucuaaaagguaaauauuuuauguagcauguguauauuguaaauuauuuauaaaaauguuuuaaaagaccuaauccugaaauaguaaauaacuaaaaauuuacaaauacuauucucaaauaguaaauaaguauauaugagcuuucaaguuagaacuaaaauuuccaugaugugauaucuauuuuaagauuuguuuaucaaggaauauuguaauuugggaggauuuuuuaaaagcagauuuuauuuuuucugcccuucacaaaaacuaaaucugagccuugggaaaucagggcagcugcaucaugaugugacuugccugggguuugguauuuugcugagauaccugccaguuggaauuagaacccuauggguauaacuaggguagacuuaauuauuggcuuacuguauuuaaaucaaaaugaaaagcucauacaaaauuuuguacccguacucugaaaaaauguggaacuguuuuuggacuaaaauuuuauagcuuuuguggcuaaugaggcaugaaauaaauuggcaagcucaaacuguucggaguacagugguacagugugcauuuucuaauucccagcccuugggauuccagcaaaggucacaaauuaaacaaagucaggauuaaucaagacuauaaucaaauaaaacucaaucauuaauccucuucugacuuacaauagagugauuguguaauugugugagaagcacuggagagggcucuuuuguagugcguaggaaaaucaacauuaaggugucagacagaaaagugaaacccugcaggugaagcugucucuggagccaagagaaacuggcaauuuaugcagaguugcaagugaagcuuuggagcauugaaaggcuguuggcacugagcugcagagcgugugggucucucggugaggccuccacagagaucaguuuacgggcugcagcaggccguuugcugagaagcucaguguuugggugcagcagcuccaagcaacagucucuccaaguuaacugccagaaauuuacuguguaauucucagcucuuuguaauuuugaagaagagguuauggaaaagcauuuccucugugggaguaauuaugugucagaaaaugccauuccucaauaaagggggaagguucacaaagcacagaacuuuguccuauuuauuccauguuccugacuucugaacugaugcuugcuuucugcuauuuuauguucuauagugauacuuucuucauuuuucaucccuucaucucaagucagcgucaguuuuauugcuuuaaaagucaacagugauacuauccaguucugcuaagagugaaacuuuaagaauaaaauuugauuuuaauucaucccuuauuauaugugaguauauuuuuuauauucgcuuuaaggauaguauuuaccucuguuuguuagcuuucugcuuuccuucguauaccaaauagaaaaauucucauucacucacccccaaagcaugugccuguuaucacaugauucaguuugaguuucuauauuacacaauuucuguuucuuacauugcuuuuuccuauuuauguacuaagcucucuguauaugcaggauacuguuagguaugauaugagauauuuauuauuuucuuucaaguaaauaaacaaccauuauccaugcauagcuggucagucccauaaauuuuaguacuaaaauaucacuuggauuauuuuauuagcaagacuuuauuguaaugauguauuucagauuuugucuuuccauuuaggcucauauauguuacauuuugguaucauuauugaaacaaauucaugaauugaguucaucauuagaaaaugaaagccucagaauuuugguaauuguuuuggaccaucacaaaaaugugcuuggcauauuuaaauucuguauuuuuuucccuuaccuguaauaacuuuucaaaguaccuaaagcuaugauagaaauggaauagcauauagaauacuuguguguguguuuguaugcaggggggcggcuucuuauuuuuaccuuuuuucugauuuuauauauacaauguuagauauauuguucugcaauuuauauuucaguggaagaauauucaugguuauuuuuuaaagucagcauaaagaucuguugcauucuguuuaacaagugcuuuguguuccaguguauagauacugcauuauuuauuucauccuuucuugguugaagauuguuuagguuauuuccaguuguguaauauugcagauaauacuguaaagaaaaucauuauacuugcaucuuuucacauauguaagcauauuuuucuaggauagauaauggaguugcugggucaaaacauaauggcguauuuuauuuugaaaacuguugcucaagcacucuuauaaaaggcucuaccccacaugugcucucacccaaauguguaugaaagugugcaucuccuuaauuguuagguguaguggauacuauccaucuuuuacauuuuugcugacuuuuauauuugagauaucuuucuacaccauuacucacccuuuucuuuccagcagaguaguauuccauaguauuauauuuaauuaguccuccauuaaugaacauuuaaguuacuucuaacaguuugccauuacauucaaugcuacagaauuuuaacaaauuuguaaugcagaauuuucauaaguauaagaauaaccuuauuacaaaagucauuucacauguaugcaaguauaucugcaggauaaauuccaaaauguaacaaagggaguauguauuuguaauucuaguugauaguguuuuuuugguuuuuguuguuuuuuugagacggaaucucacucugucgcccaggcuggagugcaguggcacgaucugggcucacugcaagcucugccucccggguucacgucauucuccugccucagccucccgaguagcugggacuacaggcgcccgccaccacgcccagcuaauuuuuuguauuuuuaguagagacgggguuucaccguguuagccaggauggucuugaucuccugaccucgugauccgccugccucagcuucccaaaguacugggauuacaggcaugagccaccacucccagccucuaguugauaguguuaaauggaaaaggaagauguaaaacaguaugcuaccauuuguuuacaaggggaaggguauaagaauauccaugugcaggcacacaugguaacauggcgagugcgggggaaaaugagguuucaaguuagaacuaaaauuaaggguacacugugacuuaggucacaacaggacauaaacauuuaauuuacucugagccucaguuuccacauguauguaaaugaagcuaguaaaugccuguuugauaguauuaugagaauuaaaugcaaaauuguaugugaaauuaugugacacuguggccagcauaugauacguguguguguguguguguauauuuugcucuauauugugccauauguggcacagauauuucuuguaaagguagcaauugccuguuguauucauacaaugcggagccuacuugucaaugaugcuuuuauuuaaucaauuauacauagaguugucagcauggaaaaugcagcuucuguuuugaauuauguuuuacuucugaguauaauuuaaaggcaaaauggcuucacuccuagaaacucgagaccucuaaagcuuguucucuuccugaugaauguucucuuugggcacuucaaauagaguaucuuacucauggcuuuaggugauauacugggaaagcaugcaguugcuuuagaagccuuuauaaauaauacuugaguguucaauauaaaaccaauguuuggcuuucguaaccauuuccuacaucucuucuauaaguuuauugaauucacaguacacaucuacacugugagaagcauuuaucuccuuuugugcuaauaaaauuaagcaaaagacaaaguuacucccaaguucauagcauauuccuugaaaggaaugauuauaagaacaaacggggaucaaugcauuacaucuuuagaauacaggaaggaguuuuuacuacuucauuuuaaaaauaaggaaauagagaugaaaagcuuuccaucuuuccauaccacguucggcagugguaauauguuuuauacccacuaaucaaggcauccucuguguuuugaugcuuugauaaguagucaucugcuuuuaaguuugugauaguagauugaauaaguguccucgugcucacgcaggauuauauacuuauuauauacuuaggcaaauuugucuuuuugaaccaaguuuuaucacuuaaaaugagcauaauaauaacuaauucauaagaaugcuguaaacauaaaaugaguauuacuaacugagaauguacaguagauaguaggcucucacuacaugcugguuuuccuucuuccuuuccauucucuuaggaaaacugauacucagaauggcuaagugaucugugcauagucaaaaggccaauuuagugauagaacugagacuggauccaucacuuugauuacagcuagauucuuuccauuauaccaagcagcauccauaguaauuuacuuucauuuguacaauuuucuaugagaaaaaaugagcaacaacuaucaguuugucuucaauccugauaaaaucuagcacuuacagaaauugcuaagaaguaaacauuuauuacacaaacccaugccagagagggguauguugaguucuagucuaaacaucuuuaauaaugauaauuccauaauucucagcuguuucuuuuagauugaccuuuucucaccugauaaaauuuuccaauucuaagcucuuuauucugauugaaaucugacauaacuugucucagucaucauuuuuccauucugagcuugcuuauauuuucuaaacuuuuaacuugguucuccagccuggcgaccuuaauuuguccauuuuagaacagccaaaauauccuugauuuugcuggauuaauucaguuaucucaaauuaucucugacuuccuuuuucacaccugauuuuccuuaguuuuguugauuaaagauuaauaugaguuuguaugcccugacaguggaugauacaaaagaaaacuggucuaggaauuaggaaaccuacuuucuguuucaucucucuucuuauugccaagcuguuuccucacuaugaugggaaaaauuauguuguaaucuuaugucuuauaaaagagggcucaaauugguauagacuguauauuuuguggggaauuaauuaugugacuauucaacauuugacaaauaauuuuggacguaagugugcaaugucuaaagcccgaauaauucuaauuuuaaugucaacgcacuugaugaguugaaguauggugcuugcugguaauggggaaaaaaaaaggcuacaaccaaaaguauuguguuauauaaaauuacaugugauuuguugugccuucacuuugaauauuagcuuuccugacagccaauguaagauauuaguuaacauggaaaauaacuucuuacauuuacauauugcaguuuuucagggcacuucuguacacaugugguaucuauauaaauuauauuucagaauaaagaaauggucacugucuauaauucuuacacugccacaccauuugaaacaggccacagagauuuauuacuccaugaguuuugugaauauugagacucaaaugcuauguuuguacaaggaaaucacaaaucguaacuagaauacauucacuuacauauuacaccuagaguucguuuucucauuguucuuuuaaguuuuuuucucugaguauggguagguaaaguauagcaaauuuguugcagaaaauuaacugugaccacauuaaagacuugaaaccacacuccaaaauagaaaaggcauuaggaaaauauuuugcuuagaaggaaugauuguucuugucuuuucaauuuuuucuuuuaaaugugcaacaugaaacuacuccuuaccuugaaagcuguauggcugauuguugcugcuucccaacaucuucacccguuuuaccggaauuucgccucugcuauuuuaccuucuaagcugugaacccuugucauccuauuugaaccacccccugcccucccaccucccuguuauuagcaguacaucaaagauuggucauuggucuugucucccugcuaauucauaucuugauguucuugaacaguauuugaacagugccccuuuagaggaauaucuaaugucagucauuuccuauucugaguuaaguuaauugaucugauaaauuacaaugagcaagugaauauaguggguuuaaaacguauccgucuauucuggauuugcuuuugcucuggagaaggcaaaaaggccaggaauuagugagugacuuagucuucucucgucauuggcagcugacagaccuacugaugaggugauaaugaacuccaaagucuacccuaggagcaacugggagggaaaagaacccagacagaaggcaugucucacuuuggagccugccaagauuuuugcuuuuucauagaauucauuucgaggagguuaacagguagacuuugcuggaugcaugucagaaguguaacuuaucauucauggacaccaaagacaaauauauauuuuauuucucucaacguaacaagccagaggccucagucucagagacggucacugggguaauccagucagagagggagcauccgaaacaaggcuugaauauaaaguucauuuuuuaaaauaacucuuccuucuuuccauuaaaauuauuauccaauacauaugguaugacagauuagaccuuccagaauuauuugcuacuccuguuuauuugauuccuagaauguugcuuagcggucucaaacuuaauuggagauaaugaguauaccuaagguaaaucuuccaauuuuguuuccaguuaugaauguuggugaaucuuuccuuuuccaaauucaguuuaggccuccacugccuguuuuucuucagguaucaugaaagugaaugaaguauuuucaaguccauucauccccaccucacaugggcagucgccccucauacacauauauuuuguagcccacacaggaggcaacuuaauguacaaaauguuuuaaguuaauuacuggaaguguguuaaacauagaauauuagugaguuuuuaaagucucugaacuuuaaaaauaaucaacuguuuguagaaaaaaaaugaauuauuguugaugacucagcguuccuuauguaaagacuuggcuuuagucuucaagaagcucuucagcuucccuuuuucgguuuuaggcagaacauggacuuugagaaguuuuaaaaauucuauuauucccacccauguuucccucugucuuuaagcuguaauaaaacguaucaauguucugggagucuguauugcugaauugucagggccuuucuugcuuaguuucgcuugaugauaaauuucaaggaacccauagugcacuauuuuuaaccaguuucgagguugaaaaaaugcuaagaguuuguguccagagguuuggauaacauuguuaauugugccaaguauccauugaguuuggcuuuauucuuuauccuguuuaacuggcauuuucucugcuguaagaaaacaguccuuaggagccacgacaacugauuuuauugguaaacauaugaaugaggcauguuucauaaaacuuuauaaauuuaauauuagaaggacagaaguuugaccagacaguucaauaaagacaauuuuauauauauuuuaacuuucuuugauuccauucacuuuucaaauuagauauuucagauuguaauucuuagaauugaccaugccauuuauuccucuuucuugaaagacaaauagaauaaacaaaaauuuguagacaucuaaagaguaaucuaaggacuauaguuuugacucauuucuuucaugaguauaguuucucuuuucucuuuuauaauauaagauaugcacccguuugucuauucauuccuuuuugcuucuccaaaccuguuugcaucuuugguugugacucauuucuuuauuugaucaauuguuaccauuguauacagucucuuuaguuggauauuugcugaagucagauaaaccuuacugguuucagggauaugauugugguaugaaacugccaaucuucuacuuugauguucaugauucaaaaacuucuuguuccuuuggagaaaaugagccuaaguuagucgucauccuggaaauaaguuuugauuucuuuuuaugaaagaaugccaggaacuuucaccaguuuaucuuugaaucuuuauuuuccaaaaguaagguagaaaaauccucaccguuuuacugauuugcagacugguaaagugaacaagguguuagaaucaagacauuuuacucaaagaccacuaauuuaaaaagguaagucagaaucuggcccaagaccuugaccucucaaauuagauuuaauuaugaacugcauuaagucccauuauuucuccuauuuugcuuaucaagugauaacuucuagucagacugggauaaucaugaaucuacagugccgaaggcauucaugacaaagcucacccuuugaagcagaaaagcaauucaucugugucaaaaaaggaugcaaacuaaguuuugauccugccugauaguaccauuuuccagcuauaccuuguccagcauucuuuaucaaagccagaaagacuauaugcaagaagaauuuagaacagacuagguacuauaauucuuuguguuugaaaggugauauuuuagacguagagacaaaaagucucccuugaguuuuugaaagaaauugcuuguaagggcaaauguuuuagguugaaaaguugauauuuuuuaguuucccuguuuaugaauaguucacaggguaauguugucagucauuuuaaacuuauuauuucucccucuuggaaagguuauagauugccaacagaaaguagaacucccuguuucugcguguuuuucucugaaauagugugugacguagucacauuacuccaggcucaauuauagacaguuuguggguuuuuuuuuuaauaaugccaaaaaucuguggauaauguauaauaagcugauguacauccuacuagaacugagguauuucaguuugugacaaauuaugucuuaacauguuaccucguuaauagucauugguucauaaaugcuggggauuuuaaauuuaacucuuuuuauaccuaauauuaaaaauuaacccaauuuaacauuauuucaucuaccacauuacuggccuuguuuugauucuaaaucucauguccuaauuuacaaauuaccaaauuaauucaaauguauaaccucuuuaugauuugaggcccacucuggaaaagaaaaauacuagacauuucuauuaaagucaugagugauuuuuaugugucuuguggauccaucccccagagucuugucuuauaucuuuauguucuaacaaugaaguuuuuuuaacguacuuuuagcaaaauauacauauauuuacacaaguauuuuagaguuaccuacaguaggauuuagaggucuuuuauucccaugauuauauaacauuaaacaauauguagcccccaaauaaauuuuucugugggaacuucuucacguugucugcacaugacaguugaucuuggguuguuucaguacuuuccuugguuuuccuccugugucuuuagccauucccuagaaguccccuuuuucucucccuuacaacugauggucucuaugaguccacuuuuagcucccuucucuucuucuauacuuucuuccccuauauuuuuuccaaaguaauguuaucuguucaguggcaucagccgcuauuaauauaugcucaugacguccaaguacaaauaaauacacaagugguuuacucuagcccauaucucuguucccaacuuugggccccuaucaacugccaacugcaccugacagcuugaacauuccauaaacgaccucaacauaccuaaaaucaucucaucauuuuuuuuuuuuacaaauaugcuccucaguaucuucaucaucaagaaaugucguuuacucaguuguucaagccagaaacuaauuaaauuguuccuaacaacuuuuuuucccuugccucucauagcuuuuucaaccuuugagacauaucuccacaucauuuugcuucucucuucacaggaauuauucuauuuuaucacuuuguuuuugcaacagcaucuuagcuaauuuguaacuaauuuuacccuuugccaguccuuuucuucugcuucuuccagguuaauacuugguuguuuguuuguguuuguuuguuuguuuuuccuuuggagauggugucucauucugucacccaggcuggagugcauuggcauaaucacuggucacuguaaccucaaccucccaggcucaaggaauccuccugccucagccucccaaguagcugagaccacagaugcaugccaugauguccagcuuaauuuuuuuuuguuagaagugaagccucacuucguugcccaggcuggucucaaaccccugagcucaaguaguucuccuaccauggccucccaaagugcugggauuacagacaugagccacugcaccugcccuuaauacuuuugaaaacacguguauggucauguuauuuccucuuaaaauuuuccaaaggcuucuuauccuuucaggauaaaaugcagacuccgaagccugacguugaagguuccccauaaucugacuucuccuguuguacgccacgcccaugugaccucacguuucuccuuucucucucuuucgcuucccccucuugccuuuuuccuuucuccccccuccccuuuucucccucaguuaagaugcuacuucuuccaugacaaaugaugcuauaggaggaagucauuucuuucucugcguuugcuuugaaccucuccuauugcuuugucuuuuuuuucuuaccauggauuaaaauaucuguguacauguuuucuguugaauuaggagcaucuaauucaguguuagacacgguucuacguguuagcaguaucaucuggaauaagacagccucuguucuuggggagggaggguccuugucuuuuucauucuuggaacuuuuuagaggugauuugacaaauaaauaaaugucuauuuaaaaguuacuaaaaaaaaaaaaaaaaaagccuuagcgaccaggcacgguggcucacgccuguaaucccagcacuuugggaggcugaggcgggcagaucacuugaggucaggauuuugagaccaaccuggccaacauagugaaaccccaucucuacuaaaaaauacaaaauuagccaggcgugguggcacaugccuguaaucccagcuacuugggaggcugaggcaggagaaucacuugaaccccagaggcggagguuggagugagccaagaucacgccacugcacuucagcuugggcgacagagcaagacucugaaucaaaaaaaaaaaaaagaaagaaaagucuuagaaaagguuuuuuuuuucuaaauuuuucaauauagauucaucuaauaaucucaaaauaauuuuauaauagccuaaauaaaaucaacuacacacguauuaauaaugaccuucuaucccuauuugggaugcaaagugaggcaauaacuacaacaauaauaauauauuguuuuacguuuuccauguauauauucugaaagccucacgagcagccugugagaaagcugcuuucauuauacucguuuuauaguugaggaaagugaguaauuuucccaauuauacuaauaaaugagaaggaacagauccguaacuuugguuuccuuuugcuaucuaauguugcucuucuagaucuuaccuagcuggggaaggggaaaaugugaauaagauaccaaaauaaguggauguuaaaguaauucaggcaagaaauuaugaauuaggguuaugucagagguggaccaugaagaaauauugaggagguagaaugaacagaagauuuaaugacaaagggauauguggaauuugaaggaaagggaggaguuaaagaugauuuaagcuaaaagcucccaggacuuuugaccccacuuuucuagugugcuugguuucuccuuuaaaaagauucuggagaauaguuuaacaguucccaauggaaguaaauuauaaaagcugagauggcaauauuuaaacccuagagccagcagcaguggauucaacccugaaguuucaagcaguauccuuuguuuuauggcuaagaaccaguaucaucuguuauuuaacuaggaaguacaaguucaccuuuacaggaccaacauuuuauuuucuucugugaaaugcauaaacaacauaauacacgacaaugggaaaagucagauagcacagaaaggccuauaaggaaaagcaacaacacaucuaccuuuucugucccccuuuccacauccucgagugagugauccuuucagcuuucuucacucaaaacuuugcacuugcucuuagcuaaggcugagaagcaaucaucacucagaacuuuagacucauaauguuauuuuuuauugacuccuugcaacagucaguauuuagcuuacuuaaauugcugccuguuuucccucacuccuucucccaguuuuuguauuauuauuauuauuauuauuuuaugaauccucuucguuaccuuuguaacuuuaaaucauacacuuaaaacucuuaauuucucuuuaucaucuucccacaggcucucugccuagugacauguaaaauaagguuaucaguaccucuacucuuccuuccacuuuucuuccccucccuucuucucucuuccccuucccuaacuucugacaguugaauuuuuauuuuuauucauuuacacaggacaugcagccauaucuuaaaguugaagacucaucuuguccuucuauuuuggaaaauuaugaacaauucucccaaauacuguuuucucuaauauuuuguucugcaacuccuaguagacuuagagucucuuugucuuuuuuacaugucucuuaauuuaucuucucuuuuuuaucucuuuaugucuuuuauccuuuauguuccauguuuugacuaaauugcuaguacugucuuucaauucacugauucugucuucagcuacauucaauguacuguccccugcuuauuuaguuuuugucuguaacuuuacucacauauuuguuaaauuuuuuauuggaguguauacuauaccucugaaagaauauguguacugucaguuuaguucacuauauuuuugcagucugaaaaauuuauguaaccugacacccaaaucaagaaacagaauauucccaauacuccagaagcccucuuugugcuucccuccagugaguaacaccucccuugaguaaucacuauucugacuucugaaugcauauuuuaauuuuaccuguuuuguguuauauauaaauggaguuaucaaauaaguacucuuuugugucuggguucuuucacucuguguugugaguuuuacucauguuuuuacauguagccaauaguucuuucaaucuuaucccauaagguaucauauugggugacuauacaauauuuauuugucuagcaguuauccaucuacuuacuuauucacuguugauggagacagagcccauuuaguuuggggcucucacagauagugguaccaugagcauuuccagugaaguagugguucuugacccagggagauaguggggcugucacagagacccacucacagagccgguagauaccuugguucuguuucuguucuugaauccaucugcuugauucguuaugcccugauccuaacaaauaauuagucauugggacaggaggugaguacacgauugcaguuccugguguuaagcgaugagccuguaucuucuauaaaguguuguuagucccccucauccaggaggagugagaguucuagcuccccgaggcugcuuucggauccauauuccuggcaggccaugguguauuuugcagcucuguuccauuuaugcaccacacauacguuuaaguuguauuugagcccagcuguagcuuucuagaucucuccuuauagucauugcuauguauuuuauaucucagagcaugacuuuaccaaaccaucuuaaccagaaguauuucuuugaaucugaagacuccuggauuucaggauauauuuaugacuucuuuuuuucuuccuuuguuuaagcucagaaaacuucuuguauuacuucuuuggucauuuccuuuccuucauuuucacuauucucaccuucuaaaacuucuaguuguuggauuuagauuucucuuaaauuuuuuacucuguauuuuuuaucuccuuuucuucauuuaguucuugguugggggaacaaaauauccuugacuuuaucuuacaguacuuuugaauuuuuuuauuuugcuaaagagcauuuuaacuuucuuacaauuggaauguucuuuuucauagccugcuguaucuguuuuguagcuuuagcgucuucuuggauuucucuuaagaaauugauuagaccuuuuaaaaaaauguucuucuacuuccugaauuauuuguguuuccuacagccuuaguuguuaaacucauguaucuucucuuuuauuucagagguuuuucacguauuagucaauucuucauugucccuucauguuuaaggagaacuagauugauuguggcacauggccaaacugaaauuccuuuggugguguuugcagguuugcuucccugcuaggccucugcucugggugauacagcugacuagcagcuuuguauaaccggcagaaccuguccacugguagccgucucuuuaggauggaugguguggauccacugucagguuggaggcaccccccaaauuuaagaagaaaaaggauuuauucugggcaccaacugugauauaagcaguccuggaucauuucaguaguuuauuuaguaucauagaaaagaucauuucagguuucucugcuuacuuguuacagguggggaaaauaauaaacugcauguccuauguaagagcauagggaggugaggaggggaaaccauugcagcuauucaaaauagacuuguuuuaaagcuuuuauuuuaaguacagggguacaugugcagguuuguuauguagguaaacuuaggucauggagguuuguuguacagauuauuuccucgcccggguauuaagccugguacccuuuaguuacuuuauaauucguccugauccucguccugauccucguccugauccucguccugauccucguccugauccucguccugauccucguccuccucucacccccccuccuccauuaggcgccaguggcuguuguuccccucuauguguccgcguguucucaucauuuagcuaccacuuacaagugcgaacaugugguauuugguuuucuguuccuguguuguuuguuaaggguaguggucuccagcuccauccaugugccugcaaaggacaugaucucauucuuuauuuauggccgcauaguauuccgugguguauauguaccgcauuuuuuuuuuuuuuuuuuuuugagauggagucucacucugucgccaggcuggagugcaguggcgcgacgucggcucacugcaaucucugccucccagguucaagcgauucuccugccucagccucccgaguagcucagauuacaggcacgugccaccaugccuggcuaauuuuuguauuuuuaguagagacgggguuucaccauguuggccacgguggucucgaucuccugaccucaugauccacccaucucagccucccaaagugcugggauuacaggcgugagccaccgcacccggccccacauuuucuuuagucuaucauugaugagcauguagguugauucuguaucuuugcuauuguuaauagcacugcagugaacauacacgugcaugugucuuuauaauagaacaauuuauauuccuuuuauuauguacacaauaaugggauugcugggucaaaugguauuucugucuuuaguucuuugaggaaucaucaugcugucuuccacaaugguugaacuaauuuacacucccgccaacaauguauaaguguucagguuccuuuucccacaaccucgccagcaucuguuauuuuuuuacuuuuuaauaauagccauucugacuggugugagauaauauugugguuucaauuuuuucucuaaugaucccugauguugagcuuuuuucaugugcuucuuggccacguguuaugucuucuuuugaaaagcgucuguuuauguauuuugcccacuuuuuaaugggguuguuuuuuucuuguuuaagcucuuuauggauccuggauauuagaccuuugucacaugcauaccuugcaaaaauuuccucccauucuguagguuguauacuguugaaaguuucuuuugcuguacagaaacucucuaguuuacauagauccuguucaucaauuuuugcuuuuguugcaguugcuuuuggcauccucauuauaaaaucuuugcccauuccuguguccugauugguauugacuagguugucuuccagguuuuuuauaguuuuggguuuuacauuuaaguguuuaauccaucuugaauuaauuuuuguauaggguguaaggaagggauccaguuucaaucuucugcauauggcuagccaguuaccacagcaucauuuagugaauagggaguccuuuccuucauugcuugcuuuugucagguuuguugaagaucagauaguucuagaugugcaaccuuauuuuggggcucucucuucuguuccauuggucuaugugucuuuguaccaguuaccaggcuguuuugguuacuguagcccuguaguauaguuugaagucagguagcgugaugccuccagguuuauucuuuuuggguaggauugccuuggcuguuggggaucuuuuuugguuuucauaugaauuuuaagauaguuuucuaguucugugaagaaugucauugguaguuugauaggaacagcauuaaaucuauaaauugcuuuguucaguguggccauuaaacgauauugauucuuccuauccaugagcauggaauguuuuuccauuuguuugugucauuucugauuucuuugagcaguguuuuguaguucuucuuguagagaucuuucaccugcuugguuagcuguauucguagguauuuuauacuuuuucaggcacguguaaauggaauuacauuccugauuuggcucuuggcuugacuguugguguagaggaaugcuagugauaucuguauauugauuucguauccugaaaguuugcugaaguuuuuuuaucaccuuacgaagauuuuggaccaagacgaugggguuuucuagauacaggauugugucaucugcaaacagggauaguuuaauuuccucucuucccauuuggauacccuuuauuucuuucuuuugccugauugcccuguccaggaccuucaauacuauguugaauaggaguggugagagagggcauccuugucuuacaccaguuuuucaaggggaaugccuccagcuuuuguuuauucaguaugauauuggcuguggauuugucauagguggcucuuauuauuuugagguauguuccuucaauacguaguuuauugagaguuuuuaacaugaagcaauguugaauuuuaucgaaagcccuuucugcaucuguugugauaauccuguaguuuuugucuuuaguucuguuuaugugcugaaucacauugauuuuugcauguugaaccaaccuugcaucguagagacaaagccuacuugaucuugguggauaagccuuuucaugugcuucuggauucaguuugucaggauuuuguugaggauuuugcauugacguuccucaaggauauuggucugaaguuuucuuuuuuuguuuuaucucugccagguuuugauaucaggaugaugccgaccucguagaauuaguuggggaggagucccuccuccucaauuuauuugaaauaguuucagggguaaugguaccagcccuucuuuguacaucugguagaauuuagcugugacucuaucugguacugggcuuauuuauuuacuguuuauuuauuugguugguugguugguugguugguugguuggcuauuuguggcuuccucaauuucagaguucauuaugggccuguucagggauucaguuucuuccugguucagucuugggaggguguauguguccaggaauuuaucccuuucuucuagauuuccuaguuuacaugcauaaaguuguucauauauucucuagugguuguuuguauuucuguggguucgguaauaauauccuuuuuguuauuucuaaucguguuuguuuggauuuucucucuuacuagccuauuuagcaguuuauuuuauuaauuuuuuuuuaaaaaauaaacuccuggacucauugauccuuuauauggguuuucaugucucagugucccucaguucaccucuaauuuuuauuucuugucuucugcuggcuuugagguugguuugcucucgguucucuaguucuuuuaguugugauguaaaguuguuauauugagaucuuucuaacucuuugauguggacauuuaaugauaugaacgucccuguuaacauugucuuagcugugucccagagauucugguauguuguaucuuuguucucauuaguuucaaagaacuucuugauuucugccuuaguuucauuauuuaugcaaaagucauucaggaguagguugaucaauuuccauauaaugguaugguuucgagcaaaauucuuagucuugauuucuaauuugaucaugcugcggucugagagaguguuuauuauuucaguucuuuugcauuuacugaggaguauuuucuguccaauuauguggucaguuuuagaguaugugccaugcgaaggugagaauguauguucuguugcuuuuggguggagaauucuguagauuccugucaagucccuuugauccuaugcugaguucagguccugaauaucuuuauuaauuuuuuuuuuuuuugagacagucuugcuccauugcccaggcuggagugcagugauacagucucggcucacugcaaccuccgccucacggguucaagcaauucuccugccucagcuuccucaguagcugggacuacaggcaugcacgagcaugcuggcuauuuuguucuguuuuguuuuguuuuuguauuuuugguagaaacaggguuuugccauguuggccaggcugaucucaaacuccuaaccucaagugaucugcccaccucagccuuccaaagugcugggauuacaggcaugagccacugcuccuggccuuaaucuuugaucuaauacuguuagugggguauugaagucucccacuguuauugugugggagucuaagucucucugaaggucucuaagaacuugcuuccugaauccgggugcuccugugucaggugcauauauauuuaggauaguuagcucuucuuguugcauugaaccccuuacuauuuaguaaugcucuucuuuuucuuuuuuuuuuuuaaucuuuguugguuuaaagucuauuuuuucugaaauuaggauguaauccugcuuuuuucuguuugcuucguagauuuuucuuuauuuauuuugagucugugggugucauugcauacgaaaugggccucuugaagauagcacacuggugggucuugguucuuuaucuagcuuguugcuuggugccuuuuaauagggguauuuagcccauuuacauucaagguuuguacugauauguguggaucugaaccugucaucaugauguuagcugguuauuaugcagacuuguuugugugguugcuuuauagugucacuaguguguuuacuuaaaugcguuuuugaaguggcugguaauggucuuuccuuuccauauuuagugcuuccuuaaggagcucuuguaaggcagguuugauaguaaugaauuuccucagcauuugcuggugugaaaaggaucugauuuuucccucacuuaugaagguuauuuuguccagauaugaaauucuggcuuggaauuucuuuaagaauguugauuauuggugcccaaucucuucuggcuuguaggguuucugcugagagguccgcuguuagucugauggacuugccuuuguaggugaccuuaccuuacccucuagcugccuuuaacauuuuuuucuuucaucuuaacuuucaagaaccuuaugauuaugucuugaggauguucuucucaugaaggaucucauugggguucucugcauuucuugaauuugcauauuagucucucuagcuaggguugggaagcucucauggaugauauccugaaauacguuuucaguugcuuacgcucuccccaucucuuucagggauaccagucauucauagauuuggucucuuuauauaauaccacauuucuuggagguuuuguuuauuccuuuauacucucuuuucucuauuauugucugacuuccuuauuucaaaacgucagucuucaagcucugagacacuauccucaccuuggucuauucugcuguuaauacuugugacugcauuaugaaauucuuauaguguguuuuucagcucugucagguugauuacauguuuuuucuuugcuggcuauuuugucugucagcuccuauauuguuguacugugauucuucgcuuccuugauuuuguuucagcauacuccugcaucucaacgaucugcauuccuauccauauucugccuucuguuucugucauuucugccaucucaacccgguucagaacccuugcuggagugguggugcagucauuuugaggaaagaaggcacucuggcuuuuugaguugucaagaguucuuggauugguucuuucuuaucuuucugggguaauguuuguucaaucuuugaacuugcugaccuuuggauaguuuuuuuuuucuucuucuucuuuuacacuauuugaugaccuucaguguuugauugugguauaagguggauucagccaacugacuguuucuggaagacuuuagggggccaacacucagcucugaucuucuagacugugugcucuaacuuugggggacuuauauugggcaaugacuuuguucucuggcuccucugagguuaggaguccacugugcugguggggccgaagugcuccacgaucacuggucacuacacucuaauggguggugucugccaaagugcuucauaguguggcggcagcaggauccguccucauuugcacaugccagcaacagcagcagcgcagcagagugcacgcuggacaacugugacagggugcuagcaggugccagggugccugcccccauguaggcauucaccgcaguggcagaggcagcucagcuggacgacugugacagggugcuagcagguaccagggugcccgcccccauguaggcauucacugcaguggcagaggcagcucagcuggacgacugugacagggugcuagcaggugccagggugccugcccccauguaggcauucacugcaguggcagaggcagcucagcuggacgacugugacagggugcuagcaggugccagggugcccgcccccauguaggcauucacugcaguggcagaggcagcucagcuggacaacugugacggggugcuagcaggugccagggugcccgcccccauguaggcauucacugcaguggcagaggcagcucagcuggacaacugugacagggugcuagcaggugcccgggugcccgcccccauguaggcauucacugcaguggcagaggcagcucagcuggacaacugugacagggugcuagcaggugccagggggugccagggugccugcccccauguaggcauucacugcaguggcagaggcagcucagccuggggggccagagagcccuugcuggugacugugcaugugauaucacuggugguuguguuaauacggauguggguuacugguggggacaggucucugugugccccaggcaggggugguugcucaggguuggggagggucugcuguccucugugccugguuucacuccuguggcaguguuggcacaagggcagggcuggcugguucugugcucaccaaggcuccaacugcagugacgguccagcagaaggggaacaggugguagggugcacacacacaugcacacuggcagggcaaggaaagcaaaaucuguccacguacacaugugcuggcaaagagauguggaggcuugcuguaggccugggggaagcuguaauguguggagaaagcaggcaggccuggugcguggccagcgugugaccgugggggccagccugcuugaguucucugccagucaggcauaguuccccagcacaggagcuauaaugacagccuccgggguacccaaggcuauccugcaagcaggcacagcuaggcuguggucccuagagaguccagcagaccaagaggugcucagguuggaccagccccaucugaugggcaagaccuccagaguucaggucuugcagagguuagguccaguuguuccccuggggcuaaagucuccuaugggagcaagucaagccuagggagaugggcuucccuagccaugcuccacuacagacucuaccacaccaaacccucuggguuccaccucagcugacgcgcugcccuugcuucucuaagcagcucucccugccaaaucggugucugugguagaugaggggucaucuucugcuggaauuccagaggcccguagcaagaacagauuacucuucgugaguacaacucgcucauucccucagggucguugggggcuaggaacgagucccugugugcaguagcccggugcagcguucccagcauccuccccuuucagccugcuucuguguguucccuccauccacucucacugccuucccucugaaggucuguugugccagucagcucgguuucucgcuggcagcuguuccaccuggcugcuuuuaguaggcuuuagugcccuuccccucuuuuuuaauauagagacagagucucuccauauugccgaggcucguuuccaauuccugggcucaagcaguccuccucccuuggccucccaaagugcugagauuacaggcaugagccacuguguccagccuaguacucucuuuuaaggauguguuuuccaguucuuguuauuuucauucuaagggguacauugccaguauauucuaccuucuuccaaaggaauaaauacagauugguuuaaaacauagaauauuaacauuucuauuuuuccuugaauguccacuuauucuuuucuuuuucuuuuuuuuuuuuuuuuuuuuuuuuuuuuuuuuuuuuuuuuuugaggcagagucuuacucugucgcccaggcuggagugcaguggcgcaaucucggcucacugcagccuccgacuccuggguucaagcaguucuccugccucagccuccugaguagcugggacuacaggcgcacgccaccaagcccggcuaaucuguuuuguauuuucaauagagacaggguuucgccauguucaccaagauggucucgaucuccugaggauuauaaaucaugcuacuauaaagacaugcacacauauguuuauuucggcacuauucacgauagcaaagacuuggaaccaacccaaauguccaucaacgauagacuggauuaagaaaauguggcacauauacaucauggaauacuaugcagccauaaaaaaggaugaguucauguccuuugcaggcacauggaugaagcuggaaccaucauucucagcaaauuaucacaaggacagaaaaccgaacacugcauguucucacucauaggugggaauugaacaaugagaacacauggacacagggaggggaauaucacacacuggggccugucauggggugggggguugggggagggauagcauuaggagaaauaacuaauguaaaugaagaguugaugggugcagcaaaccaacauggcacauguauaccuguguaugaaaccugccuguuguguacacauacccuagaacuuaaaguauaauuuuuaaaaaaagaaacuugaagcuuugggaucagccuggaauauuuuucauaaauucuguugacaguuucuugcugaaucacuuugaauggauauucaaaacuucguuugaacuuaagaaaaauaagaauuucuuuuuguauuucacugaaugguaaacaguuucuacucucuucugggaauucauagaugaaaggggaugguuuuuaccuguccaaaucuauggagaaauacacaaaacaggagauuauauuaauaauauacuauaauaauauaaaggaaguaugaacagcuuucagugggagcuuguagagagaguuuuuccugaaaaagucaaguaaagauaaaauucaguaagcaaaaaguuaaugcgggccgggugcgguggcucacgccuguaaucccagcacuuugggaggccgaggcugguggaucaccugaggucaggaguuugagaccagccuggccaauauggugaaaccccgucucuacuaaaaaaauacaaaaauuagcugggcaugguggcacacgccuguaaucccagcuacuugggaaacugaggcaggagaaucgcuugaaccugggaggcagagguugcagugagccaagauugcgccaucgcacuccagccugggcgacaaagagcgaaacucugucucaaaaaaaaaaaaaacaaaaaaaagauaaagcaaaaaaugcagggauagagaaaccauggcaaaaggugcuaagugcugaauuuaaguguagaaccuagacucaaucugagaggacaucaucccaugucugccugguauuguacagacccuccuagucuuuuagcuagcucuuaaaggauaaaucagagaagagagcguugcgcguauucuuaguugauaaaauagcagaugaaaagucacagagguaugaaauauuaauauuaauguguauuugaggaacuauaagaaauuuaguauugcuagagcaaagaauguuugaggagaauuuugaggaaaaggcuagaagggcuuucuaugccaugccacuaauuuaaauugcuauucuauagcaaggaagugaugugauccaauccauauuucaggaagaucgugcugacccuguaauccauuacaugaaugcagacaguaacacucucaaaauuuauuaaacacacuuaaugaaauaaauaccaguaucuauguuaucugccuuuuuugccugucacucaugcgguccucacaacuccuuccagccccuaaacuaaucaguccgggcauuagagagcuuugaaauguuuauuaagaaaacaguccuguuuugacagacaggaguuagagcaccuggacuuaaagcaggcuuuacagcucuacuggggaucucucauguaggcaacaugaggccagcagagcccugugcaaacaggcaucauaagcaaaugaccauuucuuuuccauuauagacuucauccuucaaaagggagugccauucgucccaacuaguauuuuccccccuuuuaucugugucacuaaugcuaaauuaguucaugggucauucaaauucuagcagcuuugguguuagucuuuauauuucaguuccagugcuccgcugauuauuuuggcaugaaacuaucccauacagucaucaugcugcuuuuaauucaaaagauuccuaugagcugcaccaggaauaucguaucuaguacaaaaacuguaugucuguucuucccugaagcagauucucuuguaacuugaguuuaguuaucuuaguauugauauugaguuauuuuuagagaguucuguggugguuaguggcucgguguuuucaucagucguucacuuaacuauccuuucggaacaucugugccacuuacgcugucucacuucucacccaagucuuagaugcuuuuucauucuucauauuacuaggaaagauuaaacacaucauauaaugccagugacugcaggacuuuccuuuaaagcuucuaaacuaccugccaguaugcugaaauaagguauauucugaagcuuaucguuuaaauuguagauuucauauguaaaaacauuuuuuuuuuuuaagacagucuugcucugucacccaggcuggagugcaguggcgcgaucuccgcucacuguaagcuccgccuuucagguucacaccauucuccugccucagugucccguguagcugggacuacaggcacccaccacugcacccggcuaauuuuuuguauuuuuaguagagacgggguuucaccguguuagccaggauggucucgaucuccugaccucgugauccccccacuucggccucccaaagugcugggauuacaggcgugagccaccgcgcccagccuguaaaaacauuuucaucuuuguuuauaaauaaaacaucugauuauacaacaauacuuuuaugggacucaaagaggggagucaggguugggguggggucugucauuuauuuacuuauuuuuaaaagauaccuggccugguucuguggcgguggcuuuucuucgcuaaucaugagcuguacuuugaguaugcaguagauuccgucagcaucucagugggagaaaggggggaaagagggguuuuaacacaguguucucuuugcauugagugaagaagcuguugaucucugaaggaggaaaggagagacuggaaccacaugaaggcuugugcugugaaacccugaaacccugacggugccuuuugaucacuguguuuuaacaaagcugacaauccucagccacacaaaucuugggaacuaaaauaaguauucauuuaacucuugacuaaagguuaaaagauacaguuaaaaagaaaucuaaaacccagagugguaauuccacuuuuucuuucucuuucuguuguuggaaccugagcucucuaggaaaacuaacauuuguuaagggccugccaugugccagauuccugucuguaagagagguauaauuauuauuuuacacuaucucaaucuuaauaacaacuccguuaaguuuacacauuuauauuuccauuugacaguuaaaaucaaggaaguucaggaagcugcuugucuagggucauacaacuaguaagcggcacuguccagcuccagaacacaugcuuuuucuuguguauuuuagugcuccuucagucacuuauaugauuuacuuauuuguuauucuuuuauaaauuuaagcaguaguacaaaguagaaagaauaaagaaaaaaacagcccccaagucaauugccuagaaaauaaucauuauuuguaguagguaagcaggauuccugucauauuccuaugcacauauagaaaaaaauuaacauauaacaugccauuuuaaauaaaaauugaauuuaauuuuacuugacauuagcagaauaaagagaauuucaguagaauauuucuucuuuuuuuuuuugagacggagucucacucugucgcccaggcuggagugcaguggcgugaucugggcucacugcaagcuccaccuccuggguucacgccauucuccugccucagccucccgaguagcugggacuacaggugcccaccaccacacccggcuaauuuuuguucuauuuuuuaguagaaaugggauuucaccguguuagccaggauggucucaaucuccugaucucgugaucugcccgccucggccucccaaagugcugggauuacaggcgugagccaccacgccuggccagaauauuucuuuacuauaaaggagaauuccuaagccauccuuccaaguuuaagaaaagagauagagauugggguuauguuuuacaacagcaucuuuuauuuuuauuuuaaucaguauuaauucaugccaugcucuaaaagaugaagaaauuaucacuucuucucaccaguuuuuaaugauauaguuuuauaucagcuuuaccaagguuuauaauauuuacaucuuauuuuauaacucccaggcuacuuagucugggaguuaaauucagcacuuaacaccuuuugccacauuuucccuaucccugaauuuuuugcuguaucguuuugcuuauuuaauuuuaucuucacuugacuauuucaggaaagacugaugcugaauucugguuuucuuguuuuauguuugcaugcuugauaguguuuauuugccauucuacuugaaguauuacuuagcuaguuacgaaauucuuagguguguucuucuaaugcagaguggaugaauguucccggaugcucucuuccugccaucacugcaucugauguugccccucugaguuagaacagaagggccaggaauugacuucagccugcuuuucuauaaccugggaaaugugaggagcuaggacuauucucagcuggaucuccacugucuuuguggaaggccuggacucaaguuuuuguuguuuguuuguuuguuuguuuuuccugaaauuuugauaaauauccuguauucauccugguaagcaugagaagguucagaucgucugugaaauucuuuagagauugcuagaaaacagcauauccuaguaauuuuucuugccuuuaugagguugccauaguuaaauguuuuguccugacucaucucuuaaaccaccaguccacccuuuuccaucuguuuuucuccacauuuggggauauuacugggaauucucacaguuuuaucaccucacuucugaauugcuucugggcuuagaauaggguaaagagcaacacuauuuuucaccaaaauuuuuguugauuuuauuaccugcagcccaacacaaaaauacugacaaaccuuucauuucuaggagaacaacugauugacccuaauagaaaaaauagacucuaucagucagguauuccaguguauaggaaacagcguguugugacauuuguuuauuuaagagaugaugguuuucggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacuggggaggcugaggcaggagaauggugugaacccgggaagcggagcuugcagugagccgagauugcgccacugcaguccgcaguccggccugggcgacagagcgagacuccgucucaaaaaaaaaaaaagagagagaugaugguuuucagguuuuuuggguuuuguuuguuuugauccuuugaggaugguauguuguaguccagagaagguauuuagaauugugacaagguaauaaaauugagacaaacacgauuauuuaucuuugucgagagucacuccuggcaauuuucacauggaccuucguugaaaugcaucauugaaauacuagcguacauuuuagguauuuuacuguuucacgguaugcuuauuagucaguguaaaaugcauccuaaucaaaauuaacuacuuugaaaagggaaguugaucgcuucuuggccauuuggcuaagaucaacugaaaagggaaguagagauaauaugguacagcaauuuauuuuuaaaacaauuaguuuuuuuaaacugacaaauaaaaauuguguauguccaucauguacaacaugauguuuugaaauauguauauuuuguggaauuguuaaaucaagcuaauuaacauaucauuaucucacaugcuugucauuuuucauggugauaacacuuaaaaucuauacucagcaauuuucaagauguaguaauuucuauauagagaaaaucuguagaacucaggauugucuauuuugaagguucuuaagauguauuuccaagaaaauacaguauaaauuuugugauugauaccacuuuucaugcuagccacauaaauuguccuuuuugcucccagguuaagaauucaaggcuuacaaaaaugaacacaaggcugggcacaguugcucaagccuguaaucccagcacuugggagaccgagacgggcagaucaccugaggucaggaguuuaagaccagccuggccaacauggugcaaccccgucucuacuaaaaauacaaaaauuagccaggggugguggcgcaugccuauagucccagcuacucaggaggcugaagcaugagaauugcuugaagccgggaggcagagguugcagugagcagagauggcgccacugcacuccaaucuggucaacagaguuagacucggucucaagaaaaaaaaaauuauaauugaaaaugaacacagguuucuuguaugucucuccacuuaguugauucucuagagugugguacauuuuacaauguguugucugcaguguuuauuuacauugucuggcaugcuacaaagguugguagcauuugcuaauaaggaaccacuaugugaccaguguaaaugaucuaccagugccucuuccugguuucgauuucuuuccuagcaaaauacggguauaagaagugaaccagacgucuuuaagaaagaguaugucugcuacucuuguuuccaaaaguguuuauauuuauucauuaaagaacuuuuguuacugaauucuuuuuaggaaacuuagugaaccauacacugccuguauggccaaugaugaagaaucagcuuaaggggaaaaaauguauaauguccagccaggcgcaguggcucacgccugucaucucagcacuuugggaggccgaggcgggcagaucacuugaggucaggaguucgagaccauccuggccaaaaccaacauggugaaaccccgucucuaccaaaaauacaaaaauuagcugggcgugguggcaggcgcccauagucccaauuacucgggaggcugaggcaggagauuugcuugaaccucggaggcagagcuugcagcgagccgagauugugccacugcacuccagcccaggcaacagagugaagacuccaucuaaaaaaaaaaaaaaguauaaugucucacaauauaaugcaacaagauuuccuacucaggacuuacaaagaccugugucucuuaaaauacacgggucaccggaauguagguuuuuugguaagugcugagcauuccuauauucauuuccuuccucuguuuuaugauucacuggaaagcuucaagccuugaaauauuucugauuugauuuuugcaauauacuuuuucuucccauugccaugcucguauuucugcacaccucaugugcuuauacaguccaaucauuuugaugacuuggggaggugugaagaggcugagcuagacuucauauuuucuccugucccguguucuuauuguaaaggaauguaguaaugcacugugucuuuuuugugucuguuguuggcuacauguccucaaaacauauucaacaaguagacgucuauugaaaagaaauuuuccuaaguuguccccaagaaaacgacgacacuggagucaguuccguguuuauaacagagucccaacacuuguuuuucuccaggguuucuacaagaagaagcauaaaacaguguuaguaugugacugaccuuuggcuucaaggcuucaguaaauccguaaagugagauugauuaggauuaauagcuuuuuguccuagcuaaaaaguguucgagaucuuggcuuaaaaagaguucuuuuuggccgggcacaguggcucacgccuguaaucccagcacuuugggaggccgaggcgggcagaucaugagaucaggaguccaagaccaccagccuguccaauauggugaaacccucucuacuaaaaaauacaaaaauuagccaggcauagugccauacgucuguagucccagcuacucgggaggcugaggcaggugaaucgcuugaacccgggaggcagagguugcagugagccgagaucaugccacugcacuccaaccuggacgacagagugagaccgucuaaaaaaaaaaaaaaaaaaaaguuauuuuugauaccuuggaauguguuggccguuuuaggugcuuccagcauuuuauucaaagaguugagaacauaaaaggauagcuugauuauacuuagaccuuaaaaaacuuuuaggaguucaucaaacacauaaccuuuacaacugguuagacuuccagcuuuccuaaacaagaguauggcacucuugccaguguugguuuaaaguacauguaauuuacauaaaauagcacugacugcagccuaggucucuaagcagagaaugcucugacaacuuugucuccagguccacucuacuguuccuuauugaggagggaaaccagguucacaguguugugcuuucuucuuuuggcaccaaaaggggcuccuccugguuuaugaguuuuaaaggaugagggaaaaauucaucaugggggauguuauuuuccucaguggguaagugaagucagggaaaaacagaaaacaauggagauaagaggaugggaugcguucaguuuauucuguuguucucaccacaguaauugacucagaagggacucauucugaauuuaguaucuaguguuaaaagaacaggccuggggcaggcggaggccagcacugagacacagugguggguugagaccuauuguauuuuuuaaguuguuccaaggcuguccagguguccugauuuaaagccugcuucuuaagucaggaaauuguaucuuguucugagguuuacuguaauaaaguacacaguccuaggggaugguacuucuggcuccaugaaucacuuuacaggcuggcuguacugacccaagccucaugauuuauuuaugccauaccacaguaggaauggcaaauauguaagccacacauggucuaugggaugggccuuuaacugggaaacugccauaaauccgugaagucagguaggacagagccagcaggagcucaugucguguacaagauuucuuccuguuuuauagggacuuacaguucuagagcuaauuaaguucauccuccuuagaguguaucugucuuagucuguuguguguuguuauaaaagaauaucugcgccuggauaauuuauaauguaacaagguuuauuuagcucaugguucugugggcuaagaaguucaagggcauggcccuggcuucuggcaagggcuuucaugcugcgucacaaaacagcagagaaggucaaaggggaaggggacacaugcaaacaggagaaccugaggguccauccuggcuuuaucacaacccacucuccugggaacuaaucuguucccugcaauaccuaaugcagucuugucagagugggaacucacucacuaccacaagaucagcaccaagccauuccugaaggauucaugccccugugaccugaacaccucccaucaggccccaccucccaacaccaucauacugggaaucaaauuucaacaugaguuuucguggggacagacaaaccauauccacaccauagugauauccuuggacuuuuugugugcuguguuuauccagucuuugauuuacugcuuacaaaucuaaagaauagcucugaaauauagucuaguccuauugucacugauauuuucucuucgauuuauuucuauaaaguguugcccauguuuuucaaauaauuucuauguuuugaguaaauacuaaggagugcgauggccagaucuuaagaguauguuuaguuguguacagaacugccaaacugucuuccaaagugcuguaccauuuugcguucccaccagcggugaaugagaauuccuguugcucagcauucuugccaucaucugguaguguguguucuggauuuuguccauugugguaaguguguagugguaucucauuguucucauaugcauuuccugauuacguaugauguggagcaucuuuuuguaugcuuaugugccaucuguauauauuccuuggugaggugucuguuaaggucucuggugcauuuucuuccuuuuaucuuguuuuauuuuuguuuuuuauaauauuuucaauuuuuaauugauacaacauaauuguacauauuuaugggguacauagugauguuuuaauacaugcaguguaucauaaggcccauuuuuuaaucagaucauuuauuuucuuaguguugaauuuuaaguaucuuuuguauuauuuuggauaacaguccuuuaucaaauguaucuuuugcaaguauuuucucccauucugugucuuauuuucucauucucuuaauauuugaauauuuaaacacauauuauuuauaaauuaaugguacauuauuuauaauaaugguuaaacgguugguaaguaaaucacugcugaguauauacugcuuugaagggcccaaggauccauuaggccuccagcuuuaacccagcacagcauucugaaauacccaauucuccccagaguuucaagagucaccaggccuuaaccuucuuauugccucaaggacucuuagagcucaccaggcuccuccuaccacaagccuucaucauaucacccuguuccuguugcuuagggagcuuucucaggauagcauuucaagauugaguacccauccuaguuuucucaguguuccuugugagccgugucacauagaaggcauuuaauaaaugugugcugaacugagcugaaccagcaagggcaaaagggauuuaagagacugccguuuuaauugaaaaggaguaaaaagacacugggaaaggcagcauguauugggggaauaugagaaauuuccaaaucacuggaccaucaggcuggaaaauuuagguuggagccaaacugcaaaugguuugaaugucaucauguauaguuuauguauuuauauauacuuaccuuucucauagaagggugaauuuuuauauuauaauagcuagaauguucuuagaauuuaucuucuuaauucagaaaacaucacauugagaucugucaguaaaccccccacacacacaaauaauuucuuguccucauugaccuucggucugagcucuuaaugcaguuuucucuacuacacuuguccaugcacauaguggucgcagacauuugagagaaugaaaaucauguguuuaaugagagauuguuaucggagacuguagcacuuguuuuacuuuauucuuucuauugcuuuuucucuuuuuguuucuuucaaaguacauacaaauacauauucauuauauccuauguaagggaauguguauuuacucuagaauaggacuacuuuaaguuugagauggcuuuuugcuuuuaaaaauauagaugagugugauuuaggcauguauauucagucagaucuuuuagcucucaccuugauaaaauuauuggguacgagaagcaaucaagucuucuuuucuuuucuuuuuuuuuuuuuuuuuucugagauggagucucgcuuuaucacucaggcuggagugcaguggugugaucucugcucacugcaagcuccgccucccggguucacaccauucuccugccucagccucccgaguagcugggacuacaggcgcccgccaccacacccagcuaauuuuuuguauuuguaguagagaugggguuucaccguguuagccaggauggucucgaucuccugaccucgugauccgccugccucggccucccaaaguacugggauuacaggcgugagccaccgcgcccggccuacaaauaaugcuuuaacgcuaaagagacaggagaacauuuucaaauauuuuaaggacaguuauuugaaagaaugaauuucuuuuauggagcuuaaaggaauagaacuaggguuacaaagagacagcucuuucagucuuaauaauuaugcaggauaauaaaaaauauaaauaaaacuuaaaaacagagagcuuuugggaucaguucuauaaguaauuuccuaagagguugucaaagcugguauaggcaccagcucauucaauguguuuaaacauaggcuggggggccacuuggcagccaugugguguggaacacaagcaagccgugauuuucaugaauggaucuguucugugaggucucuuguuaugcuaagaguuugugauucugguuuuguuuugugugaucuugaaagacugauuuaugaucucuuuccacuuguuuacugcuguuuacugcucagcccauugcaauauagcuucugccuccagcccugaaacuacccuccaaaguaguaacuuucgaaaaacuaaauccgauggaaauuuuguauucuuuaucuugaccugccugugaaucuuuaacauguuuuaucucuucuuauuucuggaaacuuucuuuaucuuuggcuuccaggggaccaccuucuuuuuguuuucuuuuuccucuaagaccauucccccucaguucuucauagacuucuuccaccagugcugugugccccgccucuuaucuugguggucucgugucuuaucuugguggucucauguacuccugugauuuuaauuacuuucagugcugaucauucccacguagucuuuaaucggguccugauugcaggacugucaguacaacugccuaccagguaucuccccagauucauaagguugauguaaagauuaaauuacuuaguuaaggccaggugugguggcucaugccugcaaucccagcacuuugggaggccgaggugggccaaucacuugaggucaggaguucgagaccagccuagccgacacggugaaaccccugucuacuaaaauuagaaaaaccagcugggcaugguggcaggcaccuguaacaccagcuacucaggaggcugaggcaggagaaucauuugaaccugggaggcagggguuucagugagccgagauugccccguugcauuccagccugggcgacaagagugaaacuccaucuuaaaaaaaaaaaacuuaguugaaggugccuaguagaauaucuggcucuauaguaaucaugcuggcaaugcuaauuauagugaguguuuacccaguucauucauacucuugaagaaucauuuauuuauccuuuucuugggucagggcgcaacagagccuugcucugucauccaggcuggagugccgaagcgcagugucggcucacugcaaccuccgcguucuagguucaguugauuuuccugccucagccucccaaguagcugagacuacaggagugcgcccggcuaguuuuuguguuuuuguagagacggggugucaccaaguuggccaugcuggucuggaacuacugaccucaggugauccgcccaccucagccucccaaaauccugggauuacagcaguccgcccacugauuuaucuuuaaaucaccacuucccaaacuguuuucucuuguacuaguaucccucaaggugguaagugauguuccacccagaaaagagagaaggugggguuccaugaucaguuaaguuuggaaaauacuuuauagguaggguuggaacuuuuucaggggccagauuguaaacuuacugggcucugugggccauuuggucucugucacacuacucaaaucucuuguagcaccagcguagccauagaaaauauauaagcaaaugagcaagguuuuguucacuaaaauuuuauuuguggacacuaaacuuugaauuucauauaauuuucacaaaauguaauuauuauauguuauaugcuauauuauuugggguuacaaaaguauuauuauuuucuuuuuuuucaaccauuuaaaaauggaaaagccauucuuugcucaugggccaugggcuggcuuugaccaugaguggcaguagcuugcugauuccugcuuuaaaauauagcccccuauuaaagauaugcaaccuacaccauaaaaagcuuuucuaaguucugcagcagugcuguuaugaccaguguuccucaaacauauuugaccguggaaaucuuuugucaugcuuauuuguuacugucucuugcuguacuucuguggaaugugcuuuugagaaauacugaccuagagaauagcuauguaugccagagguaaaguuuggccuguggagcagacuguaaauaacaagagaaagcgucuugucuuuauuccucuugcucugaucgucagcuccaacuggucacagacagaaugguauuuugggaaacugaauucacucuacgaggugggcaccagugaaccacuaaagcugagucaaagauuagcugaauugaggguggacaugaugaaguuaauuccgucaaccagcuucagaaaugggaaaaauggcuuuaacguaagguaaaauagaggugcucuaagugagauaaaauacucgguccuggcugggugcgguggcuuacaccuguaguccuagcacuuugggaggccaagguggguggauugcuugagcucaggaauucaagaccagccugggcaacgugaugaaacccugucucuacacacacaaaaaauuagccaggccugguggcacaugccuguggucccagcuacuugcagggcugagaugggaggaucgcuugagccuaggaggucaaggcugcagugagcugagaucacaccacugcacuccugccuaggugacaaagugagacugucaaaaaaaaaaaaaaguguguguguguguguguguguguguguguguguuuauauauuuauauuccguugaggaagaagagauccagaggucauaugcaaaauauaaacaguaauagguaucaauuucuauaguuuugaaaucuuuacugcuguuguuuuaaaauaugcaaaaguuuaaaacuuaaaaaauugaguuuauauauaauaaaauucuaaaacuugcuuugaaauaauauuuucaguugcuguuuuugugugugugugucuuugagaaguaggaugugugacucaguagggaguaaagguuauugcuuuacuauuuugagcauauuuuucccuaauaaaaauaaugccauagcuaaggagagaaccuucaaauuaaaaacaaaaacacuuucauuuuaaaagucuacgcuucccaucuuuuuaugucuacuuuaaccguaugccccuuauuaaaaggaaaaauugguguaguaagcauuguuuuuaaauucugucuggcauuuggcaagcagcuagaaccuauaggaggaugcagaaaagaugggaccaucccagcugaugagaauuuaucuaccugaugcaggcauagucauugcccauucccacagaauuuacauaccaggugucucauuccaaaccuguguaggagaaaagggacucuuauaguuuuugccaacagauugauagcugaugaauaauaaaauuguugaaucauuaaugcaagaagguaauaaauuaccggguuuguuuucauccauuuggccaacaaauguuuuuggugaccuccaagaucucaguagccccaaugucuucaguacucucucagcaucccagcaugcacucauauauaucccugacagcuuucauaagcuuccuauacagcuauaggaguauaucucggauacuuacgcauuggagcagcuccuacuuuuuuuguaaguguaccacaaaucccaaaauuagauguucuauguaacgcuggcuauuuuaugagaucaagacacaguuggaucuugauuuugcuggagguggagaccugagugcccugacacugcuggcauucuucuagcaaacgucaugacaaacagacguggaaugcagcacaggcuaaagaaaggcgagcaagcccccucgguagcacaguguggacagcugguauggacaugcuauccaucuaaaacugggaaagguuaaauaaacagugggacagugacaaagugcagagauuaauugccgaaagcauucaauaauucuuaaaacagacaucuaaauaagcagaagcauucuggaguuugaguucugagagacaauguaagaagacuuuauuuacuuuuggagacagagacuuccuaaggaaagaagacaagauaaaugguguaguccaaaaguagacauauauaacaacagguguaccuuaguuugaagggacuacaucuucauaugggaagauuguauucugaaauuuucuguucauauuacauacacuauaaaacaugaagcguaaaggacauacuguuguaaaauaauaaagacaaaaugagagaaaaggccaauauaaaucuuuuuaucagaccaucuccagauguuacugugaaccuacuacuuagcuucaucucuugaggcucaagcucagcuuccccuccuccaacuucauccccagaucuccagcgcagaucaguggguuuaagacauaauucaguagagauuuugauaggauuugaguaaaucccuaacagaaacucccuuggcuugccagcuauuuuuaaaggcagauauguagaaagcagaagauccuaaauucaccuaucugucuugugauagcccuugccaggaaaauaggagauuugcccaagaauauauuauaggauguucuugugguacaugccuguagucccagcuucuugggaggauggcuugagcccagcaguuugaggcuacagugagcugcgaucaugccugugaaaaaacauugcaccccaacccggacaacauagcaaggccuugucuguucaaaaaaaaaaaaaacacuaaacuuuuuuuuuuuucaaauaauacauuagauagaaccaacccauagaagucaucucugcauaauauuucuaaguccaauaaugaucaacauuaugagugccugcaauaucaugagaauuuaagagucaaaaguuacuuugaucauuuucacuauggaauugaaagauucuuuuuauauacuuauuggauuaggaaaguacauacaaaugcuaaaaauccagucuuggcaaggauguagggaaucagagguauguaauaccuuaauguuggucuuuuaaaucagcucgucuuccucuaaaacaguggaucucaaguauagauguccauuccagaaacucaguaggucuggaguagagcacagacuuccauuuugaauaauuucuuucauguuugagagccaccauuguaaagcaaaucugauaccauguaauaagcuauacaacucuccacagccgcugaccuauuugugagcccuucuuggguucugcaggggaaagcugcuucccgcucauagacugaauuaugucuuaaauccacugaucugugcuggagauguggggaugaaguuggaggaggggaagcugagcuugagccucaagagaugaagcuaaguaguagguucgcacucuggauugauuuucauaugcuaaaucauuuagaauuuccauauccauuuucacuucaaccguuauaguuuggcaugacauaaaucuucuuacaucgacaaagauaagaguuugcuucauuuuuucauucugguguuugggaguaauuuucuggaggaaaaugucacugauaggucuuugcucugcugccuugaagucaggaauccaaaauugucauuaguacuauauuggagcccucaaaacuuugaccaagguggggaaagaaaaagcauaacagcuucagggaaaaguaggcucagucgaggcuuucucccugaggaucaguaauuguagcauggugagggguuggauaaucaaucauuuuaggucaaauuaaacauauuuucuuuacgaguucugucaaaauagguagacaugagguagaauccaggagucacuucuacacucaacagaaauagagacaacucacuagaacuaagacuguaaggaacagucuaagauggucuuaguucauuuuauugcuguaauaauaaaguaccacagacugaguaauuuauaaugaacagaaauuuuggcuuaugguucuggaagcugguaaguccaaaagcaaggaaccgacaccuggcaagggucuuuuugcugugucaucccacgguggaagggcaaagaggguaagagaaaggcggaaggcagguaaaaggaggccacaccccgcuuccucguuaacagaccuacccuuacaauaauggcauuaauccauucaugaagacacagcggucauggccuagcauacccuaagcguucuaccuauuaauacuguuacaaaggcaguuaaauuucaacaugaguuugggagggaauagucaaaccuuggcccacucacugaauugauguuguuuuccuuucuguuauaauguuucaccguaaacuguaguucccuacauauuauauugaaaggacuauuggucuguauauauuuguguaucacaaaagaguuacgucaucuuuagagucuucuaacauggagaauauauagauacauuuuauauacaauuugauaguuaacuaauucuauagaugcaggcuuuuuuuuuuaaagaaagauacuaugugccauuauuuugcaaauuaauguaaaucuuaaaaauuuuuaguggauuuuauucuaaacaguaaauaccaaaugagcagacauugucguaacuagguacucccuucuccucuggcaucuuuuuuguuuguuuguuuaagaagacauucugaggcuuauuguaauuucuuaauuucucuucugauuuuuaaauuucaguuauguugucuguuuuacuauugacagacauuguuaaguauaauucaaaaguaaagaagcuuagaauauaaacagggaucuggaugucauucagcagaagugcucucuagucaugaagaaaaugaagcuuggcuaugaaguagaagaaucuuucuaucaaaaaauaagaacguuggaacuuaggauccaauagagucgcacaauagucauauaggugauuuuacacuuacuucauuggggcugucauggcucaaauauauuugugauccuuuucuuggaaauugcuuucagagccaguuugcaggaugccccuaaaaauaaauaugcacuuacacuucacuguaauccaaaaccuaucacucugauucauugugcacaagacuuggugucaaaauuaaaauucaguuaauaaaaaggguauuugucauaauuccaaauauuuaaauaaugcaauaaaacugugaagcuuaaagagaaauuuggcagcaucacuggaauaaauuuuuguguaacuucccaaaauuaauucccugaagaauauaucuuucauuucaaauauaaguacaaguauauuuuauaaaggaagcagcuagauaacuuuugcuaaaguaacguuuaaggaaauacagggcuggguacaguggcuuacaccuguaauuccagcacuuugggaggccaaagugagaggaucacuugagcccaggagagcagccugggccacauggugaaacccccucucuaauaaaaauaaauaaauagaauagaauaagcuagguauggugaugccagcuacuugguauguagucccagcuacuugggaugcugaugugggagaaucaccagagucugggaaaucuaggcugcaguuguuggcuaugaucucaccacugcacuccagccugggugaugggagugaggcucugucucaaaaaaaaaaaaaaaaaaaggugggcauggaagaugaauggaagauacucaaagauagacccacgaaacugaggauaugcuauuucagucucuggacuaaaaaaaauugccuguuuucauggacacaggaaggggaacaucacacaccggggacuguugugggguggggggagggaggagggauagcauuaggagauauaccuaaugcuaaaugaugaguuaaugggugcagcacaccaacagggcacauguauacauauguaacaaacaugcacauugugcacauguacccuaaaacuuaaaguauaauaauuaaacauaaaaaaauaaaaauuaaauuaaaaauugccuguuuuuauuaaacuaguaaacaauuuguagaaaugcaugauuugauuaaaugaguuuugggugccaccuucauaagggaagcuagaacugugcuuaaauaccaggagcccugcuaccuucuuaaucuugagcacuaaaacuaagaccuauaucuaaaaacuuagccuaaauucgcauuccaccgucaugaauauggaaugaaaaucucucaugaaguugguuuucaugaaagugccuccaggaaagcaaaacucuggaacauugggccacauuuauaagaccgugauuauucauuaaaaaacugaggauguaauauuuggaaggccuuuacuuacuaucaacucaucaacaguaugggaugaaacuagcagcuugacuuucuguaugaaguaugggggaaagaguggaaagaaugucagaguucacugggaccuucuuuagagccauggggcugaauuuuauuuaaaauauucauuggaaaagcaccuggauuccaaugcuucuuaaagucauucuguuuuuccaugcaguucguuauuugcuuuuagaccuuuuaucuccaaguuguuuuauuuaguugcuaguauuucuucaggugucauuaucuugcaucccucuagaagauaagacacacuauugugugcaugugaaauuagaauuccuauaaauaucucauucuugaacaaauuuucaguaucaccauaaaugauauuuaacacuaaguggccaaaaacaagucauucacagagauucugcaucauauucagucugacagcacugaagcugugguuguguauuuuuaacuacacuuaaugaaaaaggacaucaggacuccagcaaaguugccagcauucaccaggucuuaugaguucuucugcccuagaccuuuucucaucugcucuguccauccgaucuuggcacucgccagcucugccuucuuaguccagcaguggcucgauaagaaccguugaucuucagagcucugucucucucucucugucucucucucucucucucucugucucucucucucucgaagagcuggaaaagaggacucgaggaaaaaauauucauaggguaauuuguaucuuccacauuauuuaaauuuggaagcauaaaaauacauugugcuugaaucaugcugggugaaauaagccagauacaaaaggccaaaugcugugugauccuacuuauaugagguaccuggaguagucagauucaaacacagaaaguagaaucguggcugccaagggcuggaaggggcagaggaggguguuagccuuucauagguguagaguuucuuuucaggaaaaugaaaaaucuuuggauauggauggcggugacaguugcacagcaguaucagugugcuuaaugccacagaaauacacacuuuaaaaugguuuaaaauggucaauuuuauguuaucuguauuugacuauagguuaaaaaacgugcuuauacuuaucauguuugcuauaugagaacauuccucauucagaagauuuuaugguucuuaaaguaacuugauuaaggaauaauauaaauacaauaaagugcgaacauuuuagacauacauuuuggugaguuugucaagcuacagucauuuccaggagcuucugucugcccuuucuggucacucgccauuucccacugcagucccuggcaacgacugaucugccuccgauccuuguggauuagaauacaguucauuuuuauauuuuuuaaacaaauuuggaauguacaaacuuuuguuuuuugacaaguagagauacagaugucgaguuuuuugcccaucugagaagcagguagaggcuuuauagcagaggucucaauagcacaguaaaacuaagucuucuaaacuugccauaaucuuaugaacaugcucauuuuucagaaaaggugaaggaaaaaacugaacgcaaguuuuccaccuacaauuuuguucaaucaaugucauuuacugagcuauaaucaccagcaguuucugccuuuauaauguuaauuuugaucuuuuucaagaacuugugaaaaauggaagucaguccauauugggauaacuucucuacccauucccuuguaaguguauuucuuuccuuuuuuuuuuuuuuuuuuuuuuuucuagagacagggucuugcucugccaccuagacuggaaugcaauguggugccaucacggcucacugcagccucgaccuccugggcucaaaggaugcucccaccucagucccccagguagcugggacuauaggcaugcaccaccaggcccagcuaguuuuuuuuauuuuuugcagagaugagguuccaccauguugcgcaggcugggcucgaacuccugggcucaagugauccacccgccucagccucccaaauuguugccauuacaggugugagccaccaagcccaaccaugaguguauuucucacuguaggucaguuccuuucccuuguuucaggagauagagaaacaugagaugagcagcaagugagaaaucuuggacauugugcuuugcacaggacuugccauugugcugcaggagggcugugcuaggcaggaccccagcgugcacuguuggaacuaugcccugaaauagucuguauuuggugaccuuugaaaguuucuuuguagcauuuaagcguaaaugugauaguuauuuuguguugcauauucauugacuagcauagcagucuuucauuuagaguccuaccugcaauucuugaauccaagagucagacagcagcguuuuauucuucauucuuuaggaacuguuuuuguaauauaagauuuuuacuucuaacacaucucuagcaguagcauccuggccuuuccccuugcagaaucuucuaaucucuccucauuaccuucaacucagucuuucuaagaccuugcuuuacuucucuaaaacuuuugguauuucuauauuacguacaaaaucaaaucacuucucauucagcauuuuuguguacccucugccugcuggguucugguuaaaacccucaaggauuucacauucuguuuauuccuuaggccaccauuccagaccaucucuacucugauuuagagcugccucuucagcuucucugccauuuccugucccuguagacacucucuaauccaguucuacgauguguccucacaugugacuggugcuuucacacuugccacucugucuuucuuauuucucugucaaaauagggcccaugucaguucccacguccuuagccugaggugauuucucucugcuguacuaccucagcauuuacugcccauacaguauauuuggcacuuagcauuuauuguuucaucucauuaguuauauuaaaaucuuagaguugaaaaggacagucucaccacugaaaacaaaauuacuuacacaauaucucugauaaucuguuuaaacaccuagucaugggaagaucuauaauuuuuuagcuuuccaacucuacuuacuaacaaauauuaauacacuagauguuccuuuuauaaaccaaaaucucucucuuuugcgacuuccccugcuuuaguaacaauugugcccucuggacaaacacagauucaauguucuguuuuugcaaaaccuaccuuaaaaauuuugguagaaaugauugugcuauguuaguaaaucuuuuuagauuaacauagccuuauauaaucccacuaugucaucuuccuuugauaccuucuacuugugcacccccucuuaaauuaugacauauagaauugaaccuagugaaccuagguguucaguuagagaaaaacacagcucuuucuuucuuuaaaugaaauguaaguugcccaaagcucaugguuucuuucuaguugugguuuauguuuaucuuccuuacgugcucugcucacuugccuagacgcuacuggccuggaaaaaaaaaaaugccuuaaaagugcagugaaauacagcuucaggauaggugaaaacacugaacagcgggggaaccaccacaacagauagaagugaagucagaaucagaggugcaguugguucaagauacauucauuaugagccuacucugugcugggaacuauucuuagcauuuggaauucauuacagaauaaaacagacaaagauccugucuuuguggaguuuguauuccaacuauuccuaagcacaggcuuugggcaaacauugaagacuagcaaaguauaucagcguauugaguauagaguauauagaguaacugcagcccuaaauaaaauaaaacaagaaagcuuaagcaguuuaggcuaaugcaaugcagaacaugaacaauacuugaaagcuuuuaguuuucaaguuuaggaaccaagacucucgaaggaagacauuuuuuaaaauguaaaaauagcagcauaauaccugaaagauagacacaacccaaguguccauguuggauaaauggauaaacaaaaugugguaugugggugugguggaauauuacucagccuugaaaaaggagauucagccacaugcuacauggaugaaccuugaaaacaucauguuaagugaaauaagccagucacaaaaagacaaauacuguuugauuucacuuaugugaggcaccuacagaagucacauucauagagauagaaaguaaaugaugacugccagaggcugggggaggggaaaagaggaguuacuguuauugguauaguuucaccuuuguaagaugaagagaguucuggagguuggucgcagaacaaucuaaauguacuuuacugaacuguucauuuauaaaugguuaugguaaauuuuauguguguuuuaucacaacuaaaaaaaaccuaaaagauaaaaguuaaugagcuaauaaacagaccaauaaaccagaaacauuaaucaauuuugaagagguaaaucauaaacauacuauaaucagagaaacagacccuacccauguagaagaaucaaaaaacauuuacagagcaaaugccuguuaauaucauccaaacuauguaagugcugaaaggagaugcugaauggagagaaauuagcaguuaagugaguagccagauuuugaaggagagaaagcuacaggcauuucaggcagaggacauaacauaaaccuaagugaaaacacauagcagcucuaugacagagaguccuuggaagacaguaaggaagaaauggguuaaaaaauuguaggugauccugaauauuaggcaaaaauauuugcuauggcaagagaccuaaugacgaugaccuuggaaaaguaggacaguauagaaugauggagaaaucagagaagaggcuuuaagaauaaugcaggcccaagauaaaagggugggagugacgugcacagacaaaacaguggguacauuaaaaacuaaauguugucagccuguggauccaggaauaugauggcucuauuaacauuaaaaggguaauuuguuauguuacuaacauguaaaauguuaguguugacauuuuacauuaaagagauauuucuggguaccuaaauaaacaugaccugcagaggacauaagauauacagggaccaaaguuugcgagggcagguauuucagugagguccacccacagaggcucucccauggacuaugguuuucacagaguuuauuuaaguaguguaucuaccauagucucugaaaccucugcaagggaaguugaagaaucuagucauuagaggauuucuucaggaaaagagauagaagaguagaagagauauauugguaguuuacuacucacucuggauaguuaauugguuaaauaacuaggaagguagcagaaucaaagguuuauuuaguccaucaguaaguuaaucuagauuucagauuuaucuuaaaauuagaguaaauuaaacuauuccuacauguccaugacauuaaaauguccaaagcuacuuaucuuguucuaguuuuaaucugguauuuuuccagauguuuucaguaugauagaauguauagaacaugauuacacagucauucaauuugacauacucaguuggaggaggagcgaauaauaaaccuugguaacagcccuucauucauacuccucuuuuugucuugcauuucuguuaaacacacacacauacuuaggacucauucagauuuuuaaccaccauaucacaacgcuaauuacggucucuuauuuacuagcaauagaagucuaauguuguggcguucucaaggauucaggaauguuauucaaaagcauuuugagcuccauuugccuuugauguuugccuccaguuucugaaauuugcccagaugggggaaggggauagaggggguggucuuacuauuuccugaagcacaaaugccgcagcagagcccuuuuagggacaucuugauucuauuagaauuugcaggucaaagggcagguucaacuggccugguaguuuaaagcaccagggauagagugaauagacuacuguaaugacuuaaaguuggauuucugcugcuaccuacucauuaugcuaauaaugugcauguuggucaugugggcggggggauuacuaauacuuugaaagguuucguguccacauuuuccuuuuuuuuuuuuuuuuuuuuuuaacucuggaaaagaagggaacagaacaaggagaguaauuugacaggaaaagcauugcaguucuuauuuugcccugggcuuguggcauacauauauuaccguucacauuuuaugugcuuguauuacucccuagggacucaugggaaugaagucagaaugugcuacacuagcaagccuccccuuucuguggauagucuuuaguucguaaagcucuuaaagucgaugauuaauuccuuugagguucaauuucuuuaaaauauuuauaucaguauuagaauaggugaucucaaaccauugacucagauuaaaagaaguuauaaaaaagaauuacuucugguaauuuuuauuuucuuuauacuuuucuguaucuuucaguuuuucuucaaugacuguguacuacuuuuaucagaaaauacuuuuuuucaaagaagcaauuauauugaguagacagcuauuaaaauaaaauuuuuucaauuugcuuuuuuuuccacugugaauuccauucccucugaaaagcugaguguuuuuaacaacauuucugaguuuagacacucucaagugugccauguaaaacuuaaucagguaaguccgacuauaccauaugguccuuucuaagagauggauuagaggaacagcaauuuucguauucccuaaaagucuuugcuguuacugucuacuagcuuucacauucuucccuauccuccaaauuuuuuucaagagguuguucucccucauacuauccacuucaaauuuaccagaauuguaaccaagagaacaauacugucuuugucccuuuuggaaaauaaaagaaaaaccuaaaagcuaguauaccuaucaaagauagacauuacucagaauucauaugauuauaugugcaauauauaaucaaaacauuuuauucucuugacuaugaauugcccuucuuaggcaccuauacauguagaaaucagugucaggaguauacguuguaaauggaaagcagaaagacaugaugaucuguuaggggauuuuuagaggaugagagccauggucauaggagagaaaguuugauucuguauaguccauagcauauuaucauugcuuaguaaaaaaaauagcaucaaugaaauaaaaucucuauuugaauugcauaaaaaauacuucaaauuauauaucuuguuaaaaagacacuauuccaauggcucagacuccaaugccacauuccucaaaacuuugaaauuagaaaucuaaguugucaucuguuauuucauauugugauuugcaaaguugacauuuuaccccagaggugaacuguaccacacuagcuguccaagcauaccauuuaugaaagaguuuggaauucagucaagaagcuucaacaauauggaauuauuuuuacuaugucauauuacaauauuuuccuuaagcacaaaauaggccucaagucugaucgccuuuguauuuugcauucagcaaaggugcugguauuucaaucuaauuagguagaguaacuuaucugucauucaccugcugcugcuugccugcuacuaaauaugugauucugacuauuggugcacagaaauguagcacccuuauugggaaagcaugcugccucuuccagcuuggucagucuuugagcuucccgaaagggaacagaugaccgcagucaacaggaaacugcauaguuagaccuucuugaacucuuucaccuuuaagcucauuucaccacuuaacauauuuuuuucaaguggucaguggauauauuuagacugucauuaucccuuuaguguugacuggauccucgugguauaaguugccugccauuucuuagaauuacguaguguggggacagugcgaugagaaucuucucuccucuuccagcagcaaaacuagugaaacaaaucuuuauuuccaugauguaaaccgaguacacaucuucuauuuguuaguauugcuuucagaguugaguagaccuacacauccagaauaaaaaauauccauuagaauauucaguagacagauagucuuccagucuguggcuaaacuaaaacucuuccauaugacugcuguugaagcucaauuaucuuaacaaaagacagaagcaagguuaaacuugggcaaugcauucucagauucagcauuuccucaggucaaaagcucaggccacuuauauaguuccuauaaaucaaauaugucuucuuucauaaaagaugagcuacugagaaaugcauuuuggauuaugaaacuaauuguucaccaacuccauugugauuauuuuguaaauuucuuacaucagcuuccccacuaaauccaccuuuuuuuccuuuggacacaaaccauaaaguaauuauuagcuaaaccacaaggaaucuguaaaguuuaaauuacuguuucaaagugugcagaucauugccaguaaagccacaacugcaaacuuauuugcauucaugagaugaaaagaaugauugauguucauaaugcaccaggaauagauggcuguguuucuauauccacguuauuaaagucugcaguuuguuguacacuguaugcaugaaaaugucuucagugucaguaaugccucagaucaucuggaagcuacagaauaauuaucaaaggaauaaauuaaauggauaaaguauguaaguuacaggauuauucuuaaaguaacuguuuacuuuucaaauucaacuacaacuauaggaacucuuuuuaaaauauaaaaugaaauacuaaguucuuacuaauauaguuuuuuuuaaaagguuaacaauuuuuauuuauucuuuuugagauagggucucacuuugucacccaugcuggagugcaguggcaccaucucagcucacugcaaccccaccucccaggcucaagagauccuccuaccuuagucucccgaguagugaguagcugggaccagaagcgugugccaccgcacccagcuaauuuuuguaugguuuugccauguugcccaggcuggucucaaauuccuggccucaagugauccacccaccucagccucccaaagugcugggauuacaggcgcgagccaccacgccuggccugaauauuuuuuaaacuuuauuuuauuguaguaagaagacaacacgggaucuacccucuuaaucacuuaaguguacaauguaguaucauuaauuguagagagaaugucauacagcagaucucuagaacuuacucaucuuacguaacuuaggcuuuaugcccacugaugggaacuccccauuucccccucucuccucugccuugcaaccaccauucuacucucuguuugcgugaguuugacuguuuuagaucccucauguaaauggaaucgugcaguauuuguccuucugugacuggcuuauuucacuuagccuaauauaggggaacuuauuaagauaacaacaugauaaagacaauuuagagucacauucgccugaaugggauuccuggcuguaccauuuacuccaggugugaacuugggcaagcuguguaaacucugaaagucuugguuuuauuacccucaaaauggggguacugauaauaguaacuucaaagaauuguuggaaggggugaaugaugcuguuggcguuugcuuucuugguuuuauuacccucaaaauggcgguacugauaauaguaacuucaaagaauuguuggaaggggugaaugaugcuguuggcguuugcuuucuugguuuuauuacccucaaaauggggguacugauaauaguaacuucaaagaauuguuggaaggggugaauggcgcuguuggcguuugcuuucuugguuuuauuacccucaaaauggggguacugguaauaguaacuccaaagaauuguuggaaggggugaauggcgcuguuggcauuugcuuucuuuugcaggcaagaagcucuucuggcugccauuagugaaaaagacgccaauauagcucucuuggagcuuucguccucuaagaagaagacccaagaggaaguggcugcccugaagcgggagaaggaucgucugguacagcagcuuaagcagcagguauuauuaaaugccagcaggagggucaguggggccagcuuucacaccauucuccacacaggucuuugccagcuuguacuuuaaggucucauguuucauauuagacaucugaucauuggagcuaguuaguuuccaucauuagagacuuuuuaucuccgcaaaucugugucuaggaaaugcagagcauucgugguaagagggcuguuuuggacaaugucacaggucuucuaugagaauguuuuuuaacuuuguacaauggauuguagaaauuauugaaauuagcccauuugacaugaaaaggcuuuuuuuuuuaaacauccagcaagauuucuaugacagcagccacuaaggauauuuucaugaaaagauuuccaguuauucaggauuggguaagcucugaagauaagaacaaagguuggcccuuuucuuuuccagccuaaaugcucucaaaauuuaauacuuaauauucauguaacaccuuuuguuugugaaaauaaaagcuaaaaguuuccccuuugaugaugguugcacaacaguaugaauguaccuaauacacaaaaccaucaacuuaaaaaucguuaaaaugguaacuuuuauguuagacauauuuuaccacaauaaagaaauggagaaaaacauuucccuuggaagauaaggagagugcuggauguuuacaucggagcccugcuugaacggcagugcuccucguugagugcuccuggcugggcgcagcauccgcgucccagccuccguggcugucuccugcauucccagucacguugucuguacauuuuggcugcccaggugugcucuuugcccucaaguaaugagaccgagaaagagcuuuucaaguaaagaaauuuauuuucuucuauuuuuggaggucagucaucaauugaugguauuuuggcauaauguuuauauuaacaagaaucaauauuuaaacaacaaaguuauuuucucuguggaucaaauuaaaacugcuuagaaauagucuuuauauguauuuauguugcacacuuugcugagaaaauaccaaaagaugucuuuuuucugcaggauggauaguugaccagcaaaaaguaacccauugcuuauucacaagugaaauaaaacuuuuccaggguccuaaaauacuuuuuagcaagaagaggacaucaucuaauauuuugacuaccuguuauguaagauaggaagaaugugcuuauuaugaaagacauccguccaguaguugaaaacugaaauuuggcucaucaaagcugauaauagcaaauuggaggauauuauuggagaaaggaguucacugcugugggaguuuauauauucagcaauaucacuuaucuuaaguaguuaggcuugaauacauaggccuaugauuuaagcaguucuugaucucuucacuuaagacaccaaauagaauugaauaucuagcagaccagaauaccauaccucauuuacagugguuuuugauuaguggccuccaaagaacauauguuuucauuaugugaaaauuaaggaaauuggccgggcacgguggcucacgccuguaaucccagcacuuugggaggccaaggcggguggaucaugaggucaggaaaucgagaccauccuggccaacauggugaaaccccgucuccacuaaaaauacaaaaauuagcuggaugugguggugcaccucuguagucccagauacuugggaggcugaggcaggagaaucacuugaauccaggagguggagcuugcagugagcugagaucacgccacagcacucuagccugacaagaggacgagaguccgucucaaaagaaaaagaagaaaagaaagaaaagaaaaggaaauuaauuaaucucugagcuuauaaccuuagaaggaaguagcuaaacaauucucagugucuuuauaucaaaccacaugccuugaauuuucuguagcgauguguccuguaugaagagaaaaauaauaacaguucucaggaguccuuccuacagucaucuccugccucccuuuuacauuccugcccuuucaaagcguaucuggaugcugugagcaagaaggaaggagucuugccaaaggcauuugauucuuuaauuccuccaagaguguguacuaacuuuuggacaagggagaggccuuuuggaaagaggauauggcaucaauguuguuuuaauuuaaagcuucuaguccaugaauugcuggaaugugccucagucuaaaggcuauuuccuaacagggaagcagucagcauugaccaggcuuuccagcaaauggagcugccacugccugauaggcucuuggcguucacaugugauuccuauugucagaaagaggugaagcaaugagggauauauagauuugggggucaccuucuaauauggucccaauuuacuuacccccucuaaccaccgcccccccacccccuacaggguaacuugucuccuugacucauucauggcaaagcagcacuuggagaggcugcaucagaggaaggggccagggccagugaaaaaaauaaacuaaggcugucuaacaaacuccagauguucuguggugggugccagccaguguguucagaccuuaagucaugaagaagccccacugugauugucaggcccccgcacgagauuuaauguaaacuccgauagaacccuggaaagcauuaauacaaucuguuuagucacagcaguugucacaagauggccuuucucucagcauuguuuucuucuuuucaccuccagaauuuuacaaccuccguauuguguugguugcuggugugaaaucuggcucugccccugugugcucuacacagauguguuauaggcaggcugggcuuuucaggacaggcugggauuuuuuuuuuuuuuuuuuuuuucuguuuuuaagagucaacuauaacaguauaaaaguaaaggcuacaaacuuaaacagauuugguuugaaucuagauaaucucauuuacaacuacaauuuuguaauccugugcauuagaauuaauugucacaccauauauucuuugauuccaguguuuuguaggcgugagggauacaaaagcacagugcucgucuuaagggaacucacaggcuaaugcaucaaacccugguuguucuagucaucuggcagacauucuguguguuaguccgcuuccacacugcuguaaaguacuaccugagacuggguaauguaaagacaagagguuuagcugacucacagauccacauggcuggggaggccucgggaaacuuacaaucauggcggaaggugaaggggaagcaaggcacaucuuacaugguggcaggagagagagcgaucaagcgaggaacugccacacacuuuucaaccaucagaucuugugagaacucacuaucuuaacagcaaaggggaggucugcccccaugauccaaucaccucccaccaggccccuccccugacacauggggauuacaauucgaggugagauuuggguggggacgcagagccaaaucguaucacguucuguagaagguaauccuggccuugccaacuuuuucugcugacagcuuuagcaggucauccaaacauuauguaacuuauuuacccauucacuucagauuuaccucacagaguuggugugaaauucaauaagauagcacaccugaagcgcuuagaguccccccuuccauucccugucacugauagcccuguucguggucagaacugugccauaggugacacacaguacauugagggagggguagucucaguaagcauggcucuuguuccuuuuuuuuuuuuuuuuuuuuuugagguggaguuuugcucuguuccccaggcuggagugcaguggugcgaucucggcucacugcaaccuccaccuccuagguugaagcaauucucugccucagccucccgaguagcugggauuaugggugcccgccaccgcgcccggcuaauuuuuuguauuuuuaguagagacgggguuucaccagcuuggccaggcugaucuugagcuccagaccucgugauccaccuguguuugccucccaaagugcugggauuacaggcgugagccaccgugcccggccuggcucuacuucuugguugucucuagccacuuuauuuaaaugugcagacucacgcaguguucagaauuacacaaccagcacauggcguuccacuccucugaggaagaacguauuucucagggcaguuaggaaaaagagguagagguacuuuuuauccuuucuuuuuuccaccuguucuuuuuaaugauaugacucucauauagaauuuuuaaaaaauaauucuaaauucuaauaugucuuucuuaaaucuuacauuuucgucacugaagaacauuuaaaugcccgucuggcugaaguccucaacauuaggaaaaugucaacucccaagcuacaucccaucucacucgccuucgaguucugugauuuuccacauguuaccucccguucuggguauccccgacuaguauaacuuuucagaauucugugaaaauagagcagugacaauaauggccaccacgugccacuugacugucgugcgcagggcacaggggcuuuacaucaccgggucuuccccacagcucuggagagugucuucauuauuuggggaagcgcuucagacccaaaaaggauaaaacuguggcuaaauuuccaugaagaagacuaagcgguggagcuagaauuagaacugauucucuucucacugucaccaucuuuugugaagauuccagaugguugguaaucagauuguauuagaauuagaauaauacaaacaaugcuauuuuauguuuuuaugauacucauuuguucccugagacacagaaaaggggaucuauuuauacgccagcccuuccccucuccauccguaaagaaccagaaacaaaaaagaaacggugcgauuuguuucccuuuucacuguuccaggcugagcaucaccuuucgguacacgcggucuuucucccgucaucccagcacuacuuccuugagaugagaugacaucaggugaucccguuggucuugagaaugaucccauauucuucagucaagcauuuucauacaguaguuuucuacuguguuauguguauuuuacuugcuuaauccuccaaagaccgcuuuauuucccuaaucacuaaguucuugaugggaagaguauuucaccguugccccaaguacuuucaguaggugugguaugaaaaaauaccugaaucaagugaauaauauuuugaguaacugucuuuuauuaacuuccguccacucucuagugaacaguuuucagucucucuuguggcacugccuaugauaccuuugcucuuguuguuucaucgguaaagcugaguacuuugacauucacugauuagguugggaaaaccagccuaugcuuugaauuggccguuucugcaaucuagcagacauucuagcacacauucacucaucugugaaccugcauuuguacaugcuuucacacuuccccaucccuauuagaaugccaguuaccaugauaacacgauucaaugcucuguccacauaucccacucagaaacaauuuguccuauaauauggacuugcuaucuuucaauucauuuauuuaggguuauuuuacuccuuuguuguuagcgaaaagaaaauguauauagguuaaugccuuucuuauuuugacuuuaaccuuuuuucucacaugauguagagcuggccauuggcccaccuuuaaauggcuguauaucaucuaucuuuuccuccucguggaaaaggcuacugucuauuauagaagcaugguguacuaauuaugaaguugcgguugaaaagacacuuuaucaucacucuagccacuuggaacuuuccaaauaaaucauuauuuggacuaaaauuucccagucuuguuuauaguacaaaggugaauaccuuuuugaagguucaguaaacucucuuuguuaggaacugaggguuaugacaacaauaaaauaucuguuucagcuuucaguuuugguggacauguucuuugaucacagcuuuuaugagagaaaaugcaguuuuauuauuaauucuucucuagccaaacucaaaucauuuuacugguuugaaaugugucgucuuuaccuaucucaaaguuuugaguaaagaauauaaauauauuguuuuguauaugaaaaaugugauuuguucucauuuacuaaaauuugggaagaacuggcuuaacauugaucugaagaauguaggggucagauacuuuuuuaagaaaaggcucaaauuugauuuucaaauucuuagcccagggcccugaccgcuccccguuggagcaauauuuaggaccgccaaguuggagacaguaaauaauugauucuuacaugucagacugauugucggcucucugcaguauacaugaguuguuuuugaacgaagcuaaaaucuugugaagacguacuaauaaucuaauaugaacccaguuagaugaaaaucaccuuuugggacuuauucuguucuaugagaaaaaaauuauacgaaaaauucuccuaacuagccaagaaaauagaccugucuguagucuacuuagugauuuaaagccuuuuccuuagacaugaaauccaugauggaagcuuguugccaauaagaauaauggagaaucaaccuuuaaagccacauacaugauguagaauuucaaguugccauuauucuguauuguaauggucagccagagagacaugugucuagucaguuuuauuaacuacuuucuacagcaguccucccuuccuuuucucuguccuauuuucugaaccaacagaggacuaaauuuucuuacggagucaggaaguuaagacuuaaaauuuaaggaauaugaggguagaguguaccuuguugacuuacauuauugcaucugaaccuucagaugacauccugaaauaaauugcauaguuaggguauuuuauaccuaugauucccauuagggacuucaugguuuugacaaauacacuaucaaagggaagcacaucacaaagaacacuacuugcaggucaaauauugacgaauuuagggaauauauugugugauauuuuggucuaauuuuucacuuucaguuuguugcuguaauacacauagggaauuuuuaaaauauauguauuuuagauuuaugcuguauuuguaaauucccauaaauacauaaaaggaccgugcuaagcugucuuugggguggccacacuaguguauuuuccucucacguuuuaccauaagcagcaagaagaaaccaggcccccaccuucagcacuuuaacuggaaaucuacuuagcuagaucucugaguucauucaguacauucuccacuuucuacacaacuguaggugacauuguugcuaaaguucugguacugcauaucaaggaucccaguaacaaguuccuugcuucccuugaagauccaguggcagccuccuaaaagccccuauuucagugaacagccaauucagggcacuugagguuugcacuagucucuccucagaaucuuuccaggucuuccaguuuccgcccacuacccagcuccaaagccacaccggcguuugaaguuuuuguuacaguguuaccccauucccaguuaugccaaaaucuauuaguuaucuacuacugcauaaaaauuacccuuaacugaguggcuuaaaguaguaauuauugucucacacagugacugagggucaggaauuugcaggcagcuuagcaggugguucugacccgggguccucuguaggguuacuuaggacacgagagccagcuucuccagaagugacccgagagaggaagagagcaaccaaaauggaauuugcagugucuuccauaacugaaucucagaagugacauaccaucacuucugccuuauucuguucacacagaccaacccuuauauaguauaggaggggacagcacagugaugcgaauaccuggagacagagauccuugcaagccauccugaaggcugacuaccacagcaagugcaugaauaaacaaauuugguauguccaugcagugaaaugcugcucagcaguagacagaaaugaacuacaaauacacacaacagguuggaugaaucgcaaagacacaccgagcaaaaauggagacacagaaaaguacauacuguaugauuccaccauacuauacaguguaagaaagcagaucagacaacaaagcagaacuuauucaucguuucuuccccucgucagcucacuugagaggccugcagggggaaagggacaaguuccauucucuuucacuccucugccuucuucaucuucugaugcugcuucucuggccaacauuguuuccuuugggguggagcagcagccaaaagacgcaaaccugacagcuuucuguaauaucacuugacccacagaaagcgcaugcauccucgccgugccaaacggugagaaauaggccgccuccgauacuucuguuuccgucugccaucugucuccuucucagauaagcacaaggcaaaucaacaagucugauggaaugagaugccagucuccuugacguguacucacacucagucuuuaggagugguucucuuugagcccucucugucuuagcuaaggcaaaggggacucuugugaaugaacacguaacucuccauguggcaaguccuuccggcaguagcacuacgcucacaacagucuuagacagauggaugaagggcaccugcugaggcaguggacugcugacaguagugccuuuucagccacuggccacuaagcugccuuuauacaucuugguugcuuagcucuuuuuugucaccugcuuugggccuuggucaccaauucuauaacaacuggaaaagcccauucaucauacuauuaaaacuguuuuacauucuaaaagaagauaacaaugguaggauaaaacagcagagagcuccugaguuguuagugaauaaagggaaaauuaaauagcaaguaucgcagcagcuuaagugcugcggaaacuguggaaaguaaaauguuguaaacaucuguucaucucacuuaguuuaaauccucgauaaugaggccagccucagagagcauuuauguacccauuuguuuuauauaugaaucugucaucuauaaugccaggugccuguuuuaugacugagaagacauuccucaaaacacaucuguguuaggcacugccagggccccuucaccuugcccuugacggugccuacuucauaucugcugugcacaucagcaucagccucccagcuguccugcaugauguuaucuccuugauggugacuguuguuuuauccuagaaaaugaaaacuuugguuagaauauucagaauuugacagaagaaugcaauuccgagaaaaacagaagauuacaguucagucuauaauaauucaacggcccuuauuuuuuuauuuacugauuuauuuuuaauaaagacagagacucacucuggugcccaggcuggagugcggugugcagucauagcuccuggccucaagccauccucccaccuugaccucccaaagugcugagauuacacacgugagccaccacagccguccucaauggccucuauugacuaguuaagauaaaaauguuaaucuuuuaaaaauuauuuuaccuccuuucaacccuaaauuuguguauauuaaguacucaaauauauauacuucuuccucugaaccauuacaaacacuaagaucaacuagauuguuccuacugaugguauccagauuguuuugaaagaaacuagaugcaaacccuuuuucauucacuguccucacuucuggaauugccuugcacuuccucagcucaaucuccacuuuaaacuucucuucaagacucaucaugauaggucggaauuuccuagccugaagucacuauuuuuccuuaucguuagcaaagccauucugugcuuuuuuucauucacguauucauuuucccuuggcuuaaguugaacaaaugagaagaaaggagggagggagggagcagagagaaagagaaagaaacuuuucacuuggacuagaguuguuaauuguauuuauucuuuauguuaagccagguuauucuuguuggugugauuauuuguucaaaucuaagaauucccguucuauaaccauuccugucuuguuuuccuguuuguauguauagcgugguacaauagaaauaguaacugagugucaggagaccugagcucuagauccaacucuguugauaaauaaguauauaaucuugaacguaauaacaccaucaacgaauaucaaacacuucacauuuuacaaaguacuauucagauacuuaauagcgccuaacccuagggcuguaugggcgaagcagaucucauaaauaaaaggagugagugguuuaaagccacagcagaaaaagaacugugagaaaguaggggccacaugguguugucuacagaggcaggcacuucuaacuccagcucucgugaccaugucagaugcgagcccuguguuauucaggcauccauguuucccuggagaauucagauuuuuauacaaaucucuuuaugucuaaguguuggcagcuaauguguuuuuuauuuuuauauaaaucaguccacaaggcugauuuaauuguguuuguuuuaacacaaauaaggccacaggcugccugacuugccucuucgggcuuuaucuuccucaccuauaauauuggguggauagaucaaaugauuuuaaagucuaaaauucauuauuuucuguauuuugauaaaucaacauauuuaccuguagcuguaucgucugcuaaaggcugacauuaagaguuuaaaaagaagcaaaucaaaaagcauaagaaaacguguguaaagauuguuuaacucugucuauagaaauuugcuuuuuuuaugaaaguauuauuuuauuaaaaaauauugcauuaugaagaugaaaaaaucuugguuuuuuugaauccuucaaagaaauagaucauauuuugaugaauucugcuugauuggaguuacuaauaaguagaaaguccagaggcugggaauguggggaaaccuggacucaucccaggcuccuuucauccaucuguugcauuuuuuugucgucauuuccagauguaggaaaaucccucacaacaauuugauaagacucuucccuucauuuccagcaucaaaucuaacuugccuuuccuaucgucaaacugcugccuuuuaugaugccacagggaauuaauuuauaaaucuucuguguuuccugaucccucuugaauugucucaacgcagauaaaucaaccuagguuuccugcccauacgcuggugcccuccucucccuguuucuucuguguccaucagguggugugauuuauagcugccuuuccuaugcucauugaccuuggucugaggaucucauuaagcauauguaaaacuagaaagauuaguuugagggucguucccuccuccguuaaacuucucuuggugggaaccagucagaccaauauauuccaaaaaucuguuccugcugccucuuuuggucucuuuugaacuaauguagauacucauuaaaagcaaaugugaauuagacaagugugguggcaugcgccuguaaucucagcuacucaggaggcugaggcaggagaaucacuugaaccugggaggcggagguugcagugaggcaagaucacaccacugcacuccagccugggugacaaaacaagacucugucacacacacacaaaaaaagcgaauguggaauuaaaugauauuugcauucaaggauaauaggagugguguuaaacuagaauauuagcugucacugagugccguuuucagaagcuguaauuuacaugaccaaauguauuaucacaugacuuucuggaaaacaguauucacgccauuagucaucucaagaaaauacuguuuaacguuuaggcagcugagcccuauuuugaguucuuuaugugaauuaauucauuuaaucaucacuacagcccucagaaguggaguuauccucauuuuacagagagggaaagagguuaaguaacuugcccuaagucccguagcucauaaguggcugagccagggcaggauucagagccgaucauaucacuccagagcugacacuccugaucacuacaccaaaauguguuaccaucauuacagcaugugcuuuuggugagagauuucaauagccuucagccauauuauuaauaaccccaucauacucuguuguaauaaauaguacuuuaaucuacccuuauaaauuacagugaaaauauauacauuacuguaaaggacugcccccaauuuuaaaaaauuaauucagaauccugacaggucaaacugcuuucuaaaucuuguauuaaaaagaugucuucuaauuuuaacaauuaccuuauaaauaguugacuggauuaaugaacagcuguacagcagaggagaggguaaaaugauaagcugauuuuuaagcagcuaaguucgaaaaucugugugcucauaacccuaaauuaccauuggaaauaauuuuguuauuaaaauacuauuacugucauguauacauagacaagauguaugcaaaucugguuccaaaguauugcacagcauuuauuaagauaguguuuagccaccagcauuuuuuuuaauuuuaagaaucaauuaauuugcauacuuaacagcucauagagaugagugauuggaaagcugcugaaaaguucauagaaaauagugacuguugaagaaagaacaucuaucauaccugaaguucaguauuuucccccuauauuucaaaaguuuuaugaaauauaagaauuuaaauaaauaaauuguugagcuuuaauacuaaaacaguauuugugguaguugguuuucaggguagagaugcuuaaaguuuaugguauugccagccuuguuccugaauggagcauuuagaauuggauaugauguuuuucuuggucucccagaaaauuacaaccuacuaaugguuaaaucuaaaauuauggguucucagaaaauaauuuggaacauguacagucugggccuaccuaacuuuuaacaagcugauucauuagaaauauacaaagagauugaauggauauuacuguguuuaaaucuacauaugcacuuuacgaguacacccaaagugcacaccuggaaacaaacaccaaacugucuccugagacccagguuauaaaacacgcuuagagaagccugguugguucucagucauuggccugaagccagugaaaggacacaguugcaucauauuccccuagucuacaguguuuaacauuucuuaauuucaauuucugcuaaaugaaagauucuuauaaaucaaguuuucuuuuccuaacaaguuuccucgcaauuaccuuccuaucuuuuuuuuuucuuuuuuugagacggagucucgcucugucgcccaggcuggagugcaguggugugaucacggcucacugcaagcuccgccucccggguucacgccauucuccugccucagccucccgaguagcugggacuacaggcgcccgccaccacgcccugcuaauuuucuuguauuuuuaguagagacggggguuucaccguguuagccaggauggucucgaucuccugaccucgugauaacgcccgccucagccucccaaagugcugggauuccaggcgugagccaccgcgcccggccccuaucuaucuuauuauugagaaacaauagccaggaagaacagaaggaaaccuguuuuuaaggcugguucuaguugagcuaauugcuaucuagagcucucuuuguauuuagacaucaagacaacagucacagcaauguucccuaagcccgcauuguccuccugaaugguagaugaaauuaccagcaccugacuugcagcucuucuuauggcugugcacugaaguaacuauuucucuuaauacauauuuuaacaaucucagaugagacuaagugggucucuuacuuuugugucgucuaguaaggagccauaacugaaauauccuccuuuuuauuaccauaaugauauaacuauaggaaaagaaaaaacaugagccaugauugacagaaauuacucuccuugucagagaucauuuccucuguugcuuaaagcuucuugcaaugcagcccuuuuuuuuuuuuuuuuuuuuuuuuuugagacagagucuugcucuuucgaccaagcuggagugcaguggcacgagcuuagcucacugcaaccuccgcuuccuggguucaagcgauucuccugccucagccucccgaguagcugggacuauaggugccugccaccaugcccagcuauuuuuguauuuuuaguagagacaggguuucaccauauuggccaggcuggucucgaacuccugacauugugaucugcccaccucagccucccaaaguguugggauuacaggcgcaaaccacugugcccggucacaaaaaaaauuuuaauugaaaugcaugcagccaggcaugguggcuuauaccuguaaucccagcacuuugggacgccaaggcaggcagaucacuugaggucaagaguuugagaccagccuggccaacauggugaaaccccgucucuacuaaaaauacaaaaauuagccagccaugguggugcacaccuguaaucccagcuacuccagaggcugaggugggaggaucgcuuggauccaggaggcagagguugcagugagccaagauugcaccacugcacuccauccagccugggcaacagagcaagacuucgucucaaaaaaaaaaaaaacauuaaaaaguacacaugucuaaguauacaugucagugaaauuuuacacacuuauguaaccagcaucuacauccaggaagcagaugauugccgacaccccagcaaccaguucucacacuccguuuucagguaccauccccugccuauuccugcaggaguaacugcucuacugaauucugacaguauugauuaauuguaucuuaaaaaaucaaaacuuaaagauuuucugucaacagagcaaccagggacccagaggcagaagccaggggagccaccacaggcagagggcacagccuugagucagaggauuguucucagaccuugaaaccuaauggaauuuucucugcuggauuucagacuugcuuggggcugaugagcccuuuuuuucuuccaguuuuucccuuuuggaaugagaaugucuaucauauacuggucccaccguuguauuuuggaaccugauaacuuguuuucuguuucgcauauugacagauggagaagauggaucauacuuagucucccucauacccaacucagauuaauuagaugaggagauuugggacuuucaagugaugcuguuuagauggaauuuuggauuuagaguugugccauaguggguuaagauuuuuggggauacuggaauggggugaaccuauguuguguaugggacagauaagaauuuggugggacuagaaggcaggcuguaguagauggaaugccccccaaaacauaugcccuccccaaacuuauagcccccaaaaaacauuauguccacguccaguuucuauaaccuguaaaugaaaccauauuuggauaaagggucuuugcagaugggauuaaauuaaggauuucaagaagagaucauucuugauuauccagguggggcccuaacccuaaugacaaguccuugugagagacagagagaagacagauacagaagauaaggugauauaaaggcagaggcagagauuagacuggguggcuaugaaccaagaaauguccacagucacugaagccaaaagaggcaaggaaggaugcucccuuagcaucuccacagggaacauggcccugccaacaccauacuuuuggacuuggggccgcuagaacugugagagaguaaauuuauguuguguuuauguuguuugugaucauuucuuacggcagcuccaggaaacuaacacauggaguagguaacacagcuucucgaguccuucauguaugacaagcuuguugccccugaagguauuaggguuccccuuuauuugaaggagaaaggugaauacauuaucucugcuuaaucacuagcauuuguugauauaugcaaagaagacauucuuaagacagccucggggcagaagaggucaaauaauauuuuuggagaaaggagaauacuaagagacuaauaagaguuagccucggccgggcgugguggcucacgcuuguaaucccagcacuuugggaggccgaggcgggcggaucaggaggucagaagaucgagaccacggugaaacccugucucuguuaaaaauacaaaaaauuagccaggcgugguggugggcaccuguagucccagcuacucggagaggcugaggcaggagaauggugugaacccgggaggcggagcuugcagugaacugagauugcgccaccgcacuccagccugggugacagagacucugucucaaaaaaaaaaaaaaaaaaaaaaauuagccucaugaaugagcuagaaaaggagcucuuaggcagagggaucauuguggccaggguugcugaagcaugaagcauccugagaucagggagccauagaaggcuucuuauuaccaagucugcacuacuccugggcagugacgugagacuccagagccaggaggagacaggucacggagagcccuggauugacaaugcugagaguagcuuggacuugcuccuguaggggaugccaagccauggagaggcuuuuagucucaccgauguuuucagaguuuucuuuuauagauaaaucaaucacucuggcagcuaauggaggaaguuaaggggagccuggaguaagaagaugguaagauuaaaaacagggagacuguuuaagaaucuauuccaguugcccaaauaugaaaugaugaggacaagaauauaggguaguugagauggaguaauguauucacuaggccauucuguguaucaaacaccaccuaaucuuagugccuuaacacaguaaacgcuuauuucuugguuacacaaaguccaccgcagaucuugccggcucuaugaggaagcugcccuccaugcagcaauucaguaauccaauucuacuaaaaauuuccuccuuuagcucuuucaguaugaggccuucuuggucacuguggcaaaggaacaaguaauuggugguucccgugcuguuucuucuaugcuugggucccacggucacuacccacagaccacuggccagucagaugucuggucuggccaaguaaguggaaguggucucccuaauuaaaaugaguaaucaagaagaaaggccauauauggaagagaauauaacaugcuuauuuuuaguagaguugaauucgagguuauuuauacccaaauagauacaucaagaaagccguuggcuggagaugcuccagguaaagaugagagcuagaaaugauaauuuuggagucaucagaacagaaauacuacuuaaacccaugaaaauggaauagcuugcuuaagagagaauauaggcaaguuauacuuacuuuuuacuguuuucugacacauacuaaaauauuaacacaggccauucuuuucauccuuacagauuauaguucaaugagcauaugcccucuguaagccuguugguaauggauuucagaauuggcucuacuggauaugcauugcuaggaguuuuuaugcaguucuaggguuuuuaagaccuuuuuuucaugucuuacauguguugaaaaugcuuuaagcauuuauggcacaauauaucacaggugauugugaucuuauauaccccauagccauuuugcugauuugauauauaaauuaauaaagcucuguuccuggaaaugaggauaaugcuacaugaauacuccaaagaguuaacauaaauguagucuugaaaagcacucccucaagaaaagaauucuguccaaauccuauuaauucccggguauuuugccuauuuuccuuaaaagcaccuuacauuaaaaaaucuguuuugcauucagucucuaagcaaaaauauguagugccuuuaaagaaacaacaacaaaaaaacccuugaguagguuaaucucuccauuuuaaguuacacacuuauuucaugaacuaaucaaacuugucguuaaggcuucauuaauuuccucuccacucauggggugggaugguugaaucauagcggggcugugugugucuggaagugaccuuuguauauuugggugguaaauuauacuucaaaauaccaguagacauuuuauuaaaauuuuuauuuucuuugguagauuauuuccuucuaauuauaguaguaaacacugguauguuaugauuagugauuagcuuauaacaaacaucuaaacagggauaagucagccuguuuagcgauaaaccugucucuugauauauuuagaacugaucacuagccaguauggcuccauauauuucuaggacaguguaacccacagugacauaaauuaaaauuuuaaaaaaaucaaggauacaguaaauaccaacugucuauuaauauugauuaauaaaucaauacauuuaaaaaauaauaaaguuuaauuuuucaaauugauaaaaguaaaaauuacuaaauugauacauuacugaguuaauaaaauuaacauuuacuacuauuaaucuaaaugggaaggugaaacaugggacaaagaaugaauuuuucugaaccuaaaaacuggaaggaaagucaaaaguacuuaccagagcaugcuuaggaugcccaaagguacugucaguucaucucccggaggugggguuaguuuagucaccaccaaaauaaaacuguggucaaaccaugaauuuuggaguauuaaaugaacccaguuguggauucacuauggucaaauuacuacaagaacugggacuggaauagguugcccugcccuagaaguuuccuaguugauugaguugaggucugauuaaguugaggucacuuccagacacacacagucgcacucugauucaaccaucccacuccaggaauggagaggaaauuaaugaagccuuacugacaaguuugaugagggagggagcagcuauguuggcaugucuucuaagagcuguuucugacuucuggugcccagcaguaguccagcuaugguagcugaucaguugcugccuaauuaccuaauccuauuggcaagaugaauguuucaguucgcugcugugccuuuaaucauaauugucuuuuauucauucaguuugaggucuuccugguucuugggauguugagugauucucaguugaaaccuggacauguuggauguuaugcgauaugacucugggucuuacuuagacuucuguuuuagcugguuuucuuugacaccacuccagcaggggaagaauggggugcugccucaguauugcccaguggagguagaaguccaguuucucccacuuggacccugcugacacucaagggguggaggcuucuuguuacuccuagguggagauggguauucauguccccacuaggcuucacugguguaucccugccugguuaggguaggaaggccuccacuaacacagugggggugaaggaaggggggccugguuacugcugugcgguagugaagguccgacuccaccaggagacacggcuguuacugcuccauggagguggaauucuagaauccucaccuagucucuagugacacuguggaggggagacuucauugcugaugguuggagauuauagcccugccucccucggcuuucccugacaccuuccaguggagcaaggagaggcugaagcaccuccucacaaccuggugagcauggggcccgccgcuuggucuuuacugacaugagugacagugggaccacauggucuuuggaauagagugauuguugucccacagguuucuauguugcuaggcugucccuuuccuuuggaggcuucuuuggcuagagagagugggcuccuguugaagcuuuuuuggucugugccuguuggcauuuccugguuguuggcuucuucagcucuaccucuggauauauaaggcagaaagauccagggagcugcaggucacagcacuccugacuggucugccuucucucugccuuuuuaguguuugucuguguguauaguucuuguuguacuuuuauacuuagugugcuggagaaaaaaaaauauuccugauacuucuuaaagacaguaaggcagacuauucaggggaccacugagaugaggauuuguguuagagggcagagauugggcucaacucagaauacacaaggaccaauggagauguguagcgaaggagcagggugggggucagugauggaaaauuacuaagaagaaacgucauggcugggggauucuugccagaccuacucaacaggaguugcugaagacaagccagagagaugacauauugauagugggagaugaggaauuugaucagaucucaugagugaucaggccucaaggguggggauuuauuuuugaaggaagacuuaagcaaacuaccuuuucucuuuaggaaaauaaaauguauguucugggcuuagauaucuaaguaaucaguagguugaauuuuaaugcuuacaugcagauaaccgauuuuuuuaaguuauaauuuucauuacuaccucaucccuuagcccaagucacauauuuaccuguuuuggaaaaccauaccucuggcagcaguugagcuuugaugucuaguaucauuacuuuauucagcuuccaauucauuuuaagugguccuuaauggguauucauuucuuaucagaaucaaucuauaccugauacuuguauauuucuggaaaucaaaguuuuucaaauauuuggauuuauaaaauuauaaguggaaauauuucaacaacuaugaagagauagauaauuuaagauacuuuucuauaauuaacaacuuuuuuuagaaaagccugauuuuaauaaauggugguuuucuguuuuuuucuucuacagaaaagacugaaagccauuuagcucaguuguacaaaaaagaaacuuuagagaauagagaaaaucaagagugcaauaguagcugugggaaaauuuuaacaauguaaccacguauguuuguacagauacauauauacagagaaauccuuuuauaaugaauagucagaguauaggagaaaaaaaugguauuggagaguuuggccuuauaucauuugcuuucaaucugaaugguucaguaagaaucuaaaaaugccuuuauauccucuggguuuauuuaaagauacuucacuguauguacacacagguguauaguugguuuauguuuugacucaguuauauucuuuucuuaccauguauggaccaugauuuuguaaaaagaaaagauaaaauucccucagaacaucuagcuuuaagaacuuuggcugggugugguggcuuacgccuguaaucccaacacuuugggaaacugaaaggcaagaggaucacuugagcccaggaguuagugacgagccugagcaacguggggaaaccucaucucuacacaacaaaaauuuuaaaaauuagcugggcgugguggugcacaucuguagucccaggccuuaggaagcugagaugggaagaucgcuugagcccagguggucaaggcugcagugagcuaugauugugcuacugcacuccagccugggcgacagaggagacccugucucaauuuaaauaucaaaaagaacuuuuauucuugugaucuaaaguucuuuuuuuuuuuuccuuuagagagaacacacguguguguguguguguguguguguguguguguguguguguguaaagugcuuggauucuugaagaucacuuucucugcuugcuuagcuguucuucaagcaggagaaaauaugcuguauuuaugugauuauaaaaagcauugccaggcaugguggcucaugccuguaaucccagcacuuugggaggccggggcgggcagaucacgaggucaggagauugagaccacggugaaaccccgucucuacuaaaacgacaaaaaaauuagccaagugugguggcgggcgccuguagucccagcuacuccggaggcugaggcaggagaauggcgugaacccgggaggcggagguugcagugagcugagauuucgccacugcacuccagccugggugacagagugagacuccgucucaaaaaaaaaaaaaaaaaacaaaaaaaaaaccacaaagcauuaagcaauuuaauuucuguauauuuaguaaggaagugaucauacuuuaaaaaaaaacuuuuuaggccgggcacaguggcucacaccuguaaucccagcacuuugggaggccaaggcgggcagaucacgaggucaggagaucgagaccauccuggcuaacacggugaaaccccaucucuacuaaaaauacaaaaaauuagccaggcgugguggcgggcuccuguagucccagcuacuggggaggcugaggcaggagaauggugugaaccugggaggcggagcuugcagugagccgagauugcgccacugcacucuagccugggugacagagcaagacuccucuaaaaacaaaaaaagaaaaaagaaauuuaguauuacuucuuguuuucguggccucuguaucuguaaaauacaacuguacacucagugauaugguuuggcuuuguguccccaaccaaaucucauguugauuguuauucacaguguugaagaaggggccugaugagaggugauuggaugggggcagcauuccucccuguuguucucaugauagugagugaguucucuugagaucugaugguuuaaaagugugcgauacuuccccccucaccugugcucucacucucuccugccaccauguagaaaaggugcuugcuucccuuucaccuuccgccaugauuguaaguuuccugaggccuuccagucauguuuccugugaagccugagggacugagucaauugaaccaauuuucuucauaaauuuacccagucucggguaguucuuuacagcagugugagagcagacuaauacacucagccacucagauaaccuaaauuacagacaaacugugguaaauguucuuggauccuggccauuguucacugauuuuuagaauaacagaaugcacuugccugcauuuucuucuuuucuuuagauaugguguugagucucacugaauccagcuaauaauucccuuuaaacauucuguucuuugagaacagauacagcugggagaaaugauccuaugacauuaaaacuagaauuggauugcauuagguuuauugcaaggaugugagaucuguacuccaaaguggggcagugaccaggagcaaaggcucaaccacucuuuguuuuugaacaguuucauuuuagguacugcacugggccauuauaggcaaauuggcccaaaagguauuucacuccuggaacuuaaguucaugaccaacuuuuaggaauggcuuuuuagaucugacuguuacuuuuucaccagaauguaccauaauuauauaccauggccuugccagaaaacaggaaaucuuucaaaaauuaggaguggaauagaaauuuuguaguuuuuuuuuuuuuuucaguuuuaaaauguugaauguguuuuuauccuuguguuaauauauguuugaagagagaaaauauaggcugcucuucuccagaguucgaaguuaaagucugcacagcauaugggaaagugcuaaauauacaugguaauuggaauuaaccauuaagaugaacauacucauucuggcagcuaagaagggauaucuucagcucagggaaaacuauaagcuauguuuguaaguccacccagcuggguuaugugucuggguuauagaagccaggaaucccaugcaagcguuucuaaggauuacaaaaacggucaugaugagauggaagagaacaguuucuuaagaacgagcagauagaccaaaaaaaauuuuuuuuauuugcuuucuaccaagagggggaaaaaaguaguuuucaugggaaauauguugaaagaacagaugucuugugagcuuaauuccauaaauggugaugugcccaagaauacccugagauaagaagaaaaacuacauggagucuuaaaaaaaaaaaucacugaguccuaaaguaaauaagugaauauccauaaucaacaauuuuccuuuucauauuaaaucuauuugcguggaaggaaaugaaggagaaaacuuuauaaauauguguaaacuggagucccuggauucuagaguucuuuugugaaacuaguguaaggaacagaaauugucuuuuuaucugagaaaaaacugugcuaguugagaugucuauuuucuuugcuuuugacugagauaacucacugugguaacacuggguuuuaaauucugauugguaacuauauaucuauuuuuguuuaauacaaagaggaaaaugaauuauuuaauaaaggaauuuuuauagaaaaagcauucaaaauguuagacucauugccaaaaaauauaugucguccuuaaucguaggaaaggugggagcuacaaaccuaucauuuuuuugcaccaaucauggaaaauugauucuugaauucaacaaacauauaaaggauuuuaucuaagcuggcaauuuuacuagguacugaguugauagaaagaugaaugagacucugucgcagcccucauaaacucaaaucuauuggaagaaaagauauguaaacagaugauuagaaucuguuucagauagcgcggaaagccuuuuguuccaaaccucaagaagcugcauaagcuuuuaccaccucuaaaaauuugucaugugugguugagcucaugugagagaauggugucagaaucaaagagggggcugaaagauaaagaugaggugugugagccuaugcagcagcugcccaggggcuagcagacguaguuaugacuagaaggacuuggguuuacaaaaugccuauacagagaauggaggugaggcauugagcucacaagagguggggaguuggaaccgaaccucugcugaagauggguccauuagaggcucgcugugcagaaaagcaagacucguucagucaaacgccuaccagugacagaugacaaagaagcuuuucucugcccugacucugggaaggagcccagagucagcucuaagaaaccaaaguuaucaagccuguaccuuccccagguuuagacuaaaaauuuaugucacuacuugucugggaaguuccuaccugaagaucacaaagaaagaaauguacaugguccuuacccauucauaguaagauaauggcaagcugaggugcuuugugaccaaaaucgagaauuuaacaacacacucaauuaagcaggcugugcacauugggaacucugauacucuccuggugggaaugcaaaauguagaccucuuauagaggcaguuuggcaauauguaguaacauugcuuaucugugcguugacuuugugacccagaagcuuuacuucuagaaauuggucccacagacacaucuucaaaaauacaaaauaacauauacacaaggaaauucauugcuauaauauuuauaauagcaacagauucaaaauaacccaguugugccacagugggauauuuguugucaauuauaguauauccaucagaguggaauacugugcagcuguagaaagggaugagaaagaucucuauugauauggagcgauucccagaacauacuguuaaaugaaaaagcaagaugcagaauaauguauuuaacauauuacuuuuuauguaagaaaagggggaacaugugcaauuauaugaguauaugauugcuaauaauugcaagaagaaacaauugaaagacaaaucaaaaauuuacccaaaaaaguuaccucuaaaaaggagggaacaggauagaggagacagggguggaagcaagccuucugugauuauaccuaguuauauaguuuugacucuagaaucaaaugaauguauuacauaaucaaaaauaaaauuagaucugaaaaaaggaaaaaagcaguccuugaaauuuaaaaacaaacagaaacaaaugaaucuaauuauauauuaaauuguugacauucacauugagcaaauaauuauuucagcuaacuuuauaauacagauuuuucucuguacaucucaguaggauaaacuccaaguaaaagaacaaaaaugcgaaguuuuuuuuaguggucucacucucucccaggcuggagcgcaggggcacagucaccacucacugcagccucaaccucccaggcucaaucgauccucccaccucagccucccaaguagcugggacugcgggcacaugccaccgugucuggcuaguuuuuguauuuuuuguagagaugggguuucaccauguugcccaggcuggucucaaacuccugggcucaagugauccucccuccucagccucccaaagugcuggaauuguagacgugagccaccgugcccagcccaaauagauuuuagaguucauccugaaggcauauugauaguaauuguauugguuuugaauuuuaaaagcauuauauuguuagagaaaacaaauaacaaguaauuauguuauuguuaggaaccaaaauuuuucagcauaagagaaaaaaauauaaaguauaaaaucaaaguaguuuaguaaacccagucuucaagacugagaucuguaaucuuaaaucugaauuuaaaacauuacuguuaaccaauaauuuucucccuuuuaaaaaaauauuuauuuccuaucucugacugaaccagacuagaagaaaugauaaauaauaaacaccccacagccggauugugguuucccacuuagucuguguaugguaugcugcuauaacaaagucgguagguagguagauuauaaagaacagaaauuuauuuuuucacaguucuggaacugggaagucuaagaucaaggcaccagcagguuugguugucugguaagggccgcuuuugacuuuuaagaugguaccuuguugcuguauccuccagagggcagggacgcuuuguccuugcacacaucuauucauuuacucauuuguuuauguaaugaguucccuaguaaacuucagugcugacaaaugaguuuauuuucuuuucuccuacuuuuuuuuuuuuuuuuuuuuuuuuuuuuuuguugaaacaaggucucacucugucaaccaggcuggagagcaauggugcgaucaugacccaaggcagccuugaccuucugggcucaagcaauccucccaccucagccuccaaaguaccugggacuacacacaggcaugugacaucaugcccagcaauuuuuuuuuauuuuuuuguagauacagggucugguuauguugcccaggcuggucucaaacuuauaggcucaagcaguccucccaccucagcauuccaaagugcugggauuacacgugugagccaucacgccugcccucucuuaauauuuuuuaagagcaaaagcauuauuuacuuacauggcugcacauuggcuuauuuuauauaccuuuauugagauaugauucacaucccaugcaauuuacccguuuaaaauaugccauuccauauuguuuaguaaaucacagaaauguguaaccaucacuacaauacccuauuuuuuaaaguaucuuuuucuaguauuauuucagugucaucgcuuuuuauauauuaaauacauuuucacaaauugaaagcauuauugauuuugcugcucaaauuguuaaauguagccauugucccuuucccccaggccuggcaaccacugaucuacuuucucuauauauagauuugccuauucuggagauuucauauaagugaaauaauauacuauguugccuuuugcaggacuucuuuaacuuggcaucauguuuucaagguucauugauacuuguagcauguaucaguacuucauuccuuuuuauggcuaauagcucauuauauggauaugccagauuuuauguauccauucauaaguuguuggauauuuggguuguuccucuuuuuugacuauaauaaauaaugaugccgugaacauuugugggugcuuuuuugcauggaaacacguuuucaguuaucuugaguauauaccuaggauuggaauugcuaagucauaugguaauuguauguuugccauuuuaaggaacuaccaaaauguuuugcaaagagaccuuaccacucuacaaucccaccagcaauauaugaccgucccuacacauucucaccaacacuuguuauugacuuuuaauagccacccugguggaugugaugugguaucucauuaugggguuuuguuuguuuuguuuuauauuguauugcuucuccguuguuccuguagaucacuguggcuuugauacgcauuucccuauugguguugcacaucuuuucuugugcuuacugccuauuugugaaucuucuuuguugauugaaaagauucaaaucccuugcucauuuuuaauugggguauuuguauuuuuauuauugaguuguaagaguucuagacacaaguccuuuaucauauauaugauuuauaaauauguucucccauccugucguucucuuuucacuuucuuguugauacuguuuacagcauaaaauuuuauaaauuuugaugugcuccgauuuauuuuuuuuucuuuugccgcuuucgcucuuuggguauauuauccaagaaaucacugccuaacccaggccucaaagauuuacucuuauguuuuguucuaagaguuuuauaguuuuagcucuuccauuuagcucuuuggcccauuuugaguuuauucuuuuauauguucugagacugagacuuaaugaguuugacaucauuuucuuugcaugucuauuucuauuugucccacaccaugggaugaaaagaguauucuuucuccauuagauugucuugguacccuuacuggaaaucaguugaccauaaaaaaaugaugauuuguuucuggacucucaauuuuguuucauugauuucuuuguccaucuuuaugcugauaacacacuguagguaaaccuacuauuuacuguaggaucugaaaucagaaaguaugagucuuccuaacuuuauucuucucauucaauauuguuuuggcuauuuuuguauuuuuuuuuuuuuuuuuuuuuuuuuuuuuuuuuuuuugugacggagucuugcucuaucgcccaggcuggagugcaguggcgugaucugggcucacugcaagcuccaccucccggguucacgccauucuccugccucagccucccgaguagcugggacuacagacgcccaccgcugcgcccggcuaauuuuuuguauuuuuaguagagacgggguuucacguguuagccaggauggucuccaucuccugaccuugugauccgcccgucucagccuuccaaagugcugggauuacaggcgugagccaccgcgcccagcccuauuuuuguauuuuuuaaaacaccaugugaauuuacaguucucucaaaaauugaagaagcaguaauagaaguagcacuaauaguagcaguagucauaguaguagaagaagaaaugcuguagcaaauaaaggggagggaggauaaaggaagcagguagagcaguagaaucguuucugaaggaggacauggauguauggguuuuuucuguucuuuccucugguguauguuuggaaauucuccauauaaaauauaauuauuuuaguuuuaaaaggagaacaggcucugaagcuagacuguuuguauuagagcucuagcccugugacuuauucaucauaugaaugucgcuaaguuauuuaggcucucuguaccucaauaaaauugacaugcaaauuguaccaacuucauauuguugcuaugaggauuaaauuaccuaaagcucucagaauacuuggcacuuaguaaguauucaguaaauguuggcuuggaaauugacuauuuuugaagggagggcgguaaaaaaaaaaaaaaaaaagaguauuuuuaaaaguacacguagauuuaccaaauaaucaauaaaucuaguuauucaauuaaaaacuuaguggcaaguuaacguauaugaaaggagaauuaaugaacuugaagauucugccgaaauuauccaaaaugcagugcagaaggauaaaacaaaauugaaaauaucaaagagagauuaggagacauggaaaacagacugagaagguacauucaucugauaggaguuuugagaaagaccauaggggaaauucagaaggaccaauauugcaaaauaggaaaguauacauuuaaaaaacuggaaauuacagauuuugcaaauuagaaaauaaggaaauugcaaauauuguaaaaaagagaaauugcaaaauauuuagaacagggaaaaacacuuuauaucaaaauuugugagaugcugcuaaagcaguucuuggaggaaaauuuauacucuuaacacauauauaaaauugaaaaugaaaaggcugggcacgguggcucacgccguaaucccagcacuuugggaggccaaggcagguggaucacuugaggucaggaguucaaaaccagccuggccaacaugaugaaaccccgucucuacuaaaaauacaaaaguuagcugggcaugguggcgggcaucuguaaucucagcuacucaggaggcugagaaaggagaaucgcuugaacccggagguuguagugagccgagaucacaccacugcacuccagccugggugacagagagagagacugucucaaaaaaaagaaagagaaagaaaaaaagaaagaacaguaaugagcuaagcauccaaaucaagaaauagaaaaagaauaucuguguaacccccaacacacacacacacacacacacacacacacaaaagaacaaagaaaauaaaaacaaauuaaaugaaauagaaaacaagcuguaagagaagaucagugaaacuaaaagcuagcucuuagagaggauuuaaugacuuaauuagaugugaaauacauagugagacagauuguucaugaagaaaagaccagauauuauaauaauuuuaacagugacuuaaucugaugucccuucagacuucuauuacuaaagaauuaauuagucugcuuuuauucugguuaauagaaccugcaacugaacucucagauuuuuuuuaucaauacuaaaacacaaaucuaauuagaauuuaaacuuuuucuuuuaauagcugcguuuggauaaccuauccugucucuuagcuuauguauucuucuaugaaauguaguuucuguaacaaguuauuuuaacauuuuggacauugacauuuuugucguagaagaaaaaauuaacagaauagacaacuaacuccuuuuuccucugggaggguauguauaccuggagauauacauugauagcaaagaagucuauuucagcaaguuucuuccuucuucccuucuuccuuuuuuuucccccuuccuuccuucagacaacguuauucuuuaugucguugggaccagggguuucaucucccugcacaugcaccuggcacgguucaagaggaaaaacauuuggauauaaaauaucuuucaugucaguaaaacaugaaggaauuacuccuuuugcuuuuuggucuuaucuugagaagagcauacuaugagagccccuuaagagcacagagucauuuauaugaucuguguaacaucuaaugcucugugagcugucagauauuuagugcucaacaucauaacuaugcagggaacagacuucacaccaaguuucuucauacuagaccuaggaacacuaaacuuugaucaucuucgugucuuuuuggaaauggagaaguaaguucuuacaacuguuuuuuucauucucugacguggaucaaauaaggaaucuuuggucuuaucuguccacuuggaucaguuuuuuucaggcaggcauacguacucacuccuaagaaguacuuuaaaugcguucugccuugaaaauggauuuguguguacuuuauuaggauuucuuuuuaaguuuuuaaacuuaugcuagauaucagauauuaaagauugucucauguucuaagaaaauaacuagccaagucuacuuucacccacauuccuguuaaagucaacauggaaagguuucuuaaccaauugaaugacaugauacagauguuucgcucacuuucuguauaugccucuuuccuuucuucuauuuuccuuuuuucugagagcugcuuugcagaagacuuugucaugaaauaccacaugccauaagaaaaauuagccuacaucuuuucaagauugucuuaguccauucagacugcuauaacaaaauaacucagacugaguaauuuauaaacaauagaaauuuauugcucaccauuuuggagaccagaagugcaagaucaaggcagcagcagauucggugucugaugagggcuugcucucggcuucguagauaaugcugcuucacugcaucuucacacugcagaagggcaaacgggcucccucgggccuuuuuccaaguauaauggauacauuuauuuauuuacucauccauuuauuuauucauucauuuauuuacucauccauuuacuuauucauucauuugcaauaauccuuugaacaacuacuguuugcaaaaaaaaaaaaaaguauguuauuugccaccaguuugauaauggagauaacaguucuauaugaaaaaaucgauaguuggucucacaagcaaagugugcugggagagcaaaaacagaagaaaaacauuauuuucauauuuucucuuuugagugagacacuguccucuuuaggaguucaguuuccuaccagugauagaacuagauauuuacaucucccaaaucaaaguacaaacuuuggccauagaaccuuguuccucguuauuuucuuuuuauuuucaacuuuuauuuuagauucgggggaugcauacacagguuuguucccuggguauauugcauaguacccucaggccuuuuuuacagggaugcuaaucucauucaugaggguuccacccucugaccuaaucaucuccaaaaggcccauuucauaauaccaccaaaucaaagguuaaguuucaacaucuaaauguggggagagccgggcgcaguggcucaugccuguaaucccagcacuuugggaggcugaggcaggcugaucacuuggggucaggaguuugagaccagccaggccagcauagcaaaacccugucucuacuaaaaauacaaaaaaaauagccagcgugguggugugugccucuaauccgagcuacuugggagucugaggcaagagaauugcuugagcccaggaggcaaaaguugcagcgagcugagaucucgccacugcauuccagccugggcaagagaacgagacuccggcucaaaaaauauaaauaaauaaauaaauaaauaaauaaauaaauauaaauaaaauaauauaaaauuggggggaacacaaacauucagaccauagcaaaggucucuggggguccucccagaaaagagaaauuugauucacagauaauuuauuaaucgguuuuuuuuuuuucuaucguuauguacuggagggaggaauugacuuuaaaaugugcuuacauuauuaggugaaaauguaaagaaccuaaaucuucaacaguaugggacucacuaaauauccauucaggggaccaggcacaguugcucacgccuguaaucccagcacuuugggaggccaaagcaggcggauuauaugaggucaggaguucgagaccagcaaggccaacauagugaaacccaucucuguuaaaaauacaaaaaauagccgggcgugguggcaggcgccuguaaucccagcuacucgggaggcugaggcaggagaaucacuugaacccaggaggcagagguugcagugagccaggaucacgccauugcacuccagucugggugacagagcaagacuccaucucaaaaaaauuaaauaaauggauaucuauucagccaaaugcuguguagccaguuaaaaguagauuuugggcuggucaccguggcucacgccuguaaucccaacucucugagaagccaagacggggggaucacuuaaggccaggaguuuaagaccagccugggcaacauagugagaccccauuucuaaaguuucuaaaaaaaauacauaaacuuucuaaaaccaacaaauaaauauauauacauauguauauauacacacauauacacguauacauauauguguaauuuuuuaaaacaguauuuuagaauacuauuuaaugacaugaaaaaauggucaugauaaugaugauagcuaaaauguauugggugucaguuuuacgccagacaccuuuuuaagugcucuccuuguguuaauucaacagguuaauccucacagcagucuuauguaggagaaaacuguuguuauccccauuuuaaaggugaggaaacugagacucaacagcauuuacauagcuugccugaagucagcuggugagagacagagcuagaguuuaaacucaggcaauuuggcucuuuuaaaucccuugcucagacauauuacauaucucuguaaauuuuuuuuaugaaacuagacaaacuauuuuuaauucaucuagaaacuaaaauguguuaaaaauaaccugucaaauuuugacagaguagaauugguggacauauucuaccagguaugaaaauaugcuauaagauauaguaauuuuuaaaauauccuaguguagcugaaauagagaaaaaguagaauaaaucagaagagcaugccacuuuuuauguucacagggaggggacuaaauggauacaccuaaauauuaagagugacaaucacugauagaggaauuauagaugauuuuucuuucuuuucucuuuuuuguuuguacuuuauuuuuuaaauuaucuauaaugccaggaguucaagaccacccuagacaacauagugagacccugucucuacaaaagaaaauuuuuuaauuagcugggugugguggugccuaccuauagucccagcuacucaggaggcugaguugggaggaucacuugagcccaggagucugagguugcagugagcagugaugaugccacuguacuguacagccugggugacagaaugagacucucucuaaaauauaacaaagaaaacccaaauuaucuuuagugaguauuuuuaaaucauacaguauuagcaaguuuauuuuuaaugcuuuaaaacuucaaguuuuaacaauauuuuacuaguguaacauauugcuguuugauuuuaugcaucauguacccuggcauuuucuaagcugcuuacucugcagaguuaauuuuucuaaaauguucaauauauuauucauuuauucaaggccuaaauuaaccacucacacagaaucacuaauccagucuuccuuuuugauaaagauggagaaaagacaaugggauuauaguccuuuucuggcuuaggguugaggagaaggauuucagaacuuuuaacuuauuuuuaagacucgaauuguuuauugaugguauaaagaaaagcuauuuauauauauauauaugagagagagagagcacuucugucugaacaccucacugaacucuguaguaaauuguaauaguuguucaauugauuuuuuuauugagacccugucucuacaaagaaaauuuuaaaauuaagcaugguggcgugcaccuguagucccagcugcucgggaaacugaggccagaggauggcuugaggccaggagcuugagacaagccugggcaacauagugagacccugucucuuuauuuuauuuuuuauuuuuuuaaaaagacaguucaugaagugcuugauuuggggauauugccucuuccccaaaaauuucuguaucaauuuaauugccagucuuagcccaagcugccauaauaaaaugccauuaacuggauagcuuaaucaaacagaaauuuauuuucucacaguuuggagaaaucaagguaguguuugauucaguuccuagugaagguucuuccuggcuugcagaggcugccuaauuacuggauccucauaugacagagauauaaagagaaaucccucuauuuuucucuucuucuucuuacgaagcccaguccuaucagauuaaggccccacccuuaugacuucauuuaaccuuaauuaccuccugaagacccugucucuggguaugguaacguugggguuuagggguucuacauaugaauuugggggaggcacaauucagcccguaguauuggcuaaacucuuuccaguauccucagaaaucccauauuuaguuuauuuuauugcagacaggauuaguuuuauccuuucuuauggaacucuuaaaauacucguuacuuuacagugugucauagaaacuuuacuuaaauuuaaccuuaugaauaauuucuuccuagacgcaaaaucgaaugaagcuaauggccgacaacuacgaggaugaccacuucaaauccucccauuccaaucaaacaaaucacaagcccuccccagaccagguaagauggcucuggaauguuuuauuaaaaaacccacacacuuaaauuuugaaauguuuuuguacuagcauguugcaaauucugagauauaaguuagaagaauaaaaauaaauagcuaauucaguucugaaaacucuacucuuuucaaaaaaaucacagauucaguuucuuuauaggaagaacuggauauuuuaagagcagauacuugaaagauuugaacaauaaagaaugcuugaauuggguugagaaaaaaauuaaccucagagauacacacuaauaauauguaauuuuuaacugucuuuacuaauuuuuaacugucuugguuuucuuuuuaaagaaauagugccuuauuagaaaaacaagacucuuuccuuacaagccuagugaggcacaguuuggagguuauuucuguuuaguugcaaauuaugaacucucugcucauuaccuauuaaaagugaagauugaaacuuaguucuucacucccuguccuuguggaucccuccagcaugucaugcuuaaggaaaauuguugccuucaacuucucaucaaugcaaaagagauauugaugaaucugaagggaaccauauuccauucuaguuucuuggaagaagggaacucuccccaaaucuugaaaaugauggaugggagagaauggugaacagauuaccucauaucccauuaccaaaaaucaaauuuuaacaucucuaucacacccagucuuaaaauauguagcuaagggaaaaaaaaaaccagucagguaaucacauccauaugacuaaagcaucaaggaaaacuuuccugcuaaacgucuccacuaaauaacagcuauggcguuaucuuagcagaagcaggagaaauagugcagaugaaagcagcaaugguauucaaauugcuguugcuuccaagauucggaagguauaguccuauuaugaugacguuuccuaagccaguugaggcaagccuuguauuuuagaaggaaaacaauguaaauauuuaaugugggcaaaauggagagcuaucugccuggugucagcagucuuucccugccaagagaucauuuuaccuuuucugccugcuuccugauaccuggaacugaauuuaugccaggguauauaagaugcauguuugauuccucaugaaaacagguuuuugauaauagaacuggaugccuggaguaggaagagacaaacagagaaagguugaaggaaaagcaaaacauaaagaaaaaccuccaacuugguaauuuugcccagauccagcccugagauagagauagcaucuuggaaaguaggaagaaaagaaguauaaugacaaacuacaguuguuccugaguauccucaggggauugguuucaggacaaacccacccacaaaugccaaaauccaugguugcucaagucccuuauauaaaauggcauaguauuugcauauaagcuacacacauccucccauauacuguguuuuguuuuguuuuguuuuugagauggagucuugcugcguugcccaggcuggagugcaguggcaugaucucagcucacugcaaccuacaccuccuggguucaagugauucuccugccucacccuucugaguagcugggauuacaggcaccugccaccaugccuggcuaauguuuguauuuuaguuagagacaggguuucaccguguuggccaggcuggucucaaacuccugaccucaggugaucugcccgccuuggccucccgaagugcuaggauuacagguaugagccaccauaccuggccccucccauauacuuuaaaucaucucuagauuacuuguaaccuaauacaauguaaauacuguguaaauaguuguuauacuguauuuuuaaaauuuuauuaucaaugcauuguuauuuuuuauugauuuauauauauauauguauguauauguauauauuucauccacgguugguugaauccacagauguggaaccugcagauacagaggaccaacauuaacuacuaauuuugauaguuuagggaauuagaaucuguaugagagagucaagaaauucucuucugcuacauuaugcuuaugucuuuguuuuaaauacuaaccaccucuuuuucauuccaugcugcccuggggcauugcccccuugucaucucucucccuguaggaugaggaggaggguauaugggcauagccaaucagaggcuuaguucagccauuuuguucagaacggugagaaacagcuuuccuuaacuauagaaaugguuuuuguuuguuuucauuuuucuuuuuacacaguaacucucacaucucauuucucuguaauucaugaaaucccuggugugcuuucuguuuuuuuauuuucacgugauucuuguguguguugcugugcugcugacauagugggguuuggauuuuguggcuuuuuuuuuuuuuucucguuguguguuaauagucacuucuguaauuucuuuuuauacauuuuugggagaacuucuaggacguguaacuaaauuucuccaguugugauuuuauuaauuacccuuucuagggugauuuuacaguguccuggcaagguuuauaguaauuuuauaugaaauuggcaauagaaaauugaucaaguacuuugcucauuggccuaaguuugagguauacuuuuuaugaugauuaauuauaaauacaugguguuuaaaaaaaaaacuguacugugaacuaaaaccuccuuuuguuuguuucuguagaagaaugagcucucacagucagcaccucggacacauccccuggggcuuuggcauuacccucaaacuaucccuaaaaauauugaggagcaaaguaaaggaaaacuuuuuuuagaagucauucuaaaaauucuuuucccucccuuuucauggauugcugcaguguucaacaguugccaggacacugucuagauucuccuuuucaggacaauuggcuggaaaguauaguccagccguggcaguaucucccuuugaucugaugcccuugagguuugacuaaggaaauccuuuucuuagaaaaaguaauaauuaugauuaauaaguucacacauauuugguggccuugcacucccuggauucacugcccaugccuaucagugaucucacuccccuggagucaguucucccugaaaugucuuugucuugguguuaaacuucuuaaaaugaugaggacauguguagaucucuuaacguugagcacaaccaagaaggauggagagguaaguuguggaaaggggccaugcgcugugaggugggaagcuguccagauggcuuuauccugagggcaugaaugaaguugaaacgcacugggucaaccagaaagcucuucagguuaggaugcugcaugucagagaaagcuaaagcugagagcagucaaugugcuaauuaucugcacuggacaaggguagguauuugucaucaucaagcaugugagaccgugcaguagcuggauguaguuuacuggucucuuagaaaugagcaugccccuaccuugucuauuuuggcagaacauaggagcuucuuagcuuccuucagcuggaagcaccacauauguggacaugauuauauuuuugucgcaaauccuuuuucuggccaaucagaggaagccuguugguauucuaggaaacaggccuauagguaacuucaccaggagacuagaaaguaagcaaaucaguauauaaacuuguuccugaaaucuucauuuuccuuucucuaccaaaauaggauaacuuagcuuuuuccaauuaucgcacuauugagcauauugcacuaauauauuaacuuucauugguuuaacaccaugcaauugcaauuagccagccauaacuggcguuucuaugauaugguguuuccaauuuuauaaaaugugcuguaaaccucauuauaucauaaggauuuuaccuaaagaaaugcaugagugaccccuaaaacacugcagaaguuuugacuggcuauccacuuuccuucuccuguuuccucacuaauuuuacagaagauagauuuucuuuagaaauucaaacuuuugaaauugacgauuuaccuuaucaaacuuaaaaacguguguuuugcaucugaaacauuuucuaggacaccaauacauacugaucaagugugagccuuacuugauguauccauagaugggaagagaaucacagauguacugagcugaaaaggauucuggaguuaggccauuucaggagaggugguaaaacguaacgcuuaagaguguaggcuuuggagcgggaugccuauguucagauucuaccaccaccauguacuagcuucugauuuggacaagguacgucauugcgcuguacuucaauuucuucaucuuuaggauggagguuguuguggggaguagauaaguugugagacacguggacuccagagccagacugcacagcuuugaaucuagaccucuccaccugcccugugaccuugggaaagucacuuaaacucccugagccccaguuccuuuauccaaaaaauggguuuaugaauaaugccuacuuccuaggauuauuggauagauuaauaaguugauagcuguagaaugcuuugagcaguacuguacaugccuuuguuaugcuguugccguugucaucauuaacuuagauccgucuccaggaaauaguaagcuuucaauaaauguuaguuccuguuguuacuaacaucaucgucuaauccagugcccucauuuuauaggucaggaugcaaaacaaagauugaaaaguugugacuuaagguccccaggcauuucuguggucuggaaggaagaacuaguaucugacaguaaaagagguagugaagacauauugauggugauagcugucuuccaucaccacaaguuucaucuccuauauguugaggaauuuuuuccuuugggaaaacaccuugaauuuuauaaagaaauucccuauuguaugacauuuagucagugaaaucuuugaaagaauuagcugucaagcagcccuccuaagacacacggacugaagcaaggacugccuccacucauaaaaaaaaauaacaguuccuucacucuccucuuggccuauagaaaauccaugugagggccagacucgguggcucaagccuguaaucccagcacuuugggaggccgaggcaggcagauugguugaagccaggaguuugagaccaggcuggccagcaugacaaaaccccaucucuacuaaaaauacaaaaauuagcugggugucauggcaggcaccuguagucccagcuacucaggaggcugaggcacaagaaucacuugaaccuggggggcagagguugcagugaaccaagaucgcaccacugcacugcagccugggugaaagagcaagacagucuccaaaaaaaagaaaagguaaaaaaaaagaaaaagaaauugguucucucucucacaugucauucugcucaggcauucauguuagguguucuaaguucaauaacuaaguagaauuugagcaugauuugauaaguuauguaacuauucaguaaaucacuugaauaaaugucuauauuguaauguguuuaaauugcacuggguccaauagccaugaagucuuauaugacuaucucagucagcucaggcugcuauugaaaauaucauagacuggauggcuuaaaccagcaguccccaaccuuucuggcaccaggaaccgguuucguggaagacaguuuuuccacaacgggggcuuggggaagauggcuucacaaugaaacuguucuuccucacaucaucaggcaucaguuagauucucaucaggagcgugcaaccuagaucccucccaugcccaguucgcaguaggguuugcgcucccgugagaaucuaaugccgccgcugauccaggaggcggagcucaggcuguaaugcucgcuugcccgccacuccucuccugcugugcuggacaguucccaacaggccacggacaggugcugguucagggcccugggguuggagaccccuggcuuaaaaaacaaacauuuauuuuuuacuguucuaggggcugaaagucugaggucaggaucccagcguggucagauguuuggugaggacccucuuccuacuuugcagauggcuggcuucucacugugucuucacagggcugagagagagaggaagcaagcugucucgugguguuucuuuuuauaaaggcacuaauucuaucaugagggcuccacccucaggaccuaauaaucuucccaaagccauccagauaccaucauuuugcagauuaggguuucaacauaugaauuuugaggggacacaaacauucgauugauagcaaugacguugcugacucauagaucucaguggugcacaugugacuuagucuccgcccaacagggaguuccagagcaaagauuuccuauguaaguuaguuuauccaugccacucucuauccguuuacuguaaguuuucuucuuuuuucuuucuccuuucuuccccuccuccccaccuccuuuuacccucccuccuccuccucccuccuuacuguagaauguaggccccaugaggacagggacuuuaauauauuuacuuauguauucccaucauuuaaauaaaugcccaggauauaguagguccucaguaaauauauaugugugugugugucuguguguguguguauuuauuuaacuacugaauucacaaaaauccagaaaaguaaaaguaaaguuuacauugaaaccaggagcauagaaauugguuguuagcuuuauugucagcacugcuauuacuagaaagggaagauaagaaagaugaauggaaacaaaagaauuuuagagaaauguugagaauuuaaaggaaaaucauaaugaaguccuagagucugccuccugaaauuuuacacugaauauaauggaguugaauguaauucugaaaucuuuuucauuuaccaacugaaaauccuucggguagaaacuuuccuuccaguaaccugugguucuuagccaucaagaagaacagcauaugcucuuucuggacuucaccccguggagcaguuugugugaacuggugcuaggucccuucaguaaaggauggaccuaccaaggggcuuaaaaguuggucuugguauaagaacaugccacuuacuacaaucuggaaauggccugccuauuagaucagcacuguagcaucucaaaacaggauuuggaccaguaugcuagacuuuucuuuuucauuagagaugauguaaauauuaacacaaacuuuuaagacaaguguuguaaaacaagcaucuccuucucuuuuggcauuuccuuuuuguccaucuuaguggaguugucaguguacuuaucaguuggaaacauccuaaaauuauucucauugcaacagugcaacaauggaagccuuaaauuucuagagaauacauccauagaagggagguguuaaauuaucuugcagaauuaaauggugcagugaauugcacugcuuucuugguauggagaaaaugguccaaaaaccaauuugggccaauaucaggacugacuuuugauaugacagacaaggaagaauucgauccucuauuuucagaaguggaucagagauuuuagcaagaaacuucuuuccuggaaagcuuagaacaaagccaauggaauuaaagaagcacaaggaucuagcugcugagaaauaggagggagaaaaugaacauuuauuaagcauuuacuauagguccagcacuuucauguaucuuaucucauacagggcucauagacguuaaauaauuuuccaagauuacacagcuaacaagcggcagauauuuaaacccaggacagacuccagacccccugcugucuccauuacaccauacccaaagaggagucuuccauuuuccagucuaguuccuuggacauaguagacaacuccauggaaggguguugaauugaauugaauuccuaacuggggaaauaacaaaauggucuuugcugguaaggaauaucuguagguuacccaagacagacccucacugaaaagaaacuaagugguuucugaguucacugauaaaugugacuaaccaggaaucuagugaggaauuuggaacuauagaagggagaaaaaggaggucuuggagguugaguaaaguuugggaagaugaaacaggaaaagaaaaguuuucagauaggaacuaacuucaaggagguuccaaccuaagaaugagaauaugauguguaggggcuggugaggaaaccagcccaagugaaacagagggugucuguccuuccauugguuccauggcuauccccacccacacuucuguuuuaauauuggacacccauaauucaaagagacaaacuacagaugugaggagcucacaagaacaguuacauauuaagcuuuacagagaauuaaaguaguaaucagcugccuuuggacguugucugaaucacugucuucuaaguugauugucccuuuaucuaguucuguugcuuucagguccuagucagaaggugggcuuuggaaccagauuacuugguuucaaacuccuguguaccucacuuucuucauuuguaaaaucaggauaauaauacaccugccucagagggcuguuugaugauuaaaugaaguaacauaaagcccuuaaaacagaacaaugcuuuuacauaucaguaguugcucaguuaauguuagcuauuagcuggcuuuaaccugaaggcacaagcugaccacuuauagcauuaauacccuuccugcuuuuaucguuccccucccuucuucacuuucucugucuuccucuuggcucucauuuaaugggaguauugaauaagaguuccuuacucuucaacucuggauucaaacuauucuugcacaaccugaacuccaguuuaauaguguuuccucuauaugcucagaaaugucuuuaguuuacuguuugaccucggcacaccaccuguuuucugcuuuucagguuucucuucuucccuccucuccacaaagaaauuuaaaaucuucauuucugcuuuucacuguuuuccagaggguucacucccuuuacaccucauccuucuguccuggauucucacuagcugucucagaacucugccgucugcuauuaaaagccaagcuuucugccagcccuuuuugcauaccauacucagcaggucccuucugugugccucuaucuucucuaagucaccaucucaucucaugagcauguacugaaacacauaaacaguuuugcuacugcugcugcuuuuuuuuuuuuuccuucucccaagcaacuugaaccuaugucaaaucaaaaaagauuuuggaggccgagcgcgguggcucauaccuguaaucccagcacuuugggagacccaggcgggcagaucacccuaaggucaggaguuugagagcagcguggccaacauggcaaaauccugucucuacuaaaaauauaaaaauuagcugggugugguggcgcgugccuguaaucccagcuacucggaaggcugaggcaggagaaucacuuuaacgcaggagacaaagguugcagugagccaagauugugccauuguacuucagccugggcaacagagcaagacuccaucucaaaaaaaaaaaaaaaaaagauuuuggaaaagaguuauuuuugacaaaggcauugggaaauaaagaguaaaugauggaugaugcuaguaguuaccauuuaaagaauaccuacuaagugccaaacacuaaguuguaaguuuauaaucacauuguaagcauguuuucauugaaaccaauauaacaauccuaagagauagauaccauuuucauuauuuuacugcugaggaaacugaaccauggagaaguuagcuaacuuauccaaguucacauaccugguacacaguagaagccagauuugaagccagauaugucuaauuauaucaaaacuugaccuaccucugaaggauacauagcuagaaggauuuuuuaaagacguuauuaugccuuuguguucaugcugauuacaagagagaagagaguaaaugauggaauucaggacaugcuaccccaaaauauggcacguuggcauuggauacaacaacagaagcaggaaggucucucugaccuucuccucacccuucuugccugaagcaagcuauaaagaauuuucugaccugccucuaaaguaagucauaaaaccuucauugcagagguacccaccccauagcugaaggaaaagaauguccuuaucucugaagacagaggaacacaaagaacaacaggccuuguuaauuccucccaguuuauuacuguuauuagauuagacccaauuguccucaaaucaauuucuccaugacugucuccucuucaucauacacagauuuccuucuuuucugaagucuucauuuucuuucuuucuuucuuucuuucucuuucuuucuuucuuucuuucuuucuuucuuucuuucuuucuuucuuucuuucucucucucucucucucucuuucuuuucuuucuuucuuucuuucuuucuuucuuucuuucuuucuuucuuucuuucuuucuuuuuggagacaggaucucucucucugucgcucagacuggaguguaguggcaugaucauagcuuaccguagccucggacucaugggcucaagggauccucuugccucagacaccugaguagcagggacuacacgcguguaccaccaugcccugcuaaauuuuguauuuuuugguagaagcagggucucacuguguugcccaggcuggucucaaacuccuggguucaagcaauccucccaccuacgccucccaaaguucugugauuacaggccugagccacagagaccggcugaggucuucguuucugaaggcucccacauuacauaaaacuuacaguaaauaaauguguauguuuuucucuugcuagucucuguuauaggguucucccccauuaaccuagcaguggaugaaaaaagaaaaucucuucuccccuaagaauauucccauaagaauauccaauuauaaauaagacuaacaauaaacuccuuuuaaaaucugaguagaaaaggaccccaugguagcaauguauguauguuggacuaauuuguaacuauucuccuaaguguugaccuuaaucuuucugguaaugcauuuuaggauuaguauacuacaaauguacuuuuucuccaaaauuauacguccuggauacauuucuuuauguagauaugacauaccuuucuugcuucaaauaucaauaacauguaguguaagaagccuccaagaguguggucuuuuuaaagcuggaacucacauccuuuauucuaucuaguaagccaucucucaggucucauucuugagaagaaaaaaaaaagcugacaaaauuucuacauuuaaauuuauuuuucccuuaauguuucauaucaaaauggaagccauguuuuucaucauuucauucaagacauaaaaccuugugaaaaaccaaaguaauggaggaaaugaggaauugucguuuaguggauauagaguuuuaguuuugcaagaugaaaaaguucuggagaaugguugcacaacagugugaaaguauuuagcacuccuaaacugugcacuucaaaugguuaagauggugaauuuuauguuauguguauuuugcuacaauuuuaaaacuuuccuaauuaaaaaagaaguaauggugauuuucuggcaaaaaaaaaaaaaaaagauacauucaaaacaugcacugaauauuauuuugaaaauuuuucuuagugaaaagaggcaccuuccucuuucccagguaaacauuucaagguuuugaaauggaaaagaacuacccuugaggcuuugguuuagccuuuuguucucugcuugggaaccgggcuuauuuguuuguuuauuuaacugguugcuuuauuagcauaauaaagcaugacacuguucuuccuugauuugaacugcuuagaagucuuuaaaagaaucauuugcauaauuuauuauuuuuaaauguguucacauucagcauuuccuuuaacaaagauacacaccuauaccuuuuacaaagacugaauauuuaggcaacuuaacagcuacaaacuuaacuuuuuaaugaauugaagcacuuuucauucaauagagauacaaauuuggagaccaucuuuuagaaauuggauccagaaaaauacucugaaccagggacugacuuaaauaauuucccaacaucaauuaaaugagauuuuuccuuuaaaaaaaaaguuguuuugcuuugugagguuaaacuuuuuuuuauuuuauuuauuuauuuguuuauuuauuuugagacggagucucgcucugucacccaggcuguagugcaguggcacaaucucggcucgcuacaagcucugccucccgaguucacacuguucuccugccuuagccucccgaguagcugggacuacaggcaccugccaccacgccuggcugauguuuuguauuuuuaguagagauggggcuucaccauguuagccaggauggucuugaucucuugaccucaugauccacccaccucggccccccaaagugcugggauuacaggcaugagccaccaugccuggccgagguuaaacuuuuaagcaaaacccuacaggagaguuaucuggaacucuuuacaaaaugaguguauuucuuugugagaagaacaguguguggagugcaagggugugcauuuauugguuuacuuccccaagcccaguauuuuuguuuguuuguuugguuuugguuugggggggggggggguuaauuauaaagcauucuauuauuguauuuaaaucuuuuccuuuauuauuauuuuuaaauugacaucuaauaauuuuauguuuauaggguacagugauauuuugauaaauguguauaauguauaauacucaaaucaguaauuagcauaucugucaccucagacaucauuucuuuguguugggaacauuuaauauucacucuucuagcuauugaaaaauacauaacaaauuguuguuaauuauagucaccuuauagugcuauggaacauuagaacuuguuccucccaucuaccugugcuuuuacucgcucagcggauucuucucacccacugcacagaaaagccaauacacugagacagcagcauugcaguagagaaaggguuuaauuaucucaaggcagcugaucagaggacgagagauauuucucaaaucuuccuccccaagaacucagaggcuagggucuuccaggauaauuuagcaggcugagggcuaaggaacggguacugcugauugguugggguugcgaucauagaggugucaaaagcuaucuucauacacuaaaucaguuucuaggugggggucacaagaccgguugagucaguuccuugguaugaguaacagguccgaguggagucaguugguugccagaaugcaaaagucugaaaaauaucuuaaagaccaaucuuagguuuuacaacagugauguuaucuauaggaguaauuggggaaguuacaaauuuuguaaccuccagcuacaugacucuugaugaguaagcaauuuuagaaaaguaagcuagggaacgggcugcgcacaguggcucacgccuguaaucccaacacuuugggaggcugaggcagguggaucaugaggucaggagaucgagaccauccuggccaacauggugaaaccccaucucuacuaaaaauacaaaaaaaaaaaaaaauuagcuggguaugguggugcgugccuguagucccagcuacuugggaagcugaggcaggagaauugcuugaaccagggaggcagagguuguaguaagccgagaucaugccauugcacuccagccuggcaaaauaagcuagggaacaauggcugguuaucauuuaacuacaccuacaucuuagcagaauucagucuuuucccauaauccuaaccuuguggccuuucauuugucuuacagagaugguuucagucccccgugggggucagcuugcagagggacuauuaucauuuuugcuucaaaguuaaacuauaagcuaaauuccucccauaguuagcuuggccuaugcccaggaaugagcaggggagugagcuugugacguuagaagcaagauggagucagguuagauuuuucucacuuuuauaauucuugcaaaagcaauuuuauauucauuaacccaccccuggcuuuccccuucccccuacccuuccuggccucuaguaaucacuauucuacucucuguuuguaugagaucaaccuuuuaagcuuccauacaugaaugagaaaguaugguauuuaucucucugugccugacuuuuucacuuaacauauuguccucccagcucaucuguguugcuaaaaugacagaauuucauucuuuuuuuuuuuaaucacuaaauagcauugcauuguauagauauuugccacauuuauccauucgucuguugauggauacuuagguuaguuccauaucuuggcaguuguaaauagugcugcacuaaacaugggaguacagugaucucuuugauuacugauuuccuuuccuuuggauauauaccuagugguaucauagcuggauuguaugauaguucuauuuuaguuugcugaaaacccuccaugcuguuuucuguaauggcuguucuaauuuacauugccacaaacacuguguaagaguucccuuuucuccacauccucuccagcauuuguuauuuuuuguuuuuugggguuuuuaaauaauagcgauuuugauuggugugugaugguaucucaugguuugcauuugcaugcaaaugauuagugaugcucagcauuuuuucauguaccuauuucaaacucagcguaauuuugguugggaggccguuaggcuaaggcagcuccaaugcccugaguuccuacauaaacaaacugaaacccaacucuuuguaaacagucauauucuaggccaaucagaaaccaccaacuaacccccuaccuaggggcuuuccaauacucaaguuuaaccgaucaggaacugccuggccaaccucuaaccagggacuuuccacuggaaugauccaaaaaacauuacugccccacuuuaaccaauaagagauuuucuuuaccuugcuucugcuuucaccuuacaaaagucuucuaccagucucuucaucagaaccccccaccacuuauggccuaaggcugccugauuaacgaauuguugucugcucaaauaaacucuuuaaaauuuuaacgugccuuuguuuaucuuuuaacagcuguuuaaucucacugugaucacaaaccauacauuguauugucuuaauuauuuuacauuuuugagacuguuguuuuauggcccaaaacaugauccaucuuagugaacauaacuugugcucuuaaaggaaugguauucuuuaauugucacauacaguguucuguaaguaucaacugggucaggugguugauagagucugucagauccucccugucuucacugaauuuuuguagagggagaggucuguuaauugcagagaaagaagcauucaaaucuccaacaaaaaucggagauuuuucugcuuguccuuugaauuauuucagguuuuacauuguauuuugaagcucuggcuguguuugcagacucauuuaugauuguuauauacuccugauaaacuggccuucuuaccacugugaaacaucccuuuugauuuucagaaauaucauuugucuugaaaucuacuuuaucugucuuaaaucagcaaggggcacuacaaaguaacaguaaagguagauguaaauauuguuaaacaaguaauagguauucaaugaauacuuguugaauauugaauuuuaguauuuucuggguggcagauugccagauaauaugguuucguguguguauguacguguguguguguguguauguuucuuuuuuaauaaucuauuuucuaagucucaguguggaugagaugcuguggauaaaauaguacucacuucaggaaguuaguuaccuccaagguugacugagcguugguccuagccuucuaauaacuaauauugaaggaagaagcagcucauaaugacauaaugaaugaguaggcaaucuaccuuaaaucuuuagagaaaaaacuaaugauugaacauacaaugucagguguuuucaauagagggguaauagaagaauuagagcaggucaggaaggacagcuucauaaauacgacaccuuaugaccuuuggcuacaguuuuacugcuuuccugauauuugcuugaaccaaagcucauucucuguauaccaacacaaguacaauucuauucuguucuuuagcuguuuaaaacaaagugguuucuucauaucacgauuuaaaaagaguagucucuuaugucucuaaaagaaccauugggaaaaaagcaaaaaagaguaguuuuucuuaauucuaaagauccucaaggcaguggugucuuaaccaggaagacaggagagacccaggcagccuuaggaagcucacugucauccucccuuuuccucuuguuucuucaucccuagaaguaaacaaacuaaaaaugguuuugaccuuugaaaaagaaauaaacacugaaguaauugccugugauucucucuacccagccgucugcugaaagugugucuugagaagagcuugagaugauagauagauagauagauagauagauagauagauagauagauagauagaugauagauagauagauagaucgauagauagauagauagauagauagauagauagauagauagauagauaaucugucucuacuccacaggucgauaauagcucacuaacgcauagccagggagaugucagaguggcuugagaccucaagaagcuuuuucuuaaauccuuaaaaccuaagaaccuuuuuuuuucuuuucuuauuguucaguugccuguuaauuuuuuguggggaguagggguuggaauagcaugcuacugcuuagaguagaacaggguuagaauucuuugcugccaggaguauuauuuccuuuaaauuuguguuucuguuguguaaacaaaacuaucugcuuccuggaacauaaagcacauacauaauuuuaguaggcacuuaugcuggauugugcuugguaguuggcagugagagcacuuuuuagugugauggcauagccacaucucuuguggggacaggaauauuuuccuguuagaguggauggugaccucuucugcauucugcuuucuuccccuuccccacagacuuguagaagcucuugacaaacagagcagagaaacaaacuuaaguaccagcauucucaccagcccaaauuccugaaucucugacuguccuaagacaugccaguugucuguaccugugcagccuuuccucauagcaaggacuggaacagaggaggaacugguuacaguaaucaucauuccccugugaacaaaggucucacgcagucauuucuccucaguguguuuucggcuucacagaaugacugugagacaauguugaucuguuuacgucacuuagagcuuucagcacauccuuuuaauggccaaacuuacuuuuuuucugacagacuuaguauuaggaucaacuaucauuuuucuggcccuaaugcacagagcuauuaaauuccucaagguucagauaugucuguuuuucugcguaacaugaauuauccaagaaaaauguagacaccuacuuaaaguaauagaaaaagcauugaaucagggucagagacuucaaaguaauccauuaaccucuugguaccucaguuuauucaucucugaaauggaagugaugauaacuauccuacuuuucuugaggcaccgauguaaugaaugugaaaguaguuuguaaauccauaauuugccauacaauuaauagcuguuguuuacuaaccuguagguagccaccauguacuucuauauagcuuuugcauaguaucugaagucuaacacagggaguuuuuagauuuuuuuuuuuuuuuuuugagauggagcuucgcucuuauugcccaggcuggagugcaauggugcgaucucugcucacugcaaccuccaccuccuggguucaagugauucuccugccucagccucccagguagcugggauuacaagugcgugcaccaccacacccgucuaguuuuguauucuuaguagagacagguuuucaccguguuggccaggcuggucucgaacuccugaccucaggugauccacccgccucaaccucccaaaaugcuggcauuacagguaugagccacuuugcccggccuuuagaacauucuuuacaaguaaguuagaggaaugucaauaggagcaggguguagucguuuacuaauauuggaagauaccagauuucuggauuuuuaggguuagucucuuuuguuaaacauuaauauucucuagaacucaauuacuuuugaauaacuugcagaaauucccagaauucuaggaucuuugcucuagacuauacagcuuuugccaaauuuagacuacaacuauauuguacguuuuguggacuacaguaguucgucuagugugguauaguaaugcauacuauugcagauuugaaagcucugucaacauuaucauaucacuggaaugcugcuuuuauuucuuaauucuaccccagguugucuuaccauucugucuuuguaccucuaaauucaaugugucguucuuuuuuucuucauaauuuagagugguuugugacugggccacauuccaucuuccaccuuuuucguaaaaaccauuuuuucuccauagaaguaucaaaaccuuuggaauuccuucaaaacagcugugucugcccuccuucuaguggcccacuagaacauauaugucuggagagcugcagugccugggacacuacaggcagauauauauacuuuauucuuaacuagaauuucucugauaacuggacaccagccuagaagugucucagaccugcuuucaucugcucuuuguguucuuaaaucccagacagacccuuccagaaccagaugaccaucaagacaaaagcauacucaagcagacaagaaaggaguaggucucaccauaucuccuagauuuauaaugugugcucucuaccuggcagacacuacacauacuguguaaagcacugcugggggccuucuuugugugaaaccugggugccucgaugccuaucagaacuuuuacaugaggaaguuggauuggaggagagauuuauagucaacaguaaccacuuaacuuggaaaacagaaaagaaaaagaaucguccauaaucccaucaccccgaugcaaucucagugaauaucacagaucagcauuacuguuucucuuaugugcuguugucauaauugugauacaugacaguagugcaacuauaaauuucguauuuucuuuuuuuuaauauauugcaucccaccuguaaaacuggcaagauauauuuucuuuugcuuccccuacagggcguuuguauuauuuugagggccuuuuaacuuggugauaaagagugucuuugcccuaagaccuaauuugaauccagcgugguggucguguaacugcccacaagucacgucacuucuucucuaagcaucaggucccucauuuguuaaauggcaaucauaaaaccuaugccaaagguuaaggugggaauuaaauguaauaauguagucagugcacucagcccuuugccugacauauaggacgugcucaauaaauggcagugagggugacauugaggcagagaccucuuaggcuacaugagugcauuguaaguaauuugggguagaaccuuuuacuuaauguauuuuaagacaucauuuauaguguuucacagguagauccugcuuuucugugguuucuguugagugauuuaagguggcauuuguccugggacucacuugauuuauuuauuagacugaaaauuauauagcauuugaagcaucucuggaacauaugcacucagauccguggguucauaucuuaaugauuaugggcauuuuacuaaugaggaagagcuaucuuccccuauuugugguauuauuugugauuuagacauucuuccuggacaacaaaguaucuuuguacuuuguacaaaauaaaacucuucacguauuacuuguuucccacacagucaucugaaaaugugggcacccgacagggcucaacaaauauuuauuuaaauaaaacguggaugaguuuuacccuaaagaaaaguugcauguauguuauuuacaguuuucugcaguguaguagcuauuuuuaaucuuuugguuucucccugcacccuaauagguuauccuauaauuggguuccguucauguguauuagugucccaggcugaucuuagcuccaguaaauaccuagugugccuucuagaauguuauaucaugaaguucguuacucaccccccucaguuagccuacgacuugaccuuuuuuuaauaccaguuuuggaagacaggccuaacacuuguguauuccaucacaucuugauuucauagaguuacguuguggaggauaugguucaacucacauuuuaucugaaauauuaaacagcagacccuuuacgauaggaccccgcaguacugcuuucauucacuuguccucagcuccgcgcugauuuguucuucaggauuacuaucuguuuuggguuaacuguuuugcaguucuuagacacagaacugcauuaucaaccaaaauaaaagagcuauucucccugaugugccuuccuucuucuuccugauccuaggaugaugaggcuaaaguuuccagcuggaucuggcucggcauuucugggauaaauuaaaugagcacacuugauugagggguagcugcacuguaucccuggcuuccuauuaugcuaggagaucaaagcagagcacaaauagaggcuugcucuauacaauauucaaaacagauggcuuuuuuuuggugaaaauucagguuuuaaggcaaaacacuuguuagcaaaacuucauuucuuuucauugauagauagucacuacugaacacauagcacuguuucuuccuguauuucaagacuaggaucacaaacuuuuugcaggaggagggauuuggcaagccuagaaagguauuagauugucugugucuucaugugaauaugaaauaaguuauuaagauuuugcuguugguauucuagaaucaaaugaaaacaucuuacauuuggucacauaaucauuuuguuguugggucacuauuuaaaaaucuaguacucauauuguuuugucuucuaagaauugaaccaggauguuuaucucugauuucauguuuuaacugaaaaguacauucuccacacuccuuuaucauuuacaucugaauccucaaguucauguagaauaauucuaugugaugugaaacuuuuauuauuuugguuuaaaacugaaaugagaaauaagauuaauucaaaaauauuuuugggacgucugccaugugccuaacacugcauuagguacgugguaaaaaauacauguuucaagacauugaaacaacugcuaaaugauggauuuucuccaacagagaaaaauuauacaagaugcaauagaaaaacccaggucuccagagagauuuagggguucacaaagaaggugacacuugagcuaacucuugaaggagcaguaggcauuugccaggcagauacaauuuuagauaaggacauuugcaaagauauagaagcauaagcagcauaacaaauuuaguauauucuuggcagcucauuauacauaguaguucggguguaugucaauuaucuguugcagcauuacacauuaccccaaaguguggcagcauaaaacaacaauaaaugauuuucaucucagugguuucuaugugccaggaauucagcagcgucuuagcugggcaguucuuacuuggggucucucaugggaccgcaauuaucuaaaaccuucccuggggauagaacagccaauuccaggauugcucacccacaguuugugccaccuauuggaaggaaccuuccguuccuugccauauggaaccucuccauugggcuccuggauguggugacauggaguccagcuucacccaaaaugagugauccaagagaugagagccagaaggaagccacaaugccuuuuaugaccuagaaucauaaguuacacaacaucccuucggccacauucuguuccuuagaagugagucacuaagaccaucccacacugagugggguauuagggcuuaggcaccacuuuuugaaaggaggaaugcuaaauaauuuucaggcuuuuuuuuuuuuuggcagcagagucucgcucuguugcccaggcuggagugcaguggcuugaucucggcucucugcaaccucugccucccggguucaagcgauucuccugccucagccucccgaguaucugggauuacaggcaugcaccaccacacuuggcuaauuuuuuuguauuuuuaguagagacaggguuucaccauguuggccaggcuagucucaaacuccugaccucaagagauucaccugccuuggccucccaaagugcuggaauuacaggcaugagccacugcacccagccucagguuuauuuuuucaauuacuaugggaugucagagagggaaaaacaagccauuaggugguugcagucagcagcagguggaucgugaagaccucagcaugccauugcaaucuguagagguuggacagguggagagggagguauacggggcagaguacuggaaacaggacagccaguucagagcuugcuacuuuguccuggagagugaugcugaggggcugaaggggugcagugauagaagaguuuauaagugagaauauguuuauuaucaagaagcucugguucuuauaggaaaugucccaaaugguuucuagucucucuugguugagaaaauagagaacaccgucugaaugcccaguuauaauucagaaaguuaacuugcccguaggaacuacucagggaaaagcaaugaaauaaagccugaaaguucuauaaccgcuccggggagaaccacgagcugugaugcgcugaugccgacugagaacuuagcugcuggucaucuuuacagaucaagucaccccucaggauuuugaauuuuucauucagaaaguuaggcaggggacaggggcagauaucucuaaaauuccuuccaucuuuuguauucuguacucaaaaugaguacaggaugcuguuuugaaccaauuaguguuuuagacuugucuaaccuugaaaacauuggacccaauagaaacauuuaaccuauucacagauauuuaauucagguuguaucaguaucaaggaauuuuuaacugagcguuuucuggagcugaaacuaaguuaacuuaguaucuugaucaauuuauacauguaguugaaaauguucagauuuuuaaauuaucuuauggaaucauuuuaauuaguaucacuuuuucauauuuaaauugcauaacgauuuuauuuaucaguuuuuacauagauuuuacuaauuaucacuuccuguaacugucaguuuucauuuuaugccuauugccaaauccaauuuuccauuuagccaauguuuuauuuuguguuaauauuauucuugauacaaguacuuuucauugugaauggauuuuuuaagauaguaauuauuauuccuuuuuacaauaaucuguuggaaaauuauaagaauuuccucuuuaauauuauauuuacccuguuaucugagauuggucuguuauggaaauuggcaaacauuuuuuaaugguccagauaguaaauaguguauaguuacacuuuugguuuuuguuuguuuuugagacagggagugcaguggugcaaucgcaguucccugcagccucaaccuccuucccaggcucaagcaguccucuuaccucagccuccugaguaacugggacuauuggcaugcaccaccuuacccugcugacuuuuuaaacuuuuuguagaguugagucucuguguuuugcccagguuggucucgaacuccugagcucaagcaguccucccaccucgaccucccaaagugcugggauagcauauacuuaggcuuugcaaacuguguacuuccugccaaaacaauccaccucugcuguuguagugugaaagcagccauaggcaauaugugaaugaaugacuguggcuaugaacuaacaaacuuuagacacugaaaucucauguucauauaaaaccauuuuuagcugaugggcuguacgaagaaggcggagcugaauuugguucauggacuguagugcuguguugcuuaucugguucuuguugugcuucuugucauuuuacaugccuucacuagccauccacaggccuuggugaggccaagcaugugguggcauuaaaauguccucagggugaggaugucagguaguuaccaaggauaacuugucuuuacauguaccgugaucuucacaaggaugggcauaauuauucccaguuuacagaugacaaaacagguuauuggaaauaauaguaguuaauaauuauugaagaacuuaacuauguggcaggcacauagauuaucacaaacccauuaauacacuguuaccaaagcaacuuguuccaggucuccuaccuagaauguaacagacccuggaaucaagccguacagugugucuccagagcccaugcucuucaccacuguaucacucuguguguaauucugcucuguggcacagaacuaucaauacagugcaaagaugucauagcacauaagugauacacaucugucucuagugagcguagccucuggguuaaaaaacaaaaaccaaaaaaaacuuuuuucaccacagucucugaaacugaauacccagucauuaacgugaugucaccagccaaccgccugcauccuccuggcugugcgguguuugaauggccauagccacgggagcuacauugccugcccugguacuaaaggauggacuacugugucugcauccaguguaguacuguaaggugcugugaugccacagcagccguugccaaagaaauguuuagguagaugcaauucuuaguuaagauuauaagaugcagaggaucgccuaaauuaauuuaauuccaggcuaauuaaaaaauuuccugagggaaguaacugacgugagagcagauaagggcaagcaugcaggcacacagcaugcuuuccuggaagguauaaguuguaauugcuccaagagauggcagagguaggaguccuaguucagaggagccuggcuccagccaaucagacauuucauagcucuaugcacguguauguuuuaaguagcguguuaaccugaugcuuucuucugguguacagaaauauaugaucauugagacagaaugcgcuaaugaagucggggagcugaaaaccuucacauacauagaauguagagcacugaacucacagguugucggaggcacacacaccugccuuagaauggcuuugcaguauuccuugaaaugcugcaucugggaaaugauguguggaugguuugcuagcuggaggcugguuuguuaauuagaaguguaucugaccaauggcaugagaucuuauugcuuaaacgaacaagauggcggagacuuuacucccuuugaaugguccagcaaaggcuauuuccugucagcaguagcaucucaugcaagaagauuacaguugcugaagcccacaaggcaacugaguauggagaauuccucaaaauuguauguuguguauauuugggcagacugguuaaagcaugaagagagcuauugcuacuguuaaaguaugugucugugcuaucaaaaguauacucccugaggcugaggcugcaaugcagugagcugugaucacaccacugcacuccagccuaggcgacagagugagacccugucucaaaaaaaaaaaaaaaaaaaaaagguguacucccugguaggagaaccagggaaaagcagcuacaaacaagagcagauuaacauggugcagaaaaggcauguucugcuuccucuugucccuuuucuuugcuugauuucuagaguuagauuuuaucauuucacucuuuaaucuguuucuuauuuucuaaacacccguaauauauuagauucucugauuauaucaaaaacguggucuccauccucuggauuuccucacuaaaacuggacguggcuuccuuugugcaguagcuuuuuugugaguacuaaaagguggcacugguaugagagccugggagauuaaaaaauagauauaugaagauucuauauaagcuuaacuuuuuccuuucucuuuuuuacuaucagucacuuuacagcuaaacuaggagccuacuuacucuuuauugacucguguaguuaccugugcuucagucuagauguguacaccauguaccccuuggaacuuccuucuguggccgcuugcuggcgcucugcuguucccccaugaguaucaguccguucugucaaaugcuaggguuuguucuuugcgcucauuccauuucccacuucccaguggggcugccccccuuugccacuacccuucagaauugaucuccagucccugcuuaaugauccuguguucggagcagagggaaacagagcacguggguccuucuuccagagauggguguuacauacacccaaagggucgucugacuggagauccuuaggcuagucaugguccagguuguguaaucuugaaacaucagccaccauuuguaguaucucugguguuuaccaugcugagccucuuucgucauagucaauuguauauuuucaaauaauaaagcuuugcuuaagcguccacaacuaugaauauugaaguggugaugaccgucagaguuuguguugugcuacacggcuuaacguuucgagagagagagaauaauucaaucacugcaugggagguuuuauucucaaauaaaggaaguugguagagaaagccgucuuccucauguuuguuuuucccaaaucuuuuuuuccacccaaagucuggauuacucccaaggugagaggguugaugucuggaaauuguuaauccaugggaucuauucaugguauauaaaauuuucagaaagaauuugccuuuuaaauaugauuuccugauugacuauagcaaacauaaauccaggaaguacaacucugucagagcagccaggauccuucuuagcuucucagauguaugagauuuuuuagugcguguguggaguggaaguaaagauucuucccgugggcaggucagaaggagagaggggaguuaggagaagaaaggaagagaauaauaggacauagaaacaaaccaaagcugcuagggucggggaggcagguauauaccccuggcuuuccuggaauuagcugcugucccccugaaaaaccagcuuuauuuuaguuuauaguacugagaggaagaagcuagggaggcacccuuuuagugccuucuguccugguacuguuuucauucuugaagugcucuuuuaugauauacagaaacauuuccucauccucuuggugauacaaaguucuugggccacuauuuucagagaaaacuaagcuguacuaagcuggaaauauuggcugagggccauuuugcucagaucucuccucccaucuggacuucgugcccccgugcauucuuaaacaccaaaucacaaccauuucucaccugcugaagugagaaacaguuuucuggcuguuuccgauguuagcauuaaagaucagauuucuguaugugacuugccuuucuccaauggaaaggugcccauuucugauauuuacacacagcuacagauauauuuauaguuucucuuggauuucggguaauagcuaacucuucuucccugccaccuguacccucucaggccauguucuuauuaagcacucuaaugagaagcuacgucuaccacaggcucuagacacaugaugagacccucaguggcuauagccuagcugugagcacucagcaguagacuuauaucugcauagucuguuguguuugguuugacgcuagaguucaaauaauaaggugacuaacugcaaacugccucugccugcucccccagcccuuccauguacagacagacggacacacacacacacacacacacacacgugcacgcacgcccucuuauccugaccuugaaauagcuaccacucacagaagagucuccuccagagacuggccugucuuugggagccuuuguacagauaaacuaucaaaucucauagugacuagacagucauacuuggcucuuuuuuguaguccuauggacugagaaggagccgguaaauguguuccucuucaguucaggucacaucuuugacauguucacaucuuuauuauguuguuccuuguuuguugagaugcuaucaaggucaggaggucccuuuuguugacccuggguaacuccgcuugccuuuccccuccacucccaaugccauaggugagaaaggagaagauaaaaugugauuaugagguuauuauacucuuuugcccccuaggcaacaagcguauuguuguuuuucagauccauccgucuagcagacaugugauaaugccaaaagguggugucgugcuugacugcagcaguuacagcacgugaggcaccaggccucagagggucagaagagagugugaguuaucaauuucaauguuuauguguucacacgggcaugcagggaguuaaaagccaccauuuuucccugugaccaacugcccgccuagcuuuuccuuugaaauccagcgucaguccuuguagggcuggccugcucaaaaaguaugacugucucuucucccucuuuugccucauguuucuuccacaugccuagauuuuugccccuaaugucucauucauaaaucuguagcccuggaacuguacuguacaguagggaagccauucagauauauauauauauauguacuuauacuuaacucuuccauuuuucacuaaaacacaaugagugauuuguguggggagccaagccucaagccaagaacugaauucaaaguguuuucucgucuuuguuaacucuuaacagcaagaaagaauuuuggaacacauuucugcuccuggaauuucugagugcagcaguaaguggcuuucugaguggcuuucuugacuucuugauucugguuaucucaucgacuuucagcagccauccuuucagggcgcauacuguauguacccuugauuggcuggccuguaauaauagcuucugugccuccuaguagcauucucuucacuuuucaccccauuucuaugugcuguccucaucuguauauacauguucacccaccugguggugaaugaccugguuuuaauguaucuuacaaauuuccgaguacuaaagcaaguauagagaugccuacagucuugacauccuuuuguagcacauggagagacacauagauaugcucagccagagauguccuucccuuacuaguaggcaagccccuaacagucuguucccuaugcacucccuuagauuucguuugaguagcauuuuuuauaaugcauaagguaaaagagauguuaacugaaugaagauugaauaggcagaaugcaguuagcagcucuguaguugagauuucaagauuuauuuuauucugaacgcuguuccauaucuccuuacagcuuugaggacauaauguuuucucuucauaccugaauccagaaauaaaggauguuuuguuuuguuuuguuugcuagagugguaaugcauccuuaaagaaaaauuggcaacagauuugugagcuguaaaacuaagaagaaaugaucauuuguuauuuucaaaaaugauucucauguuucuuugcauuucaaaaccuauagucuuuugugguuuucauaggcacauuuacacuuugacagaccauaaaacccuuucaaucugaaaccuuuggagagaguuucuacuuuuagaaccagauauuucuauuaguagugagauuucugauuaacguuuauucaucucagugacuaguggucccuggaccugaacuccuagugguaacugaauuauaugauuuugugaacuccauucuuucacaaaauagcuguguuuaaauaagaacauaacacauugcuccaaaccuuugugacaaggcuugacacacuauccuucauuuuccugacccugaaguacauuauugacuaagaagauaucuuaguuauugaggguaaagacuuugaggcagaauuaaugaauuuuauuuucucgcaucuuuuacuuuucagaguuuagcucuccgcuggggccucuggauaagaaugccauucuaagaugauaauauuuauggaaaguuaaucuguuauucugggauuuucuuaauguagucuauguugagagacagcaguacaaugacaguccaauaagaaaucaaaacuaccacuaacauuuaugcaguuaauauauggacaguugaaccugccucugaagacuucagcagguaaaaagaacaaaaagauuuuguagccacuucagggcucugagcuagccacagaagaaucguaguagauauaaaaauaauuugccaggaagacaauaagucaucaauaaauguuagcuuuaaaaaaauggcaucuuucgggcugggugcaguggcucaggccuguuauccuagcacuuugggaagcugagacaggaggaucacaugagcccaggaguuaaagaccagccuaggcaauauugugagacccuuucucuacaauaaauuuaaaaaauuagccggguaugguggugcaugccuauagucccagcuacuuugggggcuaagguaggagaaucgcugagcccagguggcugaggcuucagugagcugugauugcaucacugcacuccagucugggugacaaagcgagaccuugucucaauuuaaaaaaaaauauauauauauauauaaaaaaugacaucuuucaacggacaaaagauuaguaccccaugagaaaauaccuuaagccccaaauaauauucaguaccuguucaucuaggcuuuaugaggaggcuguguuaugccucucggaaugguucuuagaguaacuaucuggcacagaggcaguagagugggaagagaagagccuacuggacagacgcuucacucugcacauuucuuccagguauugaagucacauggcccaagaaaguguguuuggaucucauagaugagugaguugcagaaguggaaugcuguagaaucuucuguuacuauuuguauugaaugauacaggaacaacuuaccugucuuccuaaagaccaucaguuauccaaccucacugaaguggaaacuagguuaaaacaaacaccuuuggaagauuacuggucuugucacuaugccaugaaaugcuggccucugaagccuguuugagaaucuaauacauaaacaaauaaauucuuacaagaagaaacaaagcucuuaguacuuaaccaaaaaugucucaucccuuuuuauaauuuaaauuuccucaacaauuuuguaaauguagcauuggggccauaaugacguuuuggcaucauauuugguacaagcaaauaucaugacgaguucauuuuuuaacuucuuuuuuccuagugcagaaaaguauauuuaaguacaguucauuauagcuguacaaccaauuuggccugaccacauaucugaugauuuuuaguaggaccccuugccaauguauugaggucgcauguggaaaaaaguuauaacuuacggguccuguaaggcauucucuuucuacuuggcaaaugucccucuucccucuugagauuaggcaguggcaguucuaccuugugggaaacacaguuucuuuucuaaguggacugcucaaauuagauagggagaaaagggaagagauaagggcauuucccacaugauugacaugguucauguguuccgagaggcuuaaguaguuuuuuuacagauagauuuggggacuauacuaguugggcaguuucauaugcuuucacaaugauacauauuuugggaguauuugugguauuuugauaccucuauacaauguaaaugaucaaaucagaguaauccaucacuucaaacauuuaucuuuucuuuguaaaaugaguuuuuaucccggauaaacaauuuagaauuucauucuuuuuuaaguuuucuuucuuucucuuuuuuuuuuuuuuuuuuuccuugagacagagucuugcucugucgcccaggcuggagugcaguggugccaucucggcucacugcaagcuccgccuccuggguucacgccauucuccugccucagccucccgaguagcugggacuacagacgcccgccaccacgcccggcuaauuuuuuuuguauuuuuaguagagacgggguuucaccguguuagccaggauggucucgaucuccugaccucgugaucugcccuccuuggccucccaaagugcugcgauuacaggugugagccaccgcgcccggccuuuuuuuuuuuuuuuuaauagagacagagucuugcuauguugcucaggcuggucucaaacuccuggccuuaagcaaucccccugccucagccuuuugugugugugugugugugugugugugugugugugugugugugugugugugugugugugugugugugugauggagucucacucugucgcccaggcuggagugcaguggugugaucucagcucacugcaaccuccaccucccagguucaagcaauucuuaaugccucagccuacugaguagcugagacuacaggugcgcaccacacccagcuacuuuucauauuuuuaguagagacaagguuucacuguguuggccagacugcucucgaacuccuguccccaagugauccacccaccuugcccucccaaagugcuggaauuacaggcaugagccaccacaccugaccucagccuuauuuuuuaaguuuucgauuggacucugaaauuuuucagaauaccagaugccaucauguuuauuuaaucaauuagccaucagcauaaaaugcauuuaaaucuguuugaaaauuuuuuuuuuuuuugagacagaucuugcugcaaugcccagccuggagugcaauggugcgaucucggcucacugcaaccuccccuuuucagguucaagcaauucuccugccccagccucccaaguagcugggauuacaggcaugcgccaccaugccuggcugauuuuuguauuuuuuuaguagagaugggguuucaccguauuggccaggcuggucucgaacuccugaccuuaagugaucuacccgccucagccucccaaagugcugggauuacaggcaugagccaccgugcccggcugaaauugauuguuuauuaagaauaaggaucuaaaaagucagcauccgcagucauagugguuguaggagugagcuaauaauaucuuuuuaaauucuguuuuacuauaaggaauuugaccuucucaauaugaccauuuaucacauugcccccuuucuucguggucauacuuuuuucugccaguuuugucagucaaaaguaauuaccuaagauaagcagcucuuucagccuuugcagcccagauguggcauuugugauggcagcucuauacccacaaacaugcgcgugugcaccaaaagaaugggaauaaauugcacaaauccagugaaaaucccaaaggugauuuuuuuaaaucaauguauucaugaaagaagauagagaaaaccaagcuuuuaaaaaaugaggaaugaaauagggauauguuacuuggcaucauggggguguaguaacagaaccgugaugagacgguuucgucauuggcgcacagagugugcuugcauuuaaaguaauuuuaccuuugaagacugcaccuggaauccuuuguaaauuuuccacaaugaguauacuuuuuguuguuguuguuguuuugagacagagucucacucugucgcccuggcuggagugcaguggugugaucucugcucacugcagccuccgcuucccggguucaagcgauucuccggccucagccucccacauagcugggauuacaggcgcacgccaccaugcccgacuaauuuuuguauuuuuaguagagacaggguuucaccauguuggccaggcugcucucaaaauccugaccucacgucaucugcccaccuuggccucccaaagugcugaguuuacaggcaugauccaccaugcccgaccacaaguauacauguaugcccagaaauaaaauacaauauuuuugaaaaguugguauuguuugcaaaaaacuauccagcucccccacucuaaauucucuacuugauugaaacacugucuuccuucugugacuggcuguguugacaugccugucauagguaggaaauuccagcccagaacugguaccguaaaccugcugauuaggagucucuuacagagcccagcagccuuccacagcagaacuuugguguuuaucguuuauccuuagagagagagagagaauuuuaaaaacaaaaguaaugcuaaauugauuaauuuucucugguuugucuagccaggcuccagcuucuguguaauauacuguauaggccuaaacugaacucugaucuuuuuagcaagcugaagauuguuuuagccacuaagcccuugcucuuuauucucuuuuaauuauuuccuggaaauaguauuagaaacaaaggaaaugugcuauauguauuaugcagccaugaaaaacauaguuucggucauauauaauguagugaacaguacugacaauauaauguuaaauagauaauguaucaagcaaaaugugaggugugauacuguuagaagcugauuuauauaaauuuauuaaaagacuuggcaggaaaauuuccaaaauguuacaaaugauuacuucuuuuuuauuuuuuuuuauuuuuuugagacagucucgcucuaucgcucaggcuggagugcaguggugugaucucggcucacugcaagcuccaccucccggguucacaccauucuccugccucugccucccgaguagcugggacuacaggcacccgcccaguuaauuuuuuguauuuuuaguggaaacgggguuucaccauguuagccaggauggucucgaucuccugaucucaugaucugcccuccucagccucccaaagugcugguauuacaggcgugagccaccacacccggccaaauaauuacuucuugauggaaguguaugcaaaagucuuauuuccuuuauauuuuucuuuuuucccccaauuuuuuggaguaaaauauauauuguuuucauaauaaaaacauaaaacuuuauuucuuaaaaaaacucuuguugaaaaagaaauaaaggaacguggcaggagcaguccucugaggggguccaaggaggaaucaguguuacuguggaaaguaauaccaggccuugcuucuguugacuugaagauuauugagcucccaauucauuaguuaggccagagguguccuguucaugaaaauugccaggccggugacaugcaacaggugcagaccugcugugugagcccugggaacacacugagaucugccagcguuuuggcggugcuucgcagugcucacagcugcugugugucaagcaggggcugcucuaaugcuucaguguucugugauggugaggucuggccccacucucuuccucagcacuccaggcuuugaccagcuaccaaauaccuggccagacuauugucacgagagcugccaaaugaaauccuggggcaggagucaucagucauuuagugugcuuccagaaggaaucaaaggaguagcuguucaagcaggggaaaggaaugagaaaagaaaaaacguagagcaagucuguuacuuaagaaaaacacagaaccaauguuacaacuaagaauuucagaguccuuggcugugagucagguguuugguguuauauagggauuuaucagucacugguucagaagaauaucggauaaccucugugaaauaaaugagaagagcauaagccaggaugagacagaauucguaaugaguucccucaucacaucucuuggccaagaaaaacaugcacuuucuccagaggcagaauuuuucuuccauucuaggagguggaggaacacuuggaguauauguaguccaggcuuucagaugagcaguuucacuagcaguuuuuuguaaucuacucauaaauaagugaaaagagaaacugugagguaacuggagucuuucuguaucaggaauagcaucucuguaaaaacaaguuaguccugugcuuaauuccugccucgauacagagcuguccgucuggugugaauauaugaagccagcguucucuuccugucucccagaagggcggcugcgugugacagcguaaaugugugacaguaugugaaaauguuucuguaauccugaagauuucaguagugauuagaagagcuuuagucuuuggucaauuuucuuugacuuggaaagcauaaagaauauuugaaccucucauuucagacugaccuugacuuuccucauuuuauuuuauuuuauuuuauuuuuuugccuuagaucauccagccccucuuagaacuugaccaaaauagaaguaaauuaaaguuguacauuggacaccugacaacccucugccaugaccgagacccccugauccuccguggacucacuccaccagcuuccuauaacuuggacgaugaccaggcggcuugggagaaugagcugcagaagaugacccgggggcaggugagccucucacucaaacuuugaaaagagccugugaaaauccaguugcuguguagguugaugcagugggggcuaccuuggggaauccaguugccguguaguugaugcagugggggcuaccuuggggaaucccguugcuguguagguucaugcagugggagcuaccuuggggaauuccauguuuagauucaagauuugggggguggggagggguuuccagauauaauuuuuaaacugauuuuuaauugauuuuuuacuguuuuauuuuuuuaauucaccaauuaaaaauguauguuucucauguacaacauguaauuuugaaauauguauacauuguggaauggcuaaauagagcuaacauauacauucccucacauacuuuccauuuuuguguguguguggugaaaacacuuuaaaaucuacucucagcaauacauuauuauuaaguauagucagcauguuguacaguagauuuuuuuuuuuuuuuuuuuuuuuuugagaugaagucuugcucuguugcccaggcuggagugcaaugguaugaucucagcucacugcaacuuccaccucccagguucaagccauucuccugccucagccuuccggguagcugggacuacaggcgcgugccaacaugcccggcuaguuuuuuguguuuucaguagagaugggguuucaccaagcuggcgaggcuggucucgaacuccugaccucaagugauccucccaccuuggccucccaaggugcugggauuacaggcgugauucaccgcgcccggccaguuguacgcuagaucuccugaagguaauccuccugucuaguugauauuuuguaacuuucagcaacaucuuuccagccccugguaaccaccauuuuccucuucgauucaaguuucuuggcaaugaauagucuugaacagauauuuggaauuaccuuuugaaggaaguacgauucuuggcucaguguaacuuacucaaguauccgaaagggcugauuuauaagggagaaggcuaaggacgaucuguuaacauugccaucgguuauuccaugaagcgguagccacugaaggaaagucugaguaguuuagguuaaucccaugucuuagaccauucagguagcuaaaacaaaguaacacagacaggguggcuuauaagcagcagacauuuauugcuuucuguucuggaggcuggaagucccagaucagggccccagcaugguugguuucugguuccuuguguccugucgcaugcugcugaccucaugaccuaaucaccucccaaaggcccaccuccuaauaccaucacguuggggguugggauuucaccauaugaauugaggggaggaggguaaacauuccaucuauaguacucccuagacgacauuuucuguuuacugucacuuguaaaaauccagugauucucuuuuuuacauguugugauuuuuaaugcaguaaaagacaggguaaggcuagccuggagacaaaaaaucaggaauaaaagaaacagaagacaggaugagaacaggcauacaguacagacauggaaagugaaggaaagaaaaagugaauaaacauugagacauagaaacagaaaaagagaaaaauaggucaguuuuugaaauauuaacuuaaagcuccuuuugcuccuaguuuacugauagaagucagugauauuccuuacccccuauagauucaaucauaccaacagaaggcuaaagaaaggcacaggugguguaaacuuacuaaaacucuucaucagaacuuugaagcuacuuacuauuucuagcuaaauacuuucuauuucuuaaauauuguuuguuuacucgugugugaagguaaauuguauuuaauacagaacuuccuguggugugauauuaaagaugacagugaaaacccgcaagucaagaaaugcaaacuggugagccuuagagcuguacuuacuuucccgugauguggauguugccuaauaauacacggacauauuucacagccuaacuaguuacccaucauuuauuugaugugugaagacaaggccaacuucucaaauuuagcguguugacauaggaauuuuaaucucuuucuuucuugaaagaggaaaaaaauguaacgaacaguauuaaauucagcgaggugcuguggcucacaccuguagucccagcuacucaggaggcugaggcaggaggauugcuugagcccaggaguucaagguuacaguaagcuaugauugugccacugugcuccagccuggguggugacaaagugagacccugucucuaaaacgaaaaaaaaaaaaaggacaguauuaaauucaauuccuaauagcucuuuuugauauugauaaccauauacuaaaaauguaauggaaauaaauacauacacaacuacagugcaaccaaaagcccauuggaaacaaggcacauggcuauucauuuuagagacuuuugcuucagaauuuugcagaaaaacgaugcuucuuaaaagcagugcuacugggcacaguggcucccaccuguaaucccggcauuuugggaggcugaggugggagaaucccuugagcccaggaguucaaaaccagccugggcaacauagagagaccucgucuuuaaaaauaauuaaaauuauccagacauggugucacacgccuguagucccagcugcucagguaguuaaggugggaggauggcuugaucccgggcagucguggcuacaaugagcugagaucgugccacuguacuccagccuggguggcagagugagaccccgucucaaaaacaaacaaacagcaacaacaacaacaaaaaaaaaaaaacccagugcuuauuaauguauuaaaguuuaacuggcauuaaauuauuccuuuguaaaacaguuugucuuuguuuuguuuuuguuuuuguuuuuguuuuuguuuuuguuuuggagacagagucucgcucugucacccaggcuggagugcaguggcacgaucucagcucacugcaagcuccaccucucagguucaagcaauucucgugccucagccucccgaacaguuggaacuacaggcgcgcgccaccgugcccagcugauuuuuuguauuuuaguagagaugggguuucaccauguugcccagucuggucucgaacuccugagcucaggcagacggccugccuuggccucccaaagugcuaggauuacaggaaugagugaccaugccugcccagcuugucuuugaaauggaaaagauauuuuugcucaguccuguauuuucaauaugccuagauggacuuaacucagucuuaccaaggggaaaaaaaaaucuucagagugauaccaagauagaaaauuucaaacugauuuuucagcaaguuuugagugaaugaaaccugauuaauagacuucccauugcagauuguguuacagucaagcuacugcacucauccaaacaauugugcucacacacaugacuuccguuaauauugucauguuucccuuuaauugagaauguacuucaguuacugaaguuacuguuugaggugugugaaauuguauucuccccaacagucccugcgaaacgagagaccugggucaucuacagaggaauacaguaacuaacaaccccuacuauaagcuucuucauagcuucuaaagguugguggagaaaccaacccauuucgugcuuccuuaccccaaguaagaauuuaaggaaguaauguaggcugucuaacaauacaaaaugacuugccuaugaaaguauugugaucagaguuugacuucagcuuuaacggccaagaaacagaagaugugagucacugccaaauaugcauauugguuuauuuugugugcguguuuuguuuauaguuuuguaguuuuguuuuugugaugcagagccuucugcuccugacauuugcauuuuucaccucauaucuccaaugcauuucacugccaccaugcugccaccaacaccaccgccaugaggacaggacaagaacuuugucuuuuucaaugcuagggcagugcagaagggaaaugcagggucagagccccuacacaguccccacuggggcacugccuaguggagcucugagaagaaggccaccauccuccagaccccagaacaguagauccaccgcugguuugcaccuugcgccgggaaaagcuguaggcacucaguugucagcccaugaaagcagcuggaaggggccugugcccugcagagccacaggggcagagcugcccacggcccugagagcccaccucuugcaucagcgugaccuggaugugagacguggaguuaaaggagaucauucuggaacuuuaagguuuaaugacugcccuauuggauuucagacuugccuggggccuguagucucuucguuuuggccaauuucucccauuuggaguagguguauuuacccaaugccuguacccucauuguaucuaggaaguaacuaacuugcuuuugauuuuacaggcuuauaggcagaagggacuugccucgccuuauaugagacuuuggacuuggacuuuuggguuaaugcugggggccuguugggaaggcaugauuguguuuugaaaugugaggacaugagauuugggaggggccggggcagaaugguaugguuuggcuguguccccacccaaaucucaucuuaaauuguaguucccaucauccccacgugucaugggaggcacccagugggagguaauagaaucauggagguuguuacccaccaugcuguucucaugauaguggguggcuucucaugagauuugauggcuuuauaaggguccuuuccgccuuugccuggcacuucugucuccugccaccaugauuguaaguuuccugaggccuccccagccaugcagaagugugagucaauuaaaccucuuuaauaauuacccagucucggguauuucuucauagcagcgugagaaugggcugacacacuaugucuuucuauuuaagguggguuucuuguagagaacauauaucaaaucaguaauugucuucugauugaaguguuuagaauauuugcaccugauauaauuauugacacaguaaaguuaaaccuaucaucuuuauauuuauuuguuucaucuauuuuuuuccucuguuuuuguuuucuuuuaaaguaauuuuuuuuuguuauuuuauuuuauuuccacuaguggcuuaaagcucaacuccccaccccuuuuaagugauuacucugugguuuacaguguacaguuuuaccuuaucauagucaaauuuugaaaauauaguauaccacuucagguauaguauuggaaucugccaauaguauacuucuauuuccuuugucucaaacuuuaugcuaucauuggcauacauuuuauuccuccauauauuauaaaagccauaguacauuguuacuguuuuugcuuuaaaucaguuaucuuuuuuuauuguuuauugugcuaaaacauacacaacauaaauuuuaccaucuuaaaaauuuuuacgugcacaguucaguguuauauucauaacguaaacuaucaccaccaucuaucucuguagcucuuuucaucuugcagaacugaaacgccauaccuguuaaacaguaacuccccauucucccuugccccauauuccaucugccuucugauuuuacuccuguaaggguuucguauaaauggaaucaggcaguauuugucguuuugugacugacguauuucauguagcaagguucgucuguguugcaccuuguuuaaggaaaugcugugucagaauuucguuccuuuuuaaggcuacuguuuuauauaccacauuuuccuuauucauuccuccauugaugaacacucggguugcuuccacauuuuagcucucaugaauagugcuaccgugaacacggguguauaaauaccuuuucgagacugugcuuuccguucuuuugguauaaaaucaaaagaagagaaauugcuggacuaugaguuaacccuauuuucaauuuuuugaggaaccaccguacuguuuuccacagcggcuguaccaacugacauucccaccagcgguacacaagcguuccaguuucuccauaucccggccaacacuuguuauuuuguagucuuucguguguuuuuuaaauaguagccacccuaauggguguaagguggcaucacauaguuuugauuugcauuucccuaaugauucaugauguugagcaucucuucaugugcuuauuggccauuucuguuuuuucuuuggagaaauaucuauucaaguucucagccuauuuuuaaaucagguuuucuguuguuguuguuacugaguuuuagaaguucucuacauaguuagauaguuaucccuaaucagauauacgauuugcaaauauuuucucccguucugugguuaucuucucacuguuacugugguaauagugucuuucgaugcacacauuuuuuuauuuucaggaagucccauuugucuauuuuaaucauuuauauuuuauagagauuaagauuauaaaauaauauuuuucucauauguuuaccauuuucaaaaaucuuuguuuuuuaucuguguaugucugaauuuccaucugucaucauauuccuucucucuaaagaacuuacugaggcugagagcaguggcucaugccuguaaucccagcacuuuuggaggccaaagcaggaggauugcuugaggccaggaguucaagacuagccuggacaacggugaagcccuuaucucuacaaaaauuuaaauuuaaauuuaaaaaauuuagcuggauacaguggugugugccugcagucccaccuacucgggaggcccaggugggaggaucacuuuagcucagcaguucaagauugcagugagcuaugaucacgccacugcacuccaaccugggcugcagaaugagacccugucucagaaaauuaaaaauaaauuaaaaauaaauuuuaaaaaagaacuuccuuuuaaaugucuuguaguacacaucugcugguaauuaauucuauguuuuauuuguaugagggaguguauuuuuaucaacuuccguuauggccagaauuguguccccccucccaaaauuccuauguugaagucuuaacccucaguaccucaaagugugacgacuauauuuagagauaagaccuuuaaagagauaauuaaguuaaaaugaggccauuagggugaacccuaauccauuguaacugauauccuuuuaagagacacaccaggguacacacacacaggaaaauaccacauaagggcaaagcaagaagguggccaucuguaagccaaggagagagaggccucagaagaaaugaaaccugcuaauacuuugauguuggauuucuggcuuccagaacugugagaaaauuaacuucuguuguuuaagccacccagacugguauuuuguuauggcagcccuagaaaacuguacaccuuguuuuugagauguucucugggcacagauuucuugguugacagggauuuuuuuuuuccucuuucuuuuaauacuuuuaagaugugguuccauuuucuuuuggcuuguauaguuucuguugaggucugcuauauucauguagcuuuguuuuggggugaguggguugguugguugguugauauaccauguucuuuuuucuccugaggcuuucaaaauauucucuuuaucuuuaguuuucaaccauuugaugauaauguaccuaguuguguuuuucuguauaucuaucuuguuuggaauucucugagccccugcucuggaucuguguuuuguugucuuucauuaauuuuggaaaauucuuggccauuaucucuucagauauaucuucugcccacuucucucuucuccuuuguaacuaccauuauguauuuguuagaucauuugauauugucccauaucucuuggauuucuguuuuguuuuguuuucuauauuuucuuauuauacuugaaguuuucuguuauuaguuuggauaauuuauauugaucuauacuuaaguucacuuucuuuuugugugugugucauaauuuuuuauuaaauguuaaauagucuaaguaaaaagaacaguggaaaccaagguaaauaaaacuuaugucuggaaauauacuuuccucuucuucugucaggccauuagcauuggggacugaaucaaauaacucacuaauugagcuggguuugggcuucuuuccacucuaguuaccuucauggugccacaggccuugagcuuuucagugguggauugccacuuucauacguuuaaugugagcucuguggugccgauguuucuguuucaugcuucucucucagcuuucagcauguccuucaugccugcaccgcagagggccucucuccaugcucuuguucuucucuaagcaguagacuguucuuguuacucagugaagacucagggucgggcaggaguggcuucuucauuuuccugcuccagucuuggucuugguacuucugucccacccccagugacagacaacaucuccccccuacucagcacaggucuagacugucggcugauuuccuaccccuuccccaguagcagcagacuucuaguuugaauccauucauaauuugggguccuacuggacucccugucuccuuccuggcaacaguuugcuuuugccuaaugucagcacaagagguaggguagauuuuguaccaauucucuagccuaggaauagaggccaugaagguugcugcccuacccccagaagcacacagcuuuucccuuguucuaaaauguugagcauggaaaauuuggccuuaugucuucucacuuccgggcuuucuugaugucaagcucccugucauucuguguccauguugugauugaagaaagcaaucuuaaacaugcauauuuuaggagucacaaaaaauuauuugcagaggauuccagaagaaaguuuccucugugaaaaccuucucuuaccauuuuuuacauuauauauaauuucuauuuuuguccccaggcuuuuuucuuuauugugugugauuguaucaaauuaauuuuaaugaaauauuucaaacauuuggaaaaauauggagauuaauauaacauuaccuuuauacccagaauuaacaaauauuacuuugucuuaucuucuucagauccuuuuuaaugcuaaauauaguaugauauugugauauaauaagaaauacacauuuggucucggucccuaguuccuuauacacagcuccugaaacucuuggaauccccugagugaugcguguuuguuuuuuuaaugcuaauagaugacugguggcugggagcucuggauggagacugguuaccaagggaaccaacccugugauagaugguugggacucuccagcccacaccccagccucuagagagaggaggggagcugcagguugaguugauugcccguggccaaugauguaauuaaucaugccuacuuaaugaaucuuccguaacacucuaaaggauaguguccagauggguuccagauagccagccgaacacacggaggugcuggaggugcccagagaggucacggaagcuccacaccccucuccaugugccuugcccugugcaucucuucaucugccgguucauuuguguuauccuuugaaauauccuuuguaauaaauggguaaacaugaguaaaguguuuccccaagucccauaagccauucuaucaaauuaaccuaauccgaggaagagauccugagaacuccgguuuauagcuggucagucagaagcacaggucacaaccugugauuggcaucugaagcuggaggguggauacugugggacugagcccuuaaucugugaaguccgacacugucuccagguaacuagugucagaauuaaauucuaggacacccgguuggcgucugcuggagaaucugggucaggagaguugugccgacucugugagauuaggaaaaacacuuuguuuuuuccugccucuaauaauaauuaaagucuucuuuguaucucuucucagcuguauuuuucuuuuuucaacuacaguggcacagccaccauccuaaauuggugugcauuuuuacaguccauauuuuuagcguuuuaauacauauauguuuccauaaacaauguacaauacuguugagugugauauaaauuuaaaauauaucgucucauacuacuuaggcugucaguucauuauuacuuacugaacucaggcccucuagucauuugauaauagaagaaaacauauucuugacauuuuucagagagggugauucuuagaccauuuuuuuaggggccuaagcccuaaagaagccuucuuuaaaggaaauagauugagguaaugucaagguggaacacaauuaugguacgaagugucuugacccagcacuaagaaaaagguuuuauuaaauucaggaguuuuuuaaauugcugcgcaauagaaauacuuauuuuuggaguguggauaauuugauacauucauaugcuguguaaauauaaauaagaauaauugggauaucugucacccuaaauacuuuccuuucuuaaugcuaggaaccuugaaauucucuucuaaucuucauacaauguacaacagauuaacauuaacuguagucacccuauugaucuguggaacacuaggucuuacuucuaucuaacuauauuuuaacccacuaaucagccucucuucagcacgccccaacccccuuccuggccucucaaguucaguuuuagauuucagcaucuucucuguuuacuuuaggaugcucccguaucugaccacuguuacuuagcuuucagaaucgccgaucacugaaauuccagguccagggguucugcacugcgcuuagaauuucuccucauguauaagaugugcugguugcaccgccaagcccuguugccgucugugggacaggaagccuuguuagugccuccaugaauccagcacugacauuagcucacguagaacuaacaucuacucagggaguugcguuaguggcucuuaagaaacuccaugaaaauugugagaaaacuucaaugagaacguuuuugacaagucgccuuucccuuguauauaaaugcgaaccguuuuucauuuucaaaauuucaaacuuuuucauagaacucaaggauuugaguccugcuuccuuugagagggguaacagugaguuuuacauaaacacuguguaugauuuuaaaaggcaguacugaacaugugcuacacauuaauuccuuaguuucgaaagaugcgacggagugggaaaguucgauauccacaggugcagauauuggaaagaccacacucagguguaugaucuuucucauagcugcaagugacuguguucagcuuuccaaugaggugaggaaacauuuaugggccuccuauggcucucuuauucauucaccacugugcuguguaacacaauuucccugcaacaauaaacuucaacuuugcaauuugucaccagugcaauggcucauguaguuauaaagugaacguggugaccaauuuggggcguaauauuguucugcagucaaaguauccuaauuugaagaaauuuuauguaucgugauuuuacaccaacuggccaaagucagauagucugauuaaauagauuugguuuuggcuaacuauauguaguuaauucuacacacuuuaaauauuuugguuugcagguauuuuuugaaggcuuaaguauuugguuucuguuucuuuggguuuccugucuguagauucuaccaagcguauguuguugaaauaaugaauucagggccaccuuaccccuagcugcaaucuugucaaguuccagcagcugaguaaacuugggucaggucagauuugagacacccuaugaccaagaagauauuauuucuaaauaucuuguauacauugaagaacagccauuauuuuaucucuucaagguaauuuucuuaucuaguucauguuauguuuuuuacuucuuuugaauuauauaaaauuggaaguuauauuuauaauauuguuguaaugugaggccaagggggagcacacaucagaagauggaauaagcaagcagaagcucggaucugagucucacaguacuccagaugcagugagugguucuggagcuguacuucucaaagaggguggcagcucucagagaggguggggcccucagaaucaccagaagaacuguguucucuugcauucccauccccauaauucuaauaaucuagagaaaaugaagagagaaaaaauaaggugaagccaggagugagcucgcaggcauugucagagauuuaauuauugucaugugcuacauaacaauauuucagucgaugacggaccccauguuccacagugcucccguaagaugauaagaccauauuuuuacuguaccuugucuauguuuagauauguuuggauccagaaauaccacuguguuccaguugccuacaguacguaguacagucacaugcuguacagguuuguagccuaggagcaauaggcuguaccagacacccucgguguguagcagcuauaccaccuaggucuguguaagucagucugugauguucccacaacaagaccuccugacgaugcauuucucagaauguauccccaccauuaagugacaugucuguaguaugcaguuuauaguaccccacgauauuaaaacagaaacagaaaaagaaauuccucccucauggguccucauaaagaaucugaucguaagcaacaucuucagcauccuuccauauguacagccgugagguucagaagacuucuuuuuuuaagaaacaucucagcaauauaauaaggccaaaguucaucucauaaaaaccguuuucuaggagaccguaaauauugcuacucaaauaucuaauauauuauuuaauauugggaauaaauuuucaagucuuuggaaagauuuaggcaguacucucuaaauauuaguugucucaaccauuuuuuuauacauuaagcagcaauauguuuaggaucuagucuuugacagauaccagaaugcagcuauucaguguucaaguauagagucauacacuuuaaaaguuaaucgaaaaaggaaaaaaaaaauuagccaaguaugguggugcaugccugugguccuagcuacuuggguggcugaagugggagggucacuugagcccagcagguugaggcugcagugagccaagauagcaccacugcccuccagccugagccacagagcgagacccugucucaaaaaaagaaaaagaaaaagaaaaaaaaguuagucaaucugccccuuccccuuaaugguggcugaggaaucagcuggcauggucagugaggcuggugccaaguguucaacugauauagccaaaaugacuggcaggacaaaggcacuggguuugaccagcaugguuggcauauuugguaguggagcugguccucaggaucaugcccugggcauuuggcaggaccauggauucugcuagcauagcugguguguuugucaugcugagaccaagaagccagcccacauggccaacauuuuugggaggcgagggcugaggauucagcuagcaugaguggaaauagcaggccagggccaagaaaguggcccacaugguugagagacugguuacauaccaggagaucaagcaaaugaguaaauauauuggagcuaauauauugaggauaguguguuuguuauuauaggagauaagaguaccagauauagaaagaguaaagacaaauccuaucguauuggauuguuuuuagagguauugauaugaauucaugguuuuuaacagauaaauagauuuagauuucucuguguguauguguguuuauauauguguauauguguauguauacacauauacacauguauguauuuucuuuuuuuuuuuuuuuugagauggaguuucgcucuuguugcccaggcugaagugcaauggcacgaucuuggcucaccacaaccuccaccucccagguucaagugauucuccugccucagccucccgaguaacugaaucggauuacaggcaugcgccaccaugcccggcuaauuuuguauuuuuaguagagacaggguuccuccauguuggucaggcuggucuugagcuccugaccucaggugacccacccaccuuggcuucccaaagcauguauguauuuucuaaccuuaucugcugaagggaccuggaagcagugacacccaguaacagagagcucacuuacuacucaaauguuggucuagaugccuuuucccaccagaaggaaccagagcucuuuggggaaaugacugagucuagggcugugugugggaaagcacgugauaaucccagaacaguuuuauaccagaaaguaaggaagcauuccaagagugguggggauguaucaaaacaacauggggaaaaucuugaggaauucgagcaucaaaauaaguaaagauaguaacagauuauaacaacuaauauagagagaguauugccuaaaucuuuccaaagacuugaaaauuuauuuccuauaucaaauaauacauuagguuucugaguacuugggcagcaauauuuaauuuagggucuccuagaaaaugguuucuaugaaaugaacuuugacauuaugauauugcugagauuuuuuuuaaaaaagaaaucucugaaccucauggcuauauauaugaaaggaugcugaagauguugcuuacaauuagacuuuuuaugaggacccagggggagaaauuucuuucagaucucuggacuagaaauaaucaauauucuauugaauaaaauagaaaucuuugagucugugaugguauaaagaagugaaugaaugaaugaaugaaugaaugaacaaguaaaugggggagaaaggaaaacuccacccugugguugaaugccagcauaauguagacggaauuauggaauuagagaaucugcauuuggcaccauuauaguagugacugauuuaggcagguaucaucaaugaaugugaaaacaccaggugaagguugacuaagaacagacuauuugcauagacugaaaguaucucgucaaacacacaaaaauguaugucaguuaauuagcacaaaguauuuauaguuaauuuacauuggaaaaaucugacacauaccaucuaaaccaagugauuaagguuagcaucuccaguagugggacacgucaaugugugccucuucaucauaggcacagagaagaacacaggugguacucuugccaaacaaucaccugaauuuaacaccaggaaacauacauagagugauauagauagagauacagauaacgauacagauagagacagauguguauacacauguauauuuaucaagauagagaauuaauuaaugaaugauaugacaaauguaaaauguuagcaguuaaggaauccaggugaaauuuauaccagaauagacuuaaagauuucuguuuuauucagugaguuauaauauuuuauaaucauuuauuucaaugcucaaauucuccaagauguuucccgcauccuucuaauauaugcccacuacucuuggaaaacuuccuuacuuucugguauaagauguucuuuugaaauuauuuuaaaauaaaaaguuuuuaaaaacuuaaaucaguaaacuaggauuaagauuuuaauccucuugugaaaauugagaggcacaggaguauugaaaauacaaguauuagccuaaauagccaaccccaagguaacacccacaggcagccgcaaaauggugccguggcagguggagcuuugugugggcugagucgguguuaccccaugagcagugcugccaguuacaccaagcuccacccaucgcugcaccauuacaagagguaaauacguuugaaugcgacauccauuucauuaccauuacaguguuuaauuguaaacauuacaagaaggcagguuuaaguuuaacagaaagugaaacuuccuagaucucuccacaaaaagaaugggcagccauauuugaaauaaguccuuuugacuggagagaagcuacucaguuggguuauaaaaaggauucaggauugcaagaugauuugagucagcuuguuucuaagguggugguggugguguuuuucuaacccugauugucuauuaucuaguauaacagggauguauaauagcccccuccucccaguuuuaggacaguauuugaaugugacauccuaacuugaacuccauaaaaaauaaauuagguaaaauaguugaaaaggggaagaaaggaggaaugaaaaaugaacaauuguuuugaaaaggcaguuuucauaggauaaagacuugccuaaacgaugaggaggcccuuuuuuuuuuuuuuuuuuuuuuucauuuuucuaguuccacuuaggauagaccaagauaauauauuaaauuacaaaagaaauauuuuaguuaaacauagggaacagcugucugacuauaaaacuaagcaacauggaaaaaauucaaaagaauguuguagaauuuccuucuggagaguuuuaaaaacuaagguugacuccccaucacuuagugcccaucccaaccucaccauacuugucaauauuguacccauuugauacagaucaucucauacaauuagccauauggauuauauaugaauaugagacauguauaaccuguauguugaaugauugaauauuuuugaaagugcagcuuucguuuuuaaaaccuuugucgcccaggaauuuuagauaaagccaacguuuuuggcucuaaaauugaacuuugagccgggcacaguggcucacacuuguaaucccagcacuuugggaggcugaggcaggcagaucaccugaggucaggauuucgagaccagccuggccaaugugggaaaauccugucucuacuaaaaguacaaaaauuaaccuggcgugguggugggcaccuguaaucucagcuacuugggaggcugaggcaggagaauagcuugaacccaggaggcagagguugcgugagcugagauugcaccauugcacuccagccugggagacaagagcgaaacucugucucaaaaaauaauaauaauaauaaaauaaaacugagccuuuguagcaaugggugguuguuuuaagccuuaauaaagaaauguguuuuaauuccagauauuaaccaaaaggcaccuaacauauauugcuaaaacuacccccaauucagcaggcauagagacauaaaacacuaaacuuaagagaacaaaaugguaaauaggacuuuaucaaacuuuaaacuucuauucaucaacacugggaaaaaauauucacuaaauacauacauacacacacaaaaacacauacacacaugacaaaguacuuguauugagaagauauuuuaaaagucaguaacaaaagauauuuaauagauauuuaguaucuauuagauacuuaaaacaacauaaguuuuuaaaugggcagaagacuugaacagacucuccaaauauacaaaguaagcacaugaauaaguguuuaugcaaaugaaagccacaaagagauaguacuacaguaucacuaaaauagcuaaaauuaacaaaacugacaguaccaaaugcucgugaagauauggagcaacuggaacucugauacacugugaugagaggguaaaauggcauaauauuuuagaaaacugagaagcaguuucuuauagauguacaucuauccuguaacccagggauccuauucuuacucaaaagaaaugaaagcauauguccacaaaaagacuuguacaagaguguucauagcagcuuuacuggaaaaaguccaaaaguggaaacaacccaaauguccauuaacaggagaauagguauuuuuaaaugaucauauaucauuaauggaauacuacucagcaauagaaaagaaugaacuacuaauacaaacaacugaaucuucagaaacacuguguuaagcaaaagaagccagacacacacaaaaaauuauguacuaaauguauuauuccauuuauaugacauucaggaacagaauaaauuauggugguaaaaauuagaacagugauuacuuauaggaauugacugaaagaggauaaaacagaaccuucugggguaaugaaaauguccuauauuuugacuggggagauggccauguggguagauaaauucaucaaaauucauucaguuguacaccuaaagaucuguacauuuuguuauauggcaacguuuaaaaaaaauacuccgccuccagucuccuuuugaacuguuugaaguaguacaacugauaggcagauucugcuaaaaagcuaaaaauauaauuuuucucuagaguacaaauuucuuuuuuuuuuccaccguaaaugccagccucccaucagaggcugaaccacaguggaaucaacuuucaucagccagccccucuguggcucacugagcuuuggauuccaggucccuuucccagcacuuagucccauuuuuaauuuucaggaaguauuguuccaaaacuuggcucagacuuauccucuccuuggauuccuuucuccauuuguuuucucgguuuugcucacuuacucuuuaacuugcaccccucuuuuuccaaggugguggauuaggggguguuaaugcuggggcaguguuaggcacagaaccuaggagucaucucccucacuccgggaccgcaucaaucaucagucacagacaugacaguucauuuuucccuccugaacgcgccugcacagauggguguaucgcucaaguagccaaauggauguagcuguugggggacagggccugaggggcagcagggagagaaaagaacaaagaaagaaagaagaaugguucuuuguggggcagcaaacuuucuucugguucccagccugaauguuucugaucugguuuucuucuuuuugugauguuugaacuuguuuccucaacucagaugcugaacucuuguccaaaaaaccuaagggcagcauagugugagagacugugggaggcaaguccagcaauccagcaaaaagaauugcagaacugugaagauaaauguguguccguaucaggacugcgcuggagaacgggaagagagggguuggggugcuaagacugugugugugugugugugugugugugugugugugucuugacaaacugaugagaaacacuauugaguaguuuucuccucucugcucucacacacagucuggcacuuucuucuucugugacagcugccauuaacuuuuuaaugcgaagacaaggguaucuugccaauuggauguugaaaucucuggcaaggaaaagcuugcuuuaaaaaaaaaagaggcagggaauauggggaagguugggcagacauaccaaagguccgggggaagacaggguacuaaguuggaccuuacaaugcagaauggcugcccugcuucugauaaaauccccucaaaugaaguugggaaaagaaagaggaaaugggagugugaguguaagggagauaaggaacucuuuuacgcaguugcaaugacacagauauuaaguauuauuugcaauucacucccgauggaugugagaacuccucauggaguuuugguguauaugugggaccuugugcuaaauguagaauaaucuuguuugugcagaaagagaaggaaagagaaaauauuaggagaccucuguagaccaaaacauuaugauacaaaagauuguuccagucauuuccuuccauagcuuaucucagagaaggggaguucugguguucguggcucgccuaucaggucuuccccucaccucuaaacuacggcagcucuugauccuuauuacugguaccuaccccaaacucaccaggucuaaauaaaacugaacauaaaaacauccuguugugaauucaguucucauguaccuucagcuuugcagcaaagaaugcaaaagccuuuuuuuuuuuuuuuuuuuuuuuuuugagacagaguuucgcuccguugcccaggcuggaguucaguggagcgaucucagcucacugcaaccucccccucccgaguucaagcaauucuccugcccucacccucccgaguagcugggacuacaggugugcaccaugacgcccagcuaauuuuuguauuuuuaguaagagacaggguuucaccguguuagccaggguggucucgaucucuugaccucacgaucugcccaccucagccucccaaagugcugggauuacaggcgugagccacggugcauggccacaaaagccuuuuuuaaucuaguuuuuauuagcuuggccucacacuggacucuuuaaaaaagaguccuaaaauaugaauauggaauauuauaugaaauauuuuauaaaaauauuuuauaaaaagcucagcauuuauggagaucuuaguguauuuuagcugcccuaauugcuuuuuuccuuuguguugaacguauucccaugggagaagaaaguucacccuccugagucccugagcuccugcaggaagaauuauuuaccauccuggaauuuuaaugagucuugacaauuacuguaauccaggucauugaacgcgggucugucaucgccagugucaucuuccagagaugaugcucccccaacuaagcugagaagaaaaugaguccuugugaaugccaaagagacaugaaugugaccugcaccaaugcugcaaaccuaaagccagugggacuagaaacuguggaaaugacagucuuccgguccggucagagcaucugaaauaaauugcccacaguuuucuuccaaacuuuuaaauuguuuacaaaagguuuggugguaccaaucuuacugagacggccuagaaauacaaguaacguaaauuucuuacagagugucuacaaugcugcaugccagaggcacucagcacaccugaaggaugugaagcuccuguaggaacaguagcucuguacaacaguaaucucuagacaaccaacguaaauuuaaacaaaaaggugugagaccacacacccuucuuccaguggggcauaacugcccagguguaaaaucagacaggaacccugaaauaugaaccaucuccaguuugcagacagacauugcugccauucuccacuugacuccccugugcccaugccugaaagccccgcuuccccuagagaggugggggcaguguggccacagccucucuccccgcaguaccaccuggucccaaaagucccagcccuccacggcagcacuagugaggccuccuugcuguugcugcuguuacucccugagccuucuagagaaucuccugcaugcccugugagaaugugcugaugcuggggccacugccacagucgcggguuuucucccagacccccuucuggugccaaguaggaaagaugggaccaggcuaauucuguugccacugagacaagugaagacauauccugaugucuggaguuggaucucagaaggcgccuuccaguguauaaacugauaugaaauggugguuagguccuguggcacugcacaccaacacuguauuaccuugcucgggacaccguaacaaaauaccacagaccgcguggcuuaagcaacguaaauugauuuccucacaguucuggaggcuggaaguccgagaucaaggggucggcaggguugguuucuccugaggcccccucuccuugguguauacauggcugccugcucgcuguguccucacguggucuauccucucucccugugcuccccagugucuuucuguauguccagauuuccuccuguuacaaagauaccagucauacuggauuuggaaccacccugccugccucauuuuaacuuaaucgccucuuuaaaggcccugucuccaaaugcagucacaucauucugagguucuggugauuuaggcuuccaccuaugaauuugguggggacacagcucagcccaccacagacauuauggguaaaauaggcucauggcaacaacuuccgaaccuaacuacugcuuggguaauuguuaaggguuucaaaauaacugacugucaaacaagcucuggaaacugcauuccaaauaaacuguggggcucugccuguuaaaagguaggagguccuggcgaaucuguuauguccaguaauuacugaauacucccuuaggggccauucagggucugcugguuacuucaauaaagaaugcuguaagaaaagcacugagucucuggcccuuucuaaaagaguuguguaagagacauaaagccauaaaauaugaaguaggugcuuguuuagcgacugaaugaaaucaggaauuuuccggagauaagauuaugguauucuucuacacuguauaaaugcuaucuuccugcuuuguuuaccucuuuuuauacaaaagaccaccuaggcacaaaaggaagugccccuaccuagcauagucugaacgagugaaagagagucuuuaauuuuaacacuaaagauaacagaucuugcuguaaagugcaaugaugcuuaauagcccuaaagaucagguugugauugaugggauuucucaugguguucuuguuaaagauaaauaguaguuuuuaauguuaucagacuggaaacaucuuacucuuuucuaauguaagcucuaaagcaaacuucggacacuaacaucuuauugccaacuuaacagaaaagugugaugggauauuggauaaggcuccgaccugcgugccugaaauuucagugguucgguuuguuccuuugaaugaggcaucucucugaggcacugccuuucuaagugcaaguuuucuaggaagggcaguguguugucaguuucuccuuagcgugcccaguguaucuaggaugauacaaacaggaagagacugggaaaaggaggguucaaaaaagggagggacccaauggccagauuaaaaaccagcuuaaccucuucauuguaucccaggccugaugauugagcaucuuuauucuuaggauucuccaacuuuaggcuaccugauacaucuagagcagcgguccccaacguuuucggcaccggggacugguuucacagaaggcaguuuuuccacagacaggggaguggcagggaagggaugguuucaggauaauugaagcacauuacauuuauugugcacuuuauuucuguuauuauuccauuguaauauauaaugaaauaauuauacaauucaccauaauguagaauccaugggagcccagagcuuguuuuccugcaacuagacugucccauuugggagugaugggagacagugauagauuaucaggcauuagauucucauaaggagcacgcggccuagaucccucgcgugcgugguucacaauaggguuugcgcucauaugagaaucuaaugccucagcugaucugacaagagacggaacucaggcaguaaugcacgcaauggagagcggcuguaaauauagaugaagcuuugcuuccuggcuagcccuucaccuccugcuguguggcccaguuccuaacagggccuggaccaguacacggacccaguacugggaguuggagacucccgaucuacaguaugugagaaaucacaucaaccuuuuacaaggauugagccuaaauuugaaccaaaaaauacuuacuucuaaaaguaaguaagccacagauagaugucagaauacaacuagcaagaagguaaagacucauggaaaagauggaguaaugaguuuucuuagcacuguaugauacgacagaaaagcugcagggggaaggcuucacgaaagcaaaaaacuccaacuagaaauagccugcaggggccaggugcagcgacucacgccuguaaucccagcacuuugggaggccaagguggguggaucacuugaggucaggaguucaaggucagccuggccaacauggugaaacccaucucuacuaaaaauacaaaaauuagcccagcauuguguugcacaccuguagucccagcuacuuggaaggcugaggcaggagaaucgcuagaacccgggagguggagguugcagugagcugagaucaugccacugcacuccagccugggcaacagagcaagaccccaucaaaaaagaaagacagaaaaagagagagagaggaaaggaaaggaggaagaaagaaaggagaaaagaaaggaaagaaagagccugcaggcucucagggaucacuguucuacuguuauuuuauaaggcaaaccagggaugagcuguauuuagccacagauuauuaaaucuggaaagaauuuagaaaucaucuaaucuccccuuuauacacauaaugaagcugaggacagagaggcucaagaugguaaagcuaaguggcagaguuagaacuagacauuucuuccauuucagaccuuuucccacuacuucccugugcaaccuugggaagaaaguccucuuagccugucagaggcaucucugucuguaacuguucucccucacgaauguuaacuccucugcaggaugccacagggacauuugccuucuagugcaagcagaguguuucaggaaugcauaacagcagauagauacaugucugugcuagguguugugcacuaaccaagcacuauggauuucuugcagggagaaaaaggaagaguagauaacuaacaauaucuuauuaagagucuccugcagggcugugacuccacgcagcucucuucucccuguccugcuggugggagccuugagcccagcucuugagcacugucugguguggcacccugcaggcugccagcagcugucauacgggcauugggaucguuggaaagugcugcaacaugggaguagcuggggcagcuguugauugggagcagccuccacgggcuguguucagugggugauuccaugccuuuggucuguguggagcucacucucucccuuggcuccuucggaggggugggcccaccgcccucuccagcuguuuucucagaaagagaggcaaagaagaaggaccuggcgguccuuccagagugcuugcuguggugugggcuucgccuccccuccgugugggaauaaacugugugaagccauguggguccuggagcuccguggcuucacccacacuuucugggggaacugcacucacaaguauggagagccuuaagcauucguugagccagacuggacuggaaacgucccgggagucccucauucucacccuucuucaccuaaguaaacacacaacaaaauucucugagcuuuagggggcugugggaauauuuuucuuucaaccccaaccuuccccaagagcuuucaaaucacauaaaguacuguuuucccuuuagcaauccaaaacuaguaacaugcaacuccaggccccaccccaccccacccccauccuccucaaugccagccaagucagacacaacuugccaugucccuguggugugccaugaacugggcagguaugccccggggucacucagagcagcccacgggacccuagagcucuggcagucguggaaccccuuccauggcccuugugaguuacggggccaggaguuuguaucacaucaaagggucauuucgucaucucacaagggagucaggagauaccacccagagaauguaucagauuuauacuaaaaaaaaaaaaaauccagcaagauccauagcucucugugggagccauuccaguuucucccugucacaguggcccuagaaucagauaccacgcacuggaaauagcagagugcaacccuggacguagagggugcauugagcacgugccacuguggcuggggggaaacuuccuucucucuuccugccuggccugagagauugccuggacguggaucaggcuuugugcugguuuagcacuuaaaucuuaacugcaacaaagccuuguucuuaccacccugacaguuucagcauuagguuucuuauuaguuguuuggguuugggguuuuuuuuguuuuuuuuuuuucuucaucuucucccuuuugacacuuuucauuucugagagccaaaccaaauacgcuaggcggacuagcuaaccuggcugugucugcgauucccagagcccugcugcugcucugaugggucccuuugguaaggagggaaauuuuucuccauuuuuauaacgacgagcccuuaauuugaacgucucuguucacuucaguuaauagauuuguaagaaauaaugugagauauuaccaaaucagcuuagacaaccagauuaaaaaucugccucacugggaaaucugcuucuuuguuuagaauacuccacacuuucucaagccugcaucugcaaaucuuuggccugauaaagacuuccagaguccauccguccaucucuugcuucaggacuguacuucguccaagcauuccacacagaaggguaacuggcuuguucuuugagugggauaccacgucacaguuccuuugguguuccagggacauuucuauacaagagaugguccccuguuuucuuaguguauagaggcucaucagaccaauguaaaucuccuguugaguuuuauuuuuuuaauucccauuuuugucuuuuauagucauguuuucuguucucuugccaaacucccgugcuauucagcucccuucccagcuuguucagaaaagguauaacacccacaucaagauaaaaccugcugagcaugguggcacacacccguagucccagcugcucaggaggcugaggcaggaggaucguuuaaggccaagaguucaagacccaccugagcaacacagcgagacccuuucucuaaaaaauuagagagguauaacuuuucaggaaagaggauaaucuggaaaguugcuguaggcacagacuaucacguagaaaaaacugaaauuaucucagcuagggaagaaugcuuuaggcaggaagacagccagaauuuuagaagugucuagacauaaguaaguuagaaauuaagauaugaguauguuggugacaucugcgaauacaaaauauaaucaucagaaagcaaacauuuguucuggauuuuguccagauaacgguuuaaaacugaaguguuguaucuauuguagugcgugguuccagcuccugcuguacaugaggagguuaauuuggagugacagguguuagcaacacguguuucuugguccuguagauugccacugacccaauucauuuguccaccuuugcugggguuacuuggucucucaguuguugacuuucacaaaauaaugguugacucuaaccuugcaaagaauaauaaacaacugugaguggugacagcuggaagaggucugacagcuagcaagaccagauuccuuguaaagcuuuccucucagguaggggagacuuccucuuuuucuccauggagagcuugugcaccuggaugcaguagagccugauccacuaaccacuggccaggcgugauagauacauauuaaguuuuccuacaacagauagaucuaucagucuaaccuguguaccuggcccuguaccucuugagaccucagcugucuuacuuguaagguuagagaaugggacuaguaguuccuguagcucccuuccgggcugaugagucuaaauuucagaauuggccuguuuuggguguagcauuuguaggucucguuguuccauuguuggguauuugccugagcugcaggucggggauaggggacaggguagaaaacuaaaugauaauuuauguuuuuauauagauucacuagaaaucuuaacuguuuuauuucuuuuagggcugggggcugccagugcaguugcagaguuuucagugccauagcugggaagcagagaagcucuugauuuguuuuuguuuuguuuuuaaccuuugaaaaugaauggcagaaauaugugaugaccuaacauuaaaaaaucuaggccaagcacaguggcuccccacuauaaucccagcacuuugggaagccaaggugggaggauugcuugaggccaggaguucaagaccagucugggcaacauagugagaccuccucucuacaaaaaaaauuuaaaauuaguggggugugcuggcauuucgcuguagucccagccacucgggaagcugaggugagagaaucacuucagcccaagagguagagauugcagugagccgugaucacaccacugcacuccagccugggcaacagaguguaacccugucucaaaagaaaaaaaaaaagagaagagaaaaggaaggaagggagaaagaaaaggaaaaaaggaaggaagggaaggagggaggaaggaagauaaaucuagcuacccuaaggcauauggcuagcauucacucaguaaauacuuaaugaacacuuauuacaugccaggcauaaaguguuguugauaauacaagaaaguaauuacauacuugaguuucccucccauccagggaaucucaucuucuaucaugagggaaagaaaggaggaagucccuuuauaucaccacuugaaucuggaggagaugacugugaacuaucaaauuguuaagcaguggaauuuugacuuuggauagacagacccgaauggagccaaacucuuguuguuuuuuguuuguuuuucugagaaggagucucacucuguugcccaggcuggagugcaguggugcgaucucagcucacugcaaccuccgccuccuggguucaagcaguucuccugccucagcuuccugaguagcuaggauuacaggcacgcaccaccaugcccagcuaauuuuuguauuuuuuuaaguagagacaggguuucaccauguugaucaggcuggucuugaacuccugaccucgugauccacccaccuuggccucccaaagugcugggauuacaggugugagccacugcgcccggcccaaacucucguuuuuauuaugccauuuuguucaaaguuaguuaugggagagcaguaacaucuuauuuacuuuuggucuaagcaacagccuuuccuuccuguaaaaacaaauucauacauugccuggcaagggaguucaucacaaaguaggaaggggagcugggugugauggugcgcacccguagucccggcuacucagcggucuaaggcaggaagaucacuugagcccaggaguuccaggcugcagugagcugugaucucgccaccgcacuccagccugggggacagagugagacucuaucucaaaaaaaaaaaaaaaaaaaaggacagggagggagaaggagaaguccccacagcagccucacagccauuaccacuuccggcccacuugcacagucucugcaagugcagacuugaaaggaaagaggacuuuggaguuaacuuuaaugagugggaaauaaacauaggauaaauucuucaagagcaauuuuaguuuucccugguacuaagugcuaaagggauucuguagagucaagaagugaccagaugccuguagaaaaauagaucccugggcaaaaaagauugagguuuagagggauuguagaggguuagagggauuccagaucccucugacuguguaaguuuuaugucuuauucaauagaugcucuuacggcaaaauacauuuccauuuauuccaguugugugaaauuccaaacuaggaaguuauuuuaugucuucguaucuccuaagaagccugcagauucaaguuaggggcuugugggccagaccuggccaggacgagcaccauuuccacuugaucugucagcuccaaaaggcuccgaacaucaugccagauuacagcucagaccucauggccugugacacauccugggacuuagcuguuagaaccucaaguuuagauucuugucugcuuaaaccaaacuaggcauuucugaauaauuuccugcccuccaccaaaccaucugcagaaaggaauuaaucugagucacugccaaccacagaggaauucauucacugaccccucuuguaaccgucccuucuuuauacccaucaauacauccucccuuucaccucaugcuuugugacuaugaauagaguuguuuaccuugaaaucaggccaaguccacagaacuuuuaacuguauuuucucuuuuacaaauuuauuucacggaguucugguagcucucucuaacaucuuuacuagagagaaaauguuguuucuguucuaaaaucaugacuugugcugagcgguaaauguuuggggcagucucccugaaucaagcagcccgccccucagcucugcuucucuuucuccauucagcccccucgcauuccuuauucuuuagacugucagcuuguucucuggcaguuauccuaacacucaaagagggaagggggccugagugguuuucccuguagccagucguaaccaugcuuuugucugccauaugcuuggagagccucaucucugaaauguucccgcucugcugagcuuccuccguucguuucuucccugcacagugguagggugaggcauucuccccuucccucugcugcauacgcuuccagccuguguugcuuugagcauucagauugaguugcucuugcauuugugauucuuggcucaagucccucuagaaaucauauuacuacucugaguucagggagggcuggaacagcuacuaagaacagaaugcauuuuaauaacauucaacacacaaaaaagccagagaauuucugccagaggccaccuucguauccuauacuugucccguauuccaucccuuaagaacuuuaaacacaguggagugcuacacuguaugguuuaugugcccugcugucuaccaaagggccuguaucaucagauuguuuugguuuggacaugcuucaaauuugaacuuaaauagcucuuuagaacauuaucgaggccuuuccccagaauuaauaucuauuccuuuauuucauucaccauuuucagauugucugcuacgugcaggccuuuuguuacgaggcaauauugguauacaaaaaagaauucaccaaggagcuugaagaacaguuggggaauuaaacauaaaaccaacuauugaaaggggacaaaaugaauacuguagcaguuuacacuucuaaccagggauggcauuacagagaaaaggggcucaaccgugaaggauaagaaagauagagaagaaagauguguaggaaguaagauuguccacauucuagaaugagaggaaaggaaaagcaaagacagggaauggcagguauguaccaggagaugaaauugaagcaguagcucccaugccaaaaagcuuagucuuuuauuuuguaggaaggaaaucauuuaagauguuggaagaggaggagggaacuguuccagccuauuuuagaaagauuacucuuacaccaggguugaaguaguuaugaagcuauugcaagaugguagaacaugagagcuugaauuaggauuguuaacaaggauaucggaaaugaaaaaacuaggcuagaugugguggcucacaccuguaauuucaacauuaugggaggcugaagugggaggauugcuuaaggccaggaguugaagagcagccugggcaacauagugagaugucaucucuuuaaaaaaaaaaaaaaggcugggcaaggugacucaugccuguaaucccagcacuuugggaggccgagguggguggaucacacggucaggagaucgagaccauccuggcuaacacagugaaaccccgucucuacuaaaaauauuuuaaaaauuagccuggggccaccuguggucccagcuacucaggaggcugaggcaggagaauggcaugaacccgggaggcagagauugcaaugagcugagaucacgccacuacacuccagccagggcgacggagcaagacuccaucucaaaaaaaaaaaaaaacuuagccaggcgugguggcacucuccuguagcccuagcuacucgggaagcugaugcaggaggaucacuugaggccaggaguuagagguuacagugagcuaugaucacuccacugaacuccagccugggcaacagagcaagacucuuucucuucaaaagaaaaaaaagaaagaaaaaacuaaauuagaagaaacaugaucuggaaagagcauuaauaggaaacucacagaagaaguggccaauaaauauauauuuuuuaauguuuuaccccaguuuuuggcuucacuacagaugggaagaacuacgaaugaaaacagugcugucauacugggaagguugggauugguugguuuguuggaguccccaguauguucagagagugggaaaauggcacccuuauuucuugcuuaugggcugaauaucaguacagcuauucuagaauggucugguuacuugucaaaagcuuuacacaggucuauacccuuugacucgggaauuuuaaguagaaaaucauagacaugcaaagauuuauguaugggaaaauguaauacauuaauauuuauaguaaugaaaacgagaacaaacuaaaugucuauuggaguuaaauaaauuacaauauauuaauaaaauggauuacaaugcagcccauuauaaauuauuuuagaagaauauuuuaucacaugaaaagcuguuuaauuauugggugaaaagaacaauucaguaaauaguaugaacaguaugauuugauguguaaagggaacauucaccaagagauguuuaucaggcacuggaaagaugugagucugaaacucaguagaaaaagaagcuagaguuauaauuguguagauccaccuucauaaugguuauguuuagaugagggacauagaagaguuauuaugcuaguuauuauacaugugauauuuucugugauuaaaaaaaaauuuaaagaacaccuaccucaaaagaaauaaauuugaaagaaaguggauuaaauguguuaaucacuaaagcacuuagaauaauacuuggcccauaauaaaugcccaguaaguuaguugcuguuauuaucacccuccccccuuuuaaagcuaaagguaaacacauuucgcuaagcagaggaucuaagagagaacaguggacagucuccuuagaccucaggaaaccccugcacgugugagacugagcagaaagaagaacaacaccaggacagggaagaaauguuggggcaggcagaggagagccagaaacauguggguguugggggccucuagggcagacagccuagcagguguuuucagggucagauuggaucguacaguuagauaauccuuggggguccuugauggguuuuuuucugaaguuuugaaauuauaacuugcauacagaaaaguaaacaaauccuauguauauagcugaauuacacacucauauagcaaauucuuggaacaagcagcagaauguuaccagugccgaagccccuugucauccuccuuccagucacuccucauccuccaaggauaaccugaccucaaacaccacagauuaguucugccuguuuuuaaacuuucuaugccuggaaucauaccauacucuauugugucuggauucugucauucaacaucauguuuacgaauuguaucuguuuuguuauacauauaguucauucauucucauugcucuaugauauuccauuguaugaaugugccacaaauuguuuaucgucuguuuaucauucaguauggacauuuggguuguucccagguuuuaauacucuuaucagugucuucaggugaauuuacauguaccuacaaguccacuuguucagcuuggcauucaacuuuaguagauacugccagauguuuuucuaaagugguuauggccauuuacacucccaccgggaguguaggagaggccaagugguuccacguccuugucagcacuugauacugucugucuuuuuaaauuuuagccauucugguggucauuuagugguaucuccuugugauuuuaacuuguauuuuccugaugacuaaugaguuauccaccuuuuuauaugucuguuaaccauuucaguauacucuuguggucauucaagugucuugccuauuuuucauuauuaacuguuguuacugcuuuauaggaguucuuuauauauuauggauaugcauacaucagauauguaucuucuccuguggacugcccuuucacucucuuaauggugucuuuuaagagacagaaauccggccgggcgcgguggcucacgccuguaaucccagcacuuugggaggccgaggcggguggaucacgaggucaggagaucgagaccauccuggcuaacacggugaaaccccgucucuacuaaaaauacaaaaaacuagccgggcgugguggcgagcgccuguagucccagcuacuuggcugaggcaggaggauggugugaacccgggauguggagcuugcagugagccaagaucgcaccacugcacuccagccugagcgacagagugagacucugucucaauaaaaaaaagagagagagagagagagacagaaauccuuaauuuuaauguagauccaguuuaucaauuuuuucucuuugugauuauugcuuuuuguguucuguuuaagaaaucuuuacauucccuaaagauggucucuuacauuuucuuguaaaugcuuuauuguuuuacccuucacauuuauauauguauucaucaugaauugauuuuuguuaauggcaugagguagaaauccaaauguguuuugcauauagccccaccauuuaucagaaagaccaucuuuucccagugcacagucaaguggccauauacguguaggguuuuuccguguucucuuuucgucccauuggucugugugucugcucucgugccagugcuaugugugugcauugcugccgccuugcagugacagccuucuuccagagaggagcauuuguauagcuuuguucuugguggccgucuuggcuguucugggcucucugcauuuccacuuacucuuuggaaucagcucgucuauucacauacacaccugccaguuuugauauggcuugcaucgacuguauagauuaguugaggcagaauucacaccuuuacagaaaugaggcuuccaauccuuaaucauguuuauuccuccauuuaagacauuuuaacuucuccaaauauuuuaugguuucaauauagaggcuucuguaaucuuucgagagggcaauuucagugaaauagcagaaacuaaauucucaguuauuaaggagagaacucagaaaugcagguaacacauguagacuauucuuuugagaaauuugguuacaggaagagaaaaguugcuacuagcuugugagaugcagauuccaaaagucuuuucaggacgggcaggauucagugcccucagaagccauagugaaaaaccaagggagggguuggaaacagaguucacugaagggacagagacauggagaguuagcucaggagugugggugcuccugaggcguguggaacccugcucgccuggagaagccagguggggucacucugaggcaggacggauccagacuccccgggugcccacguagucaacagcacggagcugucgugagccgugcccuuugcacugagagcagcagcaagcccugcugcccucacgccuguccucauccacaccucuaagccccuggaauacagcacauguuauuuuaacaaagcauguuccauuuucucuaccgaagguguauacuuguacaugugucauuccaacaguccuuuccuccagaguaucuugguuaaaguaagguuugguggaaaggggcuuuuuuuuuuuuuuuaaauaaaaucuugcagugcccaggaggcuugaggaauauuuuguaguagaaauacuauauauggaggaaacuaaggugcugagauaugagacuucgugcuuaaguuauagaaagggcuggcagaauucaugggagcaaacuuguuuugcaguuuagugaaaaucgguuuacucuggaaguguuuuucgauguuuuguuauuguuuguuuuuagauacaagguuuucagcacacgcacagaagauggcaucugcacaucuagggagcugauuggguaaacuucagugcugcccguaauuaugguguuucuaagaaaguaaccaagaagccaguauuuuucacuguaauaguugcaguggugggauuacuugccaguauuagaaaauggagaaugggaaauggaaaaucucauuggauuacuccuccuuacauuacugcguuuggauuuguagucuuaacaaggcaauaaauggaaggggaaagaaggaaucaauucaugguaacuagaauguaaugagcacuuucauuaagucacaauuuaauuuguauucuuucggaaauucuuuucugguuuuaagccuaaaggggccugccuugaggaggugaggaagauaagcaggugugggaggggguguggguagugggcaggggguugaagagagcaagaauaucucgaguaauaccuuuuaggggaaguuucagacacuaaaauacaucuuucccaacuuauccacagaauccguugcaucccaaagccauggaaaaacugccuuuuuucaugugaugcucaugguaaggaaaugcagacgcccccagacgucccccuuacucugggcagucuguugcaagcuccccaguggaugcugaaacuguggaugguacugaagccuauagaugcuguuuucuucuauacauauauaccugagauaaagucuaguuuauaaauuaggcacaguaagagauuaauaauaaaauaggacaguuauaacaauacucggaacagcaugcacuguaaaacuuaugaauuguuuauuucuggaauuuuccauuuaauauuuccagaucgcaguugacugaggguaauugaaaccguggaaagggaaaccauggacaagggggcgccgccguauuuuaguauaaggagguugugaauaauccauuucagguugugcuuucgcaccugugcuguauaacacauugaucuaaguuuuuaguuugcuuucuucacaucgccucucuuuccuaagcaaucuaaaaguuuuaacaacacaugccuguacuccuuugacuucagaaugacuaaagcuuuacaaucaaagucaacaaaauaaaagucgcauuuuaaaaguaaucacgguuacacaagagaaguugauccuugagauucuuucaagccaagaaaaaauagaauggaucaagcgccaaugaaaucugucccugcucagcugugcccacauguaauacugcuuucagauaaaauuugaaccaugccuaaucccuggagaacagagaaaggccucccagauggaaagcaacuccagcuagugaaggaacacuuccuucucuaaacuuuucgauucugugauucccucuauuuuuaaacaccuuuucccaggcauagcauacguuagacccuggaaaagcguagccuuguagucugccucugguuuuuuuuucuccuuaaucuuauuccaccauuucuuguuauacuuccuccuccagcgcuaaaucacugucccccuucuuguuuacacccuccuggcauguguagguaauaaucacauuucccugcccuuuguuuuuacuuaguucgggucuccauguuuagguuuucuaauccugcccauaaaaugauucuuucagcuucuuagucaugcugccauuuuucuuugaacuuacuccaguuugucucaauuuuucugguaaugaggugucugaaacggaacacagugcccuuagguguggccucgcugaaacuguguaauggaauggcggucugcugaggagugaugcccaugucuggccagcccgggggccuuugucucucuugaagagcuggaaucgcuuccaucaagauccggcgauuccugugcuccagaauugcagugagcagcccagugccuuuccuccuuugugccucaccucauacuguguuuccauuugaacugaccauuuucuguccccugcugucaagaaaauacccacccccccaacccugccuuccuuucuguccagacuacugaaggcaguagcauuuuaucucuaccuauuuguggcaguuacuacacaguguuuugcauagagcacucagucaauuuuuuaaagaguuuuuuuguuuguguuuuuuuuguuuguuugagauggaguuucgcucuugucucccaggcuggagugcacuggcgcgaucucggcucacugcaacacccaccucuuggguccaagugauucuccugccucagccuccugaguagcugggauuacaggcaccugccaccacgcccggcuaauuuuuuuguauuuuugauagacgggguuucaccauguuggguaggcuggucucgaacuccugaucucaagugauccaccugccucggccucccaaaguucugggauuacaggcgugagccacugcaccuggccaauuuuuuuauaguuuuacugagauauaauuuacauacauacaacucacccauugcaaguacauaauucaguagauuuaguguguucucagaguugugcagccaucaccauagucaauuuuugaacauuuuugucaccccaaagggaagcccccaccuauuagcagucacugccaaucaccccauccuaccccagccccaagcagcugccacucuuacuucccaacucuggauuuggcuacucuggaauuucaucaagaauggaaucaggcugggcaugguggcucacgccuguaaucccagcacuuugggagaccaaggugggcagaucgcuugagcccaggaguucgagaccagccugggcaacauggcaaaaccccaucucuacaaaaaaauacaaaaauuagccagguguaguggcaugugcauauagucccagcuacuugggaggcuaaggcaggaggaucacuugagucugggagguggagguugcagugagcugagauccugacacugcacuccagccugagcaacagaaugagacccugucucaaaaauaaaaaaagaauagaaucauacaagacguggucuguugagaccggcuucuuucauuuaauguaauguuuuuauauacuuuacauaguguagcuuuacauaaugucacgugucagaacuucguuccuuuuuauuggccaguugguuaauacuuuuugaguggauauuuuauacacuucaauuuuucccuucuuaaggucguagaguaucagaauuaugccuuuaaaaguauauacaguuuuaaaagguauuuauguuauauauuuugguauauuucuuauugcaaaauugauguugcuugugcuauaaacaguacagaaguauguaaaguaaaaguaaaaucaaaacuccuuccagccacugagagcuuuuuuuuuuuuuuuuuuuuuuuuuuuuuuuuuuuuuuggagacagagucuugcucugucacccaggcuggagugcaguggcgcgaucucgccuuacugcaaccuccgccucugggguucaagcuuuucuugugccuuagccucccgaguaccugggaacuacaggcacucaccaccacaugugaccgauuuuuuuuguauguuuaguagagacgggguuucaccauuuuggccaggcuggccucaaacuccugaccucacgugauccaccugccucggccucccugagugcugggauuauaggcgugagccgcugcgcccagcuucaaugaggucuuuaaaaaaucuuuguuccagccgggcgugguggcucacgccuguaaucccagcacuuugggaggcugaggcgggcggaucacgaggucaggagaucaagaccuuccuggcuaacauggugaaaccccaucucuacuaaaaauacaaaaaauuagccgagcgugguagcgggcaccuguagucccagcuacucgggaggcugaggcaggaggauggugugaaccugggauguggagcuugcagugagccgagaucgcaccacugcacuccagccuggugacagagcgagacuccgucucaaaaaaaaaaaaaauucuuuguuccuacaaauugccuuaguaaacauacuuguacauacguucuuaaauuucuuacugguguuucuguugaacauacucuaaaaguagaauuauuuggucaaaggacauauacaauuaaauuuggcugaugagaccaaauugcucaccucccuacaauugucccacaggucguugcucugcuguucccacuucccaugcccuagccaacucuguaguuuauauuucuuguucguuuguuuguuuugaguuuuucuuuuccuuuuuuuuuuuuuugagauggagucuugcucucgcccaggcuggagugcaguggcgugaucucggcucacuguaagcuccgccucccgggcucaagcaauucuccugccucagccuccugaguagcugggacuacaggugcacgccaccaugcccggcuaauuuuuuguauuuuuuuuaguagagaugggguuucaccaugcuagucaggcuggucucgaacucuugaccucgugaugcgccugccaccucagccucccaaagugcugggauuacaggcgugagccaccgugcugggucuuguuuuucuuuuuuugagacagggucucgcuguguugcgcaggcuagagugcagcaauacaaucacauagcucauugcagccucaaccuccugggcucaagaguuccucccaccuuagcuuccagagcggcuagaacuagaggcacgcacaaccacaccugacuaauuuuuuuguuuuaguuuuuuguagagauggggucucgcuguguugcgcaggcuggucuugaacuccuaggcucaagugaucugccugccucagccucccaaagugcugggauuacaggugugaguccccaaaccuggucaaguuuauauuucuuuuuuuuuuuuuuuuuuuuugagacagagucucgcucugucacccaggcuggagugcaguggcgugaucuuagcccacugcaaccuccaccuccuggauucaagcaauucuucugccucagccacccaaguagcugggauuauaggcgcccgccaccacgccuggcuaguuuuuguauuuuuaguagagacagaguuucaccacauuggccaggcuggucuugaacuccugaccuugugaucugcccaccuuggccuccuaaagugcugggauuacaggcgugagccacugcaucuggccauauuuaauuauuaaugaaauuggguauuauuuuuguguuuguuagccauuuguauuucuucugugaguuuuuuguucauauucucugccuguuuuucuauuagguuauagguuuuuaggcuuaugguaccacuucauaauacaguaaugucaauccuuugucuuuuuguuuuguguuuauuaugucuuucaagccgucauuuguacuucaauuaaauguauagcucuucugucucuauacagacauuuuaaauuucuaaauagcccaacuuacccuuuuauuccuuuaugacuucugaauuuaaaagcacuuacccuccucuccaaaauaaagcuaaaaauacuuuucugucucccaucccaagauuauaaaaaauaugcucuuaaauuuacuuucaguguuuucacagcauagguuuuaaauauacaucuuuaaccaguuuggaauuuauguugcuguaugguauaagcaagaauacaaccauaaaugggccuaguugaccccguacaguucauugacuucauaugcuuccuggucauauccuaaaucccagucauuuaaugguaucaacccaacacucuucuaauuauuguacuuuuauggcauguuuuguuugguaaagcaagucuuaacaucacucuucuuucuuuaaaauauuuucuugacucuucucuauauuuauacuucaguauaaauguuagacuccauuaucaaauuccaaaaagaaccuuuaggauuuguuuggaaauguguuauacacacaaauacacacauacauaaagccucaaguaaugcaugauaaaauauauagcagugguuaucucuagaugaugguaauauucuaggugauuuuuuucuuguuuuuuuuucuuuauuuucgaaaguuuuuacaauauuugugaagcacuuuuuacuuuauuuuauuuuauuuuauuuuugagauaagagucuugcucugucacccaggcuggaguacaguggcacgaucucggcucacugcaaccuccgccucccaguuucaugcaguucucaugccucagccucccgaguagcugggacuacaggcacgugccagcaugcccagcuauuuuuuguauuuuuaguagagacgggguuuugccguguuggccaggcugguuuugaacuccuggccucaagggauccgcccaccucggccucccaaagugcuggguuuacaggcgugagccaccgcacccggcugugaaaucacucccggcugugaagcacuuuuuaaauugcggaaaacuccugaaaaaaauguucuuaaacuaaauuauauccuucaguaacuucaugauuaucuacuuaacauaacagaagcccaauuagaauaaagacuauuucaugggaaauaaauaagugacuuguagagacugaagaagaguuaccuggcucagaauauaaacuagaauugucuggaauauuccugggaaggauccagcuggaaucaagauacugaagcaacaccaccccauaaccuuuucuguagcuugguugaugucaguucugcugagacuuuagggucuguagccuuuucacuuagcagcauuccuggguuguuuucucugcagcuguauuuacaagguacccagccuccuagcuuuccccguugaagagauucuuacucaugugacacagccagaguuuggggugcaccaaggccgcguggucuaaaucgggccccucaguguccuggucuuuuagucagcauuuagcagaaggaagauugcuaggucuauucuuaacucuuugauauauuuaagaagcacugugcucauucuugacucagagcaucuagauucuuucuuuucuuuuucuugcccugucuuauggugccaagcaucuagauuuuuuuuuuuuuuuuuuuuuuuuuuuugccuguuuuaagauggaaucucagcugggugugguggcucacaccuguaaucucaacauuuuaggaggccgaggcaggaggaucccuugaggccaggaguucaagaccagccugggcaacauaguuagaccgcaccucuaaaaaagaaaaagaaaagagaaauacaaaaauuagccaggcauggugguacacaucuguaaucccagcuacuuaagaggcugcagcaggaagaucacaugaggucaggaggucgaggccacagugagccugaucaaaccauugcacuccccccagacaauagagggagacccugucucaaauuaauagaaagagagagagaggagaaggguaggaggcaaggagggagggagggagggaggaaggaagaaaagaaggaaagaaaagaaacgagagagagagagagaaagaaaagaaaagaaaggaaagagagaaaaaggccaggcgcggugacucaggccuguaaucccaacacuuugggaggccgaggcgggcggaucacaaggucaggagaucuagaccauucuggcuaacacggugaagcccugucucuacuaaaaauauaaaaaauuagcugggcgugguagcaggcgccuguagucccagguacucggaaggcugaggcaggagaauggcacgaaccugggaggcggagguugcagugagcugagaucgcgccacugcacuccagccugggugacagagcgagacucacgucucagaaaaaaaaaaaaaaaaaaaaaagauagauggggucucacuaccuugcccaggcuggacucaaacuccugggcucaagcgauucccccacccucagccucccaaguagcugggauuacaggcaugcaccacuguacgcagcucccuuuuugcuuuuuaaucuguaugcucuugcugggugaucuuacccauuuaguaacaguuagaacaccuaauauuugucaagcacuuuauaugacuaucucauuaaauccuuaaaacagcccuauaagguagggcacaggagcucacgacuguaagcacuuugggaggccgaggcagaggcgggauuacuugagccugggcguucaagacaagcguaggcaauauagacucccaucucuccaaaaaauuaaaauuuaaaacauuggccugacaugguuauuauugccucauuuuacagaugaggaaacugagacucagacaagucaaggucagaugaacugaucggcagaacugaccuugaaacccaggcagccuaacuccagagccuauguucuuaacuagacuuuauauuccauuuuuaauuuuccuccuuucuuuccuaaaaccugcugucuccuucguucuuggucuuauuuguccaauauccccagcuagaauugucagaaaugauucuccaguucucccucacuugacaccuccuccuuuuaguccugccuuuugaagaggcucagaccuguguguuccuuuccacgucccuggcccucccuugcaucagccuugccuaacccccaccugggcugcgagcaggagcugcccuugguggacucuuccuucugcucagucugagaaaguggcgaugcucaugucacuguaccauuuaaaacugcguggacuccuuuuuugugguugugguuugguuucuaggcagaucacgcuggaacguccucacuucacgugcucagucuggcccucgcguguguuuucagcuccauuuccugucauucuccacccacucccugugccuuacauuccugccauccugaggcuucccuuuucgcaagaucugggccaggccugucccagccccacgcaucagccuuuguucuucugcgcuaagccuccuuugucuuuggucucccagacggacucuagucagcucugaagauccagaccccacgccucuuuaguagcauuuccucagacuccucagggugagcagacacucuuagggcugccacagcacaugcucaagccucagcugcggccucacucugcuggguggucguuuaucuguuuacaugcuugucuccauuaaccuaaaugugucuucaggacaaggaccaaaucccaucagcuuucaccacccagcacagaguagcgcucaauaaagguugguuaaaaugcuugaaggaaugugaaagaggcuguuaaaaacaacaggaaguuagaaauauacuuacuucuaagcaaagggauuaucuuguguuucucaaaguaaucucuucagcuaaauuagcaggccucagguggguaggcuaauguaccggaugaaagcgauacacggcaaauggagaaguccuuuaaauucuaaguucccuuagggcgagggucgcuccacaagguuaggauccucucugagaucaccaugccccucucuccugcucucaugcacguucaugagccugugacuugguggagagaacauucuguuuacagugagaggccaggacugaagucacagcucugcaaaaaugaucagcuuucggccuagaaccagugacuaacuuuuugggccucacuuucaugaagacgcauuugauauuugcuuuuacacuuuucuuaugguuaauuuugaugcagagagacuucacauacagagugccuuugucauuuauugaugaaaaauaauucuuagcucagugcaaaugggauuguuguaucugaaauccaucucuccuuucccuuucagcuucaggaugaguuagagaaaggugaacgggacaaugcagaacugcaggaguuugccaacgccauucuucagcagauagcagaccauugucccgacauccuagagcaaguggucaacgcccuggaagaguccucuugacccugcuuuauggggaagccugagguagucaacccaggagccaagaaaagagaacuacgaggaacaggugcccggaaccuucuuggcaccaaacacuacaaacuucaucccaacuugcucacuugaagaagugugauuccagcaccguuucuacaucugccaucuuacucugccuuucugcuuuggauguggucucuacacuaaccuucuugauguccaggguagauaaagggucgaaucucucugaagaacugccaccuggucaucagcaguggagaacugugggagcugguggcucugcccugacagagagccauggagcagaggagccucucaccuccuguccucugacaugagaaugaaaccaggaauggacuuggaguucaacaggcugagaggaugccuccaauggaccagagagcugaguguucuaauaucacaauaggugcuuucuccuaaaagggcaaaaaacaaucucaaaaagauuagaaaaagagaaggggggaagggaagagaaaaucgacucuucuuuuuacugucucuucugcuuacuuuccacaugagaugcuuuguaccggggagcugugagcaggccucacgauggcuugggagcacucguucucccaaggucugagucuucauccagcccugccugucugucgcagccuuccucacucuguuccucggccaguuaacaagaagauggugugagguguucuccaccagucucuccuguuugagacuguugacguuaucauacugagguguuagaucaaauaucucuaauugaagaacaugugagguugaaagagcaccagccagggcaacauagcgugacccugucucuacaaaaaauuaaaaagagaacauacaaaguugacauaugagacccuguuguccccgccugcagcuuugccccaguaacagaugcccguugcucuugggcugguuuccccugaacaccuccaagaggcugccugccuugccagcacccguguccugagcuccugcagcccaguggcugcugaaguugugaucccucacucacccugcuagcuuugcccuugacucgucuucucugaaccucagccucgugcauugccuggaaccuucuucuagcauaaaugaagguuuuuccuccuacacacauuccuuccucgguuauuucauucagagaauauuuaugaaaugccuacugugugcaagucauccauccuugaaaaggccacuucucagugagggagagauguaguggauucugugagacauaccugcuggaguugaagcaguaaauagcauguccuuccccuccccgaucuuaagguguguuuucuagaaaaguucccuaauggaauucaugaguuugggggucucagucacccgcuugccuguaggauuccauuugaugauucuggauuuuugcuguuuguuauugcccuuagaggggcucugaguaucuacuuguggguggccauuuccugacaucugcauguaccucguggaauucagccagcuucauguugcaaaucagaaagcugaccccaagacugcaaaucaaugaagguauuggcauuguuaaggacguagcguagacaacagcagucauaaauaauuaggcaggaacuuaacccaaaucuaguucuuugaccaccucuaccaccagaacccagcagacacucacaucuccugauaagaguugcuggacucgauguuuuuguuuugcauuuucuccucuccuuccccacuuacucagagaauuuaaagucuguagagucagcacagccccaucaguccaggaacuucccaccaccagcccuugacugucccauuaacugacauggucagauuuccagcucccccuacucccugcugugaaacaaucccucucccugugagaggaaacuguggagcguuucuuaucgaagguuaaauggacucugcucauaaaccucuuacugagaugcuuccugauagccaggcuggccagagaggggugcagggguuagauaguaagugguggucguuuguggucaguuaccucaauucuguucauugcagugcccguaaaccauguagaaagcucccagcacugaaaggcaggaguguuagcaucucgcuuuauccaccauaacguaaagaacugcggugugauaacagccuucacggggccacgguggaaccaagacagcaggcgaggccaugccuaaacaaguggucuggcacgggcacuggccagcugcucucuccaagcagguggcccagaucccacccacguggacuuucucaucaggugcagcgccugccacucucagccacugggugugucacucuccucuucaucucagcauucuccaucacuuccccuccagaaaaacggauggaaggaagcccucugugacacugcuucugagaagaagcauuuccgggaccgauaucaucugucuggucucugugaacagcaaggaaucuucuugaccguucuugggcacuggaggcuggcuaggaguucaguaauaaacguggccuucgugcuguagggcagaguggaugcaguuuguagcuuucagagugucucauugagucuagaucauugaaccaacacuuaaccaaaugucccacucccaucacacuaggacuugucauuccaugccccucuccuaguggucaugguuucauaugggcauacaacugcuacugaaguuauauagccuugaaaacucagugcagguugcccuuaauuuuccccaaaccccuccaucggcaagucuaguugcccuuuagcaccuaaagaucugcaccccaaaccaaugucaccauaaagagggcacgaagaagagugggugugaucccaacgggguuuuguaacugaagaagcccagugugagcuucucaucuuuucauauaccucuaacccccgguacucauugaaucauugaugagguaucucaauugagauuugcaaggacuuugauaccauuugaaauggaaaaauuuugaacgggcuuuaacauguuuaagaaauauggauggggccggccacaguggcucacgccuguaaucccagaacucuggaaggcugaggcaggcggaucaccugagaucaggaguucgaggccagccuggccaagauggcaaaaaccccgacucuacuaaaaauacaaaauuagccaggcgugguggcguacgccuguaaucccagcuacucaggaggcaggagaaucgcuugagccugggaggcagaggcugcggugagccgagaucgugucacugcacuccagccugggugacagagacuccauuuaaaaaaaaaaaaaaaaaauauauauauauauauauauauauauauauggaugggaaucaccaaauucaucucagcucuaaccuuuuaaccuuuguccuugcacuuuacaaucuaaagaucuaccuguggcucucagacuuccucacacuuggguuuuagaaauaacuuguaaagcagacuggacccaaggccgccuucagugucaagaagggcauugugacuugccccucaauuucuguccauugaagucugguuuuccaugaggaacuugcgggcucacccacccccagagugagagaagaggaaggcgaagucaucacagacacggucuuagccaccugcugaacuaaucccuccgcuauugagggucaggguugugaggcaaccaucaugugucaccccaaaauauaaauguuucugagccgcccauccacuggcauuuggauuugcugccagaguccuguuccucccagaaccaucccgcccuccuguugaccauguuacuugaguguaggcccggugucaagacccucagagucuuugaggaaagagccaagcagagaagaccgcugcguggagugugacaccacauggcauuucucaagcccagcggacccugugucagcaaauaccaguaauuuaacaucugcuccuggccuccucuucaccugccuggguucggaacugaggaggaaggaugagaagagacugcaaugcagcaggcacccucugcagagugaggccgcccguccaucacugccagcccugggcugcucaggaggggacgugaaccacucaaaggaaugucuuaaagaggaucuggaguuucccccaugcaaauuagggaagaauuaggcaagaaaagacauacauuacagggaaauccuucugaacaaaauggcugucuucaccuacucuucuugcaagaaaagacauacauuacagggaaauccuucugaacaaaauggcuaucuucaccuacucuucagcaaaaaccgucuccagacuuuuuagugucaaaaauguaaccaacugucuccugauuuuuuccaauguguuuggcaagugcuguggcccuguuguagguacuucuccugacucuugggggagaagugguuuuagggauugauuugggggagcggguuuuugucccaucccaccuccucucuucuuucucugcuugucgauauugucugugugauucagagaauuggggcaguuacauugugucuguuguugagauuauuaaaagauuaaaacguaguuguagaaaugaaaaauuaaacagcuguguuuuaaaaaugcaaaccaauaucuuguuaauaaaggaauucaagcuauggggcagccacacuccccuccucccaggcuggcauagguggcccugggcuggcggcuuaggaagcauggagcacacuuaggguagugccugccugggcaagagacaccugccgagcaaaaggaacgagaaucuggggcucagagccucgcaguugugccaggauuuuccuauacauguucaggaccucuggguagagguuucacaguuugugaccccauaaccacccucacccgacguggguucuagcucagugugccuaauacugcaugguaaccugggcuugacccugaagccccugccuggcaggccacaggaccucuccugcccacuuggugcuaucucuuccagugaccacccagcacgggugagcacuggccagccuggagccugcaauccagguggaacagacuguccuccaugucaguuccuucuggcuucaggcccucaauuauuucccuuugagcuuuuuuagacccuagaucuccuaggcccaggcucucucuugaccccagagaagccacugucaggaaaggaagugaacccuacugaagccagagaauucaccccggccaaagcaggcccucuggguccagccccucauuccacaccacgccaguauugcauccaucuacugcagcuacacauccugagggcagcaccacccacucuggccugcuggcccaucgcaggacuagcccaggcaccugccgggcauugcaggauauccaguggggccugugacugcucccugaugcgucagaagagaaguguugcacuuuaguggaggagcugaggagcaccugcccccuuguagcuugaguuccuuuugguaacaguagcagccuccaugguggugucugggaugcacgugcacccgcugccuucagcuguauguguguguuccugcuggaguuguguuacugacaggauaaugacauuacaaagaaauuguguuauauucaacuuugccuugauaauuauuguaaacacuuuguucauuuuuucuuuuuuauucacaaacuaaauccaccaggaaauuauaaaguuauuuaaaaaccgu

SEQ ID NO: 191683 - RNA, 158530 nt, Homo sapiens
ucaacaaaagcaaguuugguuuauuugaaugguuucauuaaauaagucuacaaagguaacaaacugaagcacaaagcgcaaucuuacaagaagcgcaacacccagaguuagugcaaaauguacaauuaacggcugcugagaaacccccaaaguuugaauuuuuauuuuuauuuuuaacaguguacauuguuaaauaauguaaggaaaacauuuauaauucagaaaguuuuuaauguggaaaaagauacucaaaguguacuauuaacacaaaaauaauuuaaacaguucaguagcacuaguucauuccucuaggcuuguuauuucauacacaggaggaugaaaucaacaguaaauaacaccaguucugacuuuuuuuguguaugagugaaaagaugucaaaauuauuauuaaacccaaauaacaaaugauaaugugcugcaugaggcuccacugcuccucugguauaaaguauguuucacucuuggguggccccuuucucagcuacucagccccuuguugguucuauccuuacucucuccacaagaaauacaagcagagaauaaauaaaucauuuuaaagcagggguggaagcccuugcccuuuuccuuucuaccuuuuaaaaaccuucagcucucauuugcauauuuagggccguagaccaacuuacuuacuuacuaagggaagcagggcccuuaaggaaugaacaggguacaggagccuccagccucuuucugugguaguggugguggugguggugauucccagaauaugccauugacguggguaaaagguuggaaauauuuucaguuucccaacuaagagucaagaagcaccccaaaauuaagaguccuagcuucuuucuuugucuucagagauaacaaagauccuaaacauagccaguuaggacaguauuuccggaaagcucugaaaauaauuaauaacuacccauuacaaggaggcauagcacugaauaacacugauugguugcaguuauuacuuacggggaguauuauuuauuugaaaaugugaacauauuaguuguacuucuagaaauaaagguggcacaauagauuaugauccugcaaccauuuggacaucauaaaggaaaugaguaggaauaaguauucuuuccuagaaugauuaauucagauguggaaagauagauagauuaacuuuccacaaaauguaguaccccaagcugagaaaugcaugguacaugugcaacaagaggaaagcaauccaaacaguuuuucugagagcaauuuucuccaucugugacuuuucacuaucagguuccccaacuugaaaacuagccccccacccccuucucuuuauguucaguuucuucuaggucacgucuguucaagccuagcucaaauaagaaagguuuauaugacagucacuggccaggcaucacguuuguuuccucauucuuuagucuuugucuuucacccagcacacaccauucuuuuaaguuguccaauuuuguuacaacacccccuccucacuauucccgaaacagaacuuucuguuuuuaaccacugaugccaaccuaacuucccacccuacucaucuuacaccugcucuagacaaaguuguugaaugacuuaaaaaaauacuuuuucaauuucccuuuggcauaaccacugcuggacugcuggggucacauggaccuacgauuuccuuccacaugcccuuuauugaucuggggucugguaaguugaugcuaauggcagaagcaauagaaguccaaggcacuaaaauguccagcaagcaacacugggaaacagaaguauucaaguacaguaauuuauacaauuuuacauucacauuuauuuaucuaauacaauggaaauacaaaggaaaaaguuaaagugucucaauaaguaaaggacagagcuagcuuuuuuuggaacuuuuuaaacguuucauauuuuacucuuaaaacuacuguuguccaacaacauuuuauauaucacaguguuuccacaucaaaacugauggcaaaguuacauguccgcagggaacuuaauuuuuuuuuuuuccuaauugcuaaugcugcagucaaagcugcuaauaucuuuugcuuaaagcacuaaugaccuaucauaagaaagaguugcaccccaguacccugguauuuuucacuggguucuaaagagcaaagaaaaaauaaaaaagagagggguaaaaaaaagggaggagggcaggguaggagagagcccaguaggugguuuuuguccugugguucggauucuugagggagugagggauucagggcauguaccaaaagcaagagcuccacccacucgaaauuacagauggguuugauuuuacauugaguucuccagcuuccuuaugaacaagacuuuccuagcccucauccucauuacugaguauagauaaacaggaaagcauggucugaagcugccccuugacaaaaaagcuguucuuuccuuccucucccauuccaauaacuggagcgggggagacucuccauucugagggcucaaugcaguauuaaaaacauuccccucuggcaagaaauaaccaguuaaaugcagcacuaguaguuaguauauaggcuacuucccacccccacccacccccucagcauuccaucuccugcccccagaucuauucaguuaaugucucuaggucuaagugguccgcagguuggagccugggggguugcugauggauuucugcaaauugcugauguugaaauucugcaaggaggcaguucccacagguuggaacuggccaaguggcuguggugcugggccacccgucccacuccauugagcgccaaaugggguagcuggaaagccauacugcuguggggggcacauagacuuggugaagugaccuagagagguagcugaugcugcagagaugggggcagagccacccagguucgaggucauggagaugcacaguugcccaggugcagagaacuuccuugccauuccagggcccugaaaacaaaaccaccacgugucaagucuggugugggccaugguauaaaauguguggcgcuaacauauacuucuaguauaauccuguaagauacagcagaacagucuucuguaguauuuauuggcucuuuauauuuaccaaguaagggugaaaauaauccucaugagagggagggaugucaugugcgugugugucuguguguguguaguugaggaugacgaaggaaaaacgaagaagaaaaaguugagcugaccaacaagagguuaggaauucagggaaggaaaaauaaaaggguaccugggggauuuuugccuuguuuuucuaaaguauuaaaauugaagaaggucguggcguaagacguuaagcagcagcuuaguuguuucuaucaccuugacucagauguguguuacggauucucugcggcaaaagagagacuuaccucguaauucaugugcccuuugcuuccucuccugccugagagauucauggcaucucgggcccaauugucuaccaacuugugcaagucaucugugaaugugcccuuccugcuggacgucauggcaggaggcugagcuugggcggcuuggcuguucacuguugccccaacaguguuugugcugcugguuccuauuauaagcaacagaauacgagcauuaaaagaagccuagguuacaauuucaggaagagggaaaacuucacgggaugaugaauggcaagccacagaaugagaagaggaugaacugggaagccaugcaagagggaagauuccaagguuuuguuuagccauuuguuuugguauaauagggugaugaaaacaguuucucuucaguagcugcugcuaaggcugaacaacucaggaugacgguagguacacaggcaggggccucuuucaguccauucacaaagcaccuaagaguauuggaacugcucgccaguacgcuauucccagcaucacguugcugauggaggugugauacaaucagcaaggcuaguugcucuggaauuuugcagaaugcagggaaaaagagguuuucuugugcauugggcacgguuaaaguaggaguaggaaaagaugcuuggcuaaggauaaggagaagguggguuuccaaaccauuggacacugccacauucuuuagccuuuuuuuuuuuuuuugagauggagucucacucuauuacucaggcuggagugcagugguacgauccuaccuaacugcaaccccugccuccuggguucaagcgauucuccugucucagccuccagaguagcugggauuguaggugugcaccaccaugcccaguuaauuuuuguauuuuaguagagacaggguuuugccguguuggccaggcuggucucaagaacuccugaccucaggugauccgcccgccuuggccucccaaagugcugggauuacagacgugagccaccacgcccggcuuuuuuuuuuuuuuaaaggaagggucucuucuuuuucugucacccaggcuggauacagcggcacaaucacgucucacugcagccuccaacuccuccugccucagccucccaaguagcuugggacuagacguaugcacuuccacacccaguuaauuuuuuacuuuuuuauauagacagaaucuccauauguugcuuagucaugaacugcugggcucaggcaauccugccaugucagccucccaaagugcugggauuacaggugugagccaccaugcucagccuagccauucuuuaaauagagagagguaauaagagaaguagcaugcuguguucagaaaaguuuuucaccuggacccauaaacaugaauuugcaaacauaaacuugggagggguuaaccucucccaauuucccaugaguaaagaacaagauuauucaugaggaaaggacuguauggugugccugaaucuuucaacuucaggaagacaugguuuuccugaagaugaccucaguuucaauuggcucaaggauucccaccgcuucuccccacucuucccagaacagcaagcacucccauguagaagcgacaagaaaaugcagcugaggcagggugcaaaggggaggaggaagcuuugcgguuaugaugaaggaacucuauuucugcgguuugaugagagaggagggagucuaugccugccugauuucggcucugcuggagggcacacugaagauuauuccaagaggcacguuuuggggaagagggaaagaagagucauggucuugucuguuuuccuuaccccccacugucuuaccagaucucacguguuacagaauaaauaaaagcuccuaaaguaaguugugaaccacuaguccuuaagguacccaaguaaugcggggguaaguaagugcaugcguuauccugcuuucaaggucaaagcagcaccagaucacagcagcacaccuaacgcaauccugccacuucaaagccuguuacugaccaucgcuggucucaagucaagcuuauauccuaccaccuggggaauggcacacacaagcaggucugugcugcaguaacagcuaauucugaggugaagcugcagugaggaaggucacaugcuucuuaccgcuauggcaagacacggaacuacugcagugugagugucagcucauuucuuggugucugcuggagccacaaggggauugcuauugcacauacagugugaagggaagaguaagcucccuacaguacaggaaacgcgaggggagaagcaugagagcacagaaaacagccuuccaugaacagccaaugugagagaguggugaagugggaagcacaggcaaugaggaugggcagucaugacagugagugacucaaucuagaaagcaagcauaucacaugcauggggauugucauccuguuugaacaauuauugcuuggugagcuugaugugagagacaaucaaaacaaaaaacagaaauaaucacaggggagcagagcugucaaaagcuaaauacaagaagcucaggaggcgugaccauugcuuauccacagagcucaugcugggagacacaccucucuagucugucgccccugaugcugcgaggccccuuuagaacgaaauuucacuuuucauuuuacccuacauuaccuaauacaggauucucuaugaggaaagagaaaccaugaggaagagucaaccauacagcuaaaccuucacguucuggcuucuguauacaggccucccauuaaagaaugaaacaaaccuaucauuuucugaccagaaauuaacuccuaagaaaaggagacuugacuauaaaagauguagaaaggccuuugagagaauaugcuaacuucuuaaccuuuuuuaguucuucugaaaagcccuaauaaguaguauagacuuacccccaagauucauuuuuaaauuuccuccugccauuauaauacauuuccccuauucccacaucaccagauccuacuaacaauaaccuauuaugaaccauaacuuacagcccaacaucccaaguacagaauuucccuguugacccuaccuacaacacuguaaguggccuucucauuaaaguaugagaagccacagucuaagaagacaaacucuagaaagugguguuuuucuccucgucaaucuagcacacaucucccacuucagugugaacgugggagggcauggacuuuuguaugcuuucgucacugcugaguuuccaguugggguaauaacacugcccggcacauauuugcugaccaaaggaucgcucucccauaggaacuaggcaucccugaccucccuauauauacccauggccauuaccaauccaugucugucacaagcuaggcucacaugggguuaucacugagggcaccgacuaggagaugauuucucaauuaagcauguuaaauauuuauuagaauaggauacagagauagauggaaguuaggaaucagggagcuaugagacugcagaguugaaagaacucaugguuaacaggcuuugcaaucaaggaccaaaaauaacagaaaagauaauuacuacagagcugguugcaaggacagacuuuuuucaccaucuucccugaagcacaaagagagaagcaauguguuaaagauaaagaaacaucaguguaaaauauuuagaaucuccaaacagcacacaaacgcccagcaagagaaagcaggaggugagacagauagguaggaccugguagcccuugaacagauauaguucuacagaauguuucgaacuggcuguuagccuuaacaugauuaucugaugggcuguguuacguggcugacagauguggaguuucuacacccaaucuuuguaucuaaaagaguaaugcccugcacugagguucuggaauuggcgaggaacuccagucucucaggucucacugcuugaauuucaaauacccaagcagcguuuccacugauccugucccacuuccuguuucuccagcugggcuguuaaaaagcacucaguuaaaugcauuagcaaccccaccacaguagacugauaguaucacuguuacagcuuuaaguucauuuaaauuggcuauuauauuuccacaucccacauauauauacuaaccccuucccuuccagaauaguuuuuaaaaguacguggaaaacaagcaaccucugaacauaaauauagcaguaagccaagccgugcuuccaaaccauuaucuauuuugagagcauagaauaauacaucucaagcuaguaaggugcccuacucuuucaaguaccuguuuccuuuccauauuucaaguaugucucuugggauuuguuuaccaggcuuacaugauguauccugaugugacuucuaaggauguagggccuuucauuuugcacccaaagggaagugacaagauucaauauuucugaccacuuucauuugaacaacagggguaauaccaccuaccuuuaaaagugggaugagaauuuauggaauuuaauuaaagugguauuugucacauuauauuucagaaacagaagcuuugguucucuuucuucccucucagacacuucaggcuguagaccauaggccugacaugucacauucuacuucaaaaacaccccccuugcaacuuucuagguggacaugcaaauuaaaugcuuauucaacugucaaagugcuaauaugcacaguccaggaaagucugaccagaaaaauuauugaucugaguccucaaaaaaaaaaucacacaagccuggaaaacgaucgaauuggguaaugccuuccacccgcuucuuuguuaaacagccugggacuagugcauguggggaaagucaguaaagacugccucucaaguacagcuaacucauuacuaauacagguacaaauaauaggggugcuggaaggagccaauccauuucuaaugcagguaaaaauaacagggguaugugugagggaaauggcaguuaaacgugucauaugcuucgcuuuaaaucuagucacuacagagaacaaagggagguuguaaauucuucccaccgugaagaggcccaagggccucugacccauacucagaaacagugauggccugagcacaugcauguaaaaagcacuucaauaaucacaucagaaguuugaggccuuaacagagaagaucuuuauucaaauuauaacaaagguuuuucuacuugaacuauguuuuuguuuguuuuaaacuguucuuccacgaacaguuauugacuaccuguucugugccagguaggcacugacucaucagagagaaaccaugagugcuuuucaagcgcuaccuguuucucuguacaugaucuuagcuugauuuguacgauggcccuaggacacuggcaucaucuccauuucacauauggggaagauggggugacuugcuauugugccuuguuuuuaaguagaaagcugcaaaaucccagaaaucauguuagaaggagaauuuucacuugcagaugcugggcuuugaucuuuauuagacuaagugcuuuaucagaauaaccaaacuaaaaaccgcuuuugauuuuaugggguuagaggacaguagugguggaaugauccaaugaagagauccuagcaucuuuucaacugguagcugcuuaggcuuaauagagaagaaaaauaagauuucaaucuacucugacaaagaauggaaaaaaaugguacauaauuuuuaccugcugccaggaucuaagagcaucauuggucaaaaugcuuucuucauuucguuucuuuuuuuugagauagagucucacucugucgcucaggcuggggugcaguggugcaaucauggcucacugcagucucaaccuccuggucuuaaggugguaauccucccgccucagccuccugggcagcugggacuauaggugcacaccaccaugccaggcuaacuuuuuuuuuuuuuuuagagaugggguaucaccauguugcccaggguuggucucgagcuccuggccucaagcaaucuucccgccucggccucccaaagugcugggauuacagguguacgccaccgugucuggcugauuucucucauuucuaaugcuagggcagacagacagcacugacuacgacuguggaguucagucuucauuauucuaaaugacccagcaaucuauugccuagauaccauauccacucucugucacagauccaugaagaagcacuucuaccagaaaguuacauugaaauuuguagauaacuuguuauuuugacauuuuuuaucauaauuaaugugggggcccaaacuucugaggguaacaguaauucagccaagccacugaguagaugauauacaaaaagagacaaaugaaaauggacugcgugaaacaucagauccaagcagcagaaacacaaggacaaggaaggaguaaagguguuacacacaaagagccaagcagggcguacucagaaaucggguccuccugccaccagguuugaaugucaccuguucagaugcacaguuaaacuucgcacagccugugagaggggaaaaacaggguagaacagagagaggagaagagacagaacacaacuacaagauguuagaaacuugaggcuggaguggugaaaugcacuaagauggcacacagaagaacaagcuucuggggggaaggucagauauguaagagaugaaauauuaggucuuaauucuacccaucugcaaaaugcggaagcuuuucuuaguucgaauaaugcuagcuaguuugcccuccuuaccaaucaagugcauucuuccugugaagagacugaucucuaauuucugugaaacuguggcaaaggcacauaagccaguaccuauauuuuuuucauucuucucacccagaugcccaagucuuuucaauucuuguucuaauaugacuaaaagcucuuuccucugugggaauuuuuucagcaaucacuaauaaacagagcuauauuuggaaaguagauuauggauaaaaaacugaauuguaagguuauucauuuuaguaugccacucccauacuuaaaaguaacaaaauucuacaauggcuaagaaaauguauuagcuucagaaacugcuaaaacaccuuagaauuucauccaggaaaucucagccuaauauuaaagccuaaguuccaaaucccaaaugagcaagucauauaggccacacagauguaacuuuucacuguaauuccuugaaaaaaaguaauuucaccuaaugggagcagugagcccaccgauucucauuaucacuccacuucccuuuucacccagauucuucaguguacaacacacaggcuguguucuggucagcuagucucccaacccgccuuaacaggcuuuugucccagguauggcaacaucuccauuuuauuguuuuuggacgaugaugguugcuuuauuaccuugaccuggagcagaaaggcuugguacugaaauggcaccaucacuggugaaggcugaauagagguugucacuggagggagauggcuuaaggggcuguaacagcugauucugcccggacucugggauguugccaggaggguggagggucugcugggggugcaagacugaagcugcacucugaccagacagguuaccugccaaaagauaaaguggcaugaggaaacauguccagcucuucccaugcacucaucaggcacuguucuuauacauuugguuuguuccacugagugaugaaugaugggucaaaagcuacaaacugaugagaagaacaaaguccucacuaacgggagaagugaggaaugacacuaagacucaauagauaggcuggguguuguggcucacgccuauaauaucccagcacuuugggaggccaaggugggcggaucaccugaggucaggaguucgagaccagccuggccaacaugaugaaacccugucucuacuaaaaauauaaaaauuagccaggcgugguggagggugccuauaaucccagcuacucaggaggcugaggaaggagaauugcuugaacccagaggcagaggcugcagugagccgacaucaugccacugcacucaaaaaaaaaaaaaaaaaaagaaaagaauccauagguaauagggccauauguacuauuccagagcuuuuuagcuuuagaaaaccuagaugggccacaugucugagcagcguaagaagaccagaguaccuaguggauacccagauuccauucugcaauuccaugauugcuuuuuuuuuuacccuauuagaaaauguguugaaucauuauacaaaaagguuugcuaggcagucucugcuuagacuuuccuauaaacgugcaucagagcaaauacaaaagagguguucaaaaaugauggaggucacuacagagcaauggguguuuaaaauuauuuuugguagguugcuuucaauaggucgguuguccuaaaauugacucucugcuccccgguucccaguugaauucaaguccacucaaaaaguaugucaaaauuaggauuagaauuugauuaggaucauagcugggcauaguggcucaugccuguaauccgcacuuugggaggcugaggcgggcggaucaccugaggccagaaguuucagaccagucuggccaacauagugcaacuaaaaauacaaaaauacaaaaauuagccagguguucuuauacauuugguuugggauuacaugcuuguaaucccagcuacuugggaggcuggggcaugagaauugcuugaaccugggaguuggagguugagccacugccgacucugccucaaaaaaacaaaaacaaaaacaaaaaagaucugauugggaucagaucagaaauuagcugauuucucuuacaaucacaucucuacuaaugggcugcaugaacuggcccuaaugugcuacauuuggauaucugugaaccuuuccagagaauggaacugcuaagaaguuugcaacugcuuuuuaacauauuuuaaccuucuuuuacuuuucaacuaauuguguuaacacuaccauaauuucaccaaaggauuagaaacucucuaucuaucccaauuaaaauauaguccagggccgggcacgguggcucacgccuguaaucccagcacuuugggaggccaagguggguggaucaccugagccaggaguuugagaccagccuggccaacauagugaaaccccaucucuacuaaaaauacaaaaauuagccaggcauggugacaugugccuguaaucccagcuacuaugcggggcugaggcaggaggaucacuugaaacugggaggcggagaaugcagugagccgagaucgugccacugcacuccagccugggcaacagagcgggauucugucucaaaaaaaaaauucaaaguuagcagggcaugguagugugugccuguaaucccagcuacccaggaagcuaagguaggaggaccaccugagccuaggaguuugaggcuguuguguugugugcuaugaucacaccacugcacuccagucugggcaacagagugaggcccugucucuuaaaauaaauaaauauauauauauacuacauuacaaaagaguaucacuuaacuauuucuuugauuuuaaugacuagcaaguucuucuuuuuuuuuuuuuuuuugagacagagucuugcucugucaccgaggcuggagugcaguggugcaaucucagcucacugcaagcuccgccucccgggcucaugccauucuccugccucagccuccugaguagcugggacuauaggcgccugccaccaugcccaccuaauuuuuuuauuuuuaguagagacaggguuucaccguguuagucaggauggucuugaucuccugaccucgugaucugccugccucagccucccaaaguucugggauuacaggcgugagccaccgugccuaaccaaugacuagcaaguucuuuaacccaauauaaaugaaauaaaaaccuuaaucaagaaguuaccacuuagacauacacacaaauaucuauaugacgauuacauucaucuaaguugcaauuaugacuaagucauccauuaaaacaaagaaucuacccaaguuuuacuaaacagagaauaauguauuuucuuccaacugcccaagaguuugguuaaaugugaguuauacgaguuaacaggcaaagcuaaaugucuauccuuaagaauaacuauaaauaaagauuaccaguagauagcaauauggauuacaauggaauaagccauuguauucacuaagucuacuucuauagacucaaaaagagguacaauaaauguaaguacagcagucaaggaagcaaaaauaucaggagagccaaauuccuuugaaauuuaacaaaaacaacaaauguucagcaggucacauacagcuggagacagaaacaaaagauaggacagcuguggcugaccuaguccagggcuuuuuaccugaaagcugggggcuuuuauuccccaaggaacugcuucgacuagauuugcugccuuugcuuuuagugggucgucgucuucucccugaaaggggagcagcugggggaauaauaacagcagggggcaccuugcccaguuugguauacaaagauucaauuucaugcuucuggcgacucugcagguccugaaucucuuugagaugucugugaaagauaaccaaacauaauucaaaauaccauaauccucuucauucagacaagaauuaacagcauauuccuaaaccugcuuucaaguauguaguaguuacuaaugaaccuuuuccccaaauguacuaccacgagauucuaguuugucaacucaccuugcuggccugcauuacccaagccauguuccaacaagcuccuagccaacaacaaaugguugauaauguuuuaggagaaaaacauuuccugacuuuugaggccacgcacacaauagcugaauuugcuacucugacccaaucugccaaacaaaacgugccaaauaaucauacaucccagugccagauucauuuaguggacuaauaaauaaagagcaguuaauagugauacaauaugcuauuaauaaaaauaauaauacaauacaguaacaauaauacaguaauaauauaguaacaaugaagaaguucuagaacuagaaaugcuaugggucuguaugagugcaagagaagcugccugugccugugagucagugguugggaaucgugugugugugugugugugugugugugugugugugugugugugugugugugugguggggagguaugggguggggcuucuguggcacugucucuuuaaaagaaaugagacauuagcauauuguggcgaaaaauauuauuaaucuuggcccugggaucuaggucugaaaaccuuaucugacauucuuucacaagagaaaauauacuuacuuaucucguagucgucgcagcucuaacuuuaagucuucaucuucgauaucugacucauugucgcuacucauguaagaggaguuaaaugaauuacuaaggcuuugacuuagauucuggcuaggaaggcucuuugagcucagcugauggggcgaguguggacuaccggaaccaucauccacaucccuacuuaaaaaagcggccuccgggucagaagacggcccauuuagaugugaaggcucugacaguucaggcuucucuuucuuugguaucacagcaggaagaacagcuuguuccaaauccauaaaaggaggagaugccacugguccuucuuucuuugugucagugaucuuguccucaguuuuugauacagagaaacgacccacuuuguuugcuguaguugucaccugaaaacguccaaccuugguaggcugcccagugucugacuuugccucugaggcaguaguuuugugggcacucucuggcacaucugaagagauaccagggaugguuaugccauucggcucugguuucaccaagguacucucuggacuacuacuugauagcacugaggacucugaggugcuggauucaaaaugaacagacuuugcaucuucugacuuauuuuuacccucuuucugggcaccgucugcugcaacagaaaccugauaaaaaaggacaaagauuaaaaacuuaaguucucaauauccaauuucuaucacagacaauuuaaaaaaggaaaaaaagaaucacuuuauuucccugucaaagaguaggcugauugucucuuuacauagcgccuccacuuuugacuaggaagaaaaauugaauaccaucauagagaacacauggguacugagaugcagauucuguguggcuggcuacgcuuauaaaguaaauaauuuacuuucguauuugaugucauacacagaauucagauuuaugucuuagucaacauauacauaacaaaaggucagggccaggcauaguggcucaugccuguaagcccaccauuuugggaggcugaagcagguggaucacuugaggucaggaguuucagaucagccuggccaacguggugaaacccugucucuacuaaaaauacaaaaauuagccaggcaugguagcgugugccuguaaucccagcuacuugggaggcugaggcaggagaaucacuuaaacccgggaggcagaggcugcagugggcugagaucaugccacugcauuccagccugggugacagagugagacuccgucucaaaaauaaauaaauagauaaaaauaaaaaaauaaaauaaaaguaaauaaauaaaauaaauuagcaaggcauuguagaauuuuuaggguugccugugaauaagaaaaacuacaagguaaauguuaaaugccugguaugccucaagaaucaacacaacuaacugguaacuaaaaaagaggauccagauccuuguucugguuuguccauguauuuacaaauacaaacucagcccaccuauaaagguucaggaccuguuuacaaaugagaaaaauaucaccuacucuccccagccagaaaaugcucacauguuggacaaccugguaaaauaaagugauaugguaucauguguuuuaauuuaaagaauuaaucuuaggacaauuauuuuaaacguggaaaacauuuuuauacacaaagauguuugcuguuacuuaacuuauuauguuggaaaaaugagaaaugaugauagagacugguuagguaaaccaauuacuggaugggaaaaaaagcuguaacauuuggaacaggagaaaugguaguuaauuuuagauaaacacuuguacagaaaacaaggaguggaaggaaauacaccccaaaaaguaaucuugggagguggguggauagauaguacgacuaucuaccgugucucuacuguucuaaguauuucuauauuuuauuuaguauauauuacuuuuauuaggaaaaugcuaaaaagagcuauaaaguacuaugugacagaaaucacuagacuggcaauugugucccaaauagguaggcaguaauuuuauuauauagacaacuccuccaaaggaaggaaucaaggcaacacaaagugacugucuuaccugaaaucgucccaucuuaaaaacaccagcuccugaacuaguugcuaggacagggccuucuuugacuugagaaacugaaacaaauacauggaugaggaaaacauaagugucuccuuccaguuaacuucuuuucccuuuagcuagaaauacagcaaaaucaaacuacacaugaggaaagcuguuagaggcaaagagaacuuccuuaucuccucccuccaugaggcucuguccaacaggggaaaagaguuauuguuugcucuacuacuagauaccaacuacaacauuaacauauacuauaaaaacaaagguuaacaggcuuuaaaaacucaauuacucauucuuuaauucagauauauaaguaagugaaaugaaggaugagauuuuacugaggacauuaaggacccaucuuuauuuuauugagauggaguuucgcucuguuggccaggcuggagugcaguggugcgaucucagcucauugcaaccuccaccuacuggguucaggugauccuccugccucagccuccugaguagcugggauuacaggcgugugccaccacacccggcuaauuuuuauauuuuuaguagagacggaguuucaccacguuguccaggcuggucuugaacuccugaccucagguaauaugccugccucagccucccaaagugcugggauuacaggugugaaucaccauguccagccaagauccauuguuaaaugaaaaccagcuaauuuuauuuucucaauguaacacuggcaaauucuagaauaggauaguacaguucucagaauuauuauuauuauuauuauuauuugagauggagucucacucuguugcccagguugcagugcaguggugcgaucuuggcucacugcaagcuacaccucccagguucaugccauucuccugccucagccucucgaguagcugggaccacaggcgcccaccaccacacccgacuaauuuuuuguauuuuuaguagagacgggguuucaccgucuuagucaggauggucucgaucuccugaccucgugaucugcccgccucagccucccaaagugcugggauuacaggcgugagccacugcacccagcccucagaauuauuuaguuuugggcaauuuaaaaaccuuuccggggaacaaugcuuugaguuucuuucuagagauauauuuauuuuauacagcuaguagaacauugagcgauuuuuauguuuucauguaauucuauaucuuugagaucauuccauaucaaugccucauucuuuuuaaugauugcauagugucauacccuauguauauaccauauauauauuucauauuuaaucaggcuucuacugaugggcauuuaaauuauucagaauuucuuuucuuuuuucccugagacagggucucacucugucacccaggcuggaguacagugaugccaucacagcucaccacaaucucaaccucccaggcucaggugauccuuccuccucagccuccugagaagcuagaacaacaggugcacaccaccacauccggcuaauuuuuaaaauuucuugcagagaugggggucucacuauauugcccaggcuggucucgaaauccugggcucaagcaauccaccugcuuuggccucccaaagugcugggauuagaggugugagccaccaugcccggcccagaauuucuugcuauuuuagaaauaaauauucucuuauagaucuguacaauaaauauaccacaaugaaagugcugaauuauuuccauuuaagacuguaguagacaucacuauuauaaacugauccccccagaggcuguaccaagucacugguggcuauuagaccccugaauuuaccaaugagaggugggaauugcuaucacuuguagccuuacuuuguguuucuaucauuacggacauuaaauauuuucaugucuaaguuuccuuuucuguuaucuuuugauuguuuuuugguucauguugaauuuuaggaacucuuuguauuagcaaaacgaguucuuuuugugauaugacuacacauaccccucccccucccacaaauauauauauuuccccaguuuuucauuuauauuugcaaucgguggcacuuuucuuccaugaagaaaauuuuauaucuauuacuacuugcuucuggauuagacauugaacuuaacaccucuauuaaacuuaucugagaacuccaaacugauccauggaccaaauucagccuacugccuguuuuuguaaauaaauucuauugaaacacaaacucauuuauuuauguauuguccauugcuacuugugagaucugaguaaguugcaagagacuauauggucuagaaagccuaaaauuuguaccaucucgcccuuuacagaaaaagaguuugugaacccugcucuagauaguugaaaaaaauccccuugggacgggggagggauggcauuaggagauauaccuaaugcuaaaugacgaguuaaugggugcagcacaccaacauggcacauguauacauauguaacaaaccugcacguugugcacauguacccuaaaacuuaaaaguauaauaauaauaaaauuaaaaaaaaaaaagauuuccaagccacaaaaaaaaaaaaaaguuaguuauaaugugggaucugaaauaauaguaauaagauauucauaacuguggccauuaaaauccauugaccuauacauuuuuuuguucaugcaugauuuuuuuuuugagacagggucucacucugccaccuaggauggagugcaguggcaaaaccauagcucacuguagccuggaacuccugggcucaggcaauccucgucucagccucccgauuagcuaggacuacaggcauacaccaccacagcuggcuaaauuuuugucuauagugaaaaaggaaaauaaugucuuaguuuuacuguaaaauaguguugcccucauaggcaccccaaaaggguccucagcccacacuccaagaacugaugccuuaauacuaugcaauucucaaguuguuauuacuaauaaauuaaaaaacuaaaaaaaaaaaaaaaaagaaaaaaaauccccuuaugauuucauauaguacuauuuuaugauauaauauuucaucuuugguccacuuggacuuuacuuaugucuaggcuagugauccaccuuugcuuuuuuccagauggcuuucaaguuguucuaaaccacuuauaaaaauauuccaucuuucagccaggcgcgguggcucacgccuguaaucccagcacucugggaggccgaggcgggcagaucaccugaggucaggaguuugcgaccagccugaccaacagggagaaacccugucucuacuaaaaauacaaaauuauccaggugugguggugcaugccuguaaucccagauacuugggaggcugaggcaggaaaaucgcuugaaccugggagguggagguugcaaugagucgagaugaugccacugcacuccagccugggcaacaagagcaaacuccacuucaaaaaaaaagaaauauuccaucuuccaaugauuugaaaagcuaccuuuuucauauucuacauucucuuuuuauugguaguaaucuuuauuauuuucauuguacauacuugauacucuacauauuuugauaaucuacauuccccuuucauuuuuccauuucuagaccauucuaaugauuugcaaaucacuuuuaaaaugagagccaauugagaauauaauugccuugaaaauaaaaauguuuaaauugauuaacugaaaucuuacauuuguauuucaauacaaauauauguccagacuauucaagcuucuaucccuauauauccagugucacaaaagcuaagagguuaucaguaaauuuacuuuucuaaauacaguaugcuuuaauuuccuaaucucuaauagcaaggaucuggcauagcuaauaaugaagggucuuaucauuaccuccuguauaaccuuuccucugacaaauaauaacggaacagauuuauuaauuugcuaaucuuucaagcuuuagauauuacuaccaaugcuccucaguuaucaaauacguggaaaugugucuuugaaacgguaaaccuccugaaucaacuacggguagggcuggaauuaguaauauaaaaggaggaaggauguuucucaccacccuucugaggcuguguuccugcuucugugauugcuguuggagccgccauggacacaggcuguaaaacacacacagacagacaccacaaaucuuuagcuucagucacucaaacuuuugccucguugccuuuccuauggucuuuguaaaagggcagaaagacaguauaugugaugaaacacuuaugucugagaacauuuuaucuucuuuccuuuuucuuuuaaagucuaaaagucugauguaaagaaaggcaccuuuuagggccaggcaugguggcucacaccuguaaucccagcauuuugggaggucaaggugggcagaucauuugaggucaggaguucgagaccggccuggccaacauggcgaaaccccgccucuaauaaaaacacaaaaauuagccgggugugguggcgggcaccuguaaucccagcuacucgggaggcugagguagaagaaucacuugaaccugggaggugaugguugcagugagccaagaucgugccacugcacuacagccuggguaacagcgcaagacuccugucucaaaaaaaaaaaaaaaaaagguacauuuuaaaagaaugaauuucuacucuuaauucuugauugcuuucuuaauuuuucucauaggaugcuuaaggguauaacuuggauauucacagaaaaacaguuucaaucaaaacauuauuauuauuuuugagauggagucucgcucugucacacaggcuggacugcaguggugcaaucucggcucacugcaagcucugccuccuggguuuuacgccauuguccugccucagccucccgaguagcugggacuacaggcgugcaccaccacaccuggauaauuuuuuguauuuuuacuagagaugggguuucaccguguuagccaggacggucucgaucuccugaccuugugauccgcccgccucggccucccaaagugcugggauuacaggcgugagccacugcaccuagcccaaaacauuauuuuaucugacaaaauuuagccuccucugaaacaaaaauacgaaauccauagaauugaucuauggcacaaucugaccagacguacaacuaaaaaagcaccuuucaaauaaaaucuuuuccauagugauacuccugagucagcaugaaucuuucauuaaucagucucauuucuuuuggcuagaauaagcaggaacucugaauacauguuaaagguauuaauaaugguuuagguuacaguuugugucccaggcauauaauauauuaggguuaugaggagauuuuaucaagauuuucaaaacuuacaccaaccgcagaagucacugugaucaucucuggacuaaguguucuucucaauugagcaucaagauccucuagagguugcugggacugaaugaaaacaaucacaguaaauacaguuccguggcaccuucagagucacgauauauagccaauuuagauaggacacacuguuuuaugcuuuauauuggcacaacauaacauuugucuuuauggaacauacaaaacuauacucaaauuuaguguacugcuuugauuauuuugccaguuucucaagauuguaugucagacucucaaggcucagaguaguucauguuuuugcaguuuaagagaagucuuauuacauucuauguuugauguuacucaaaacgguagaaagaguuauuuauuugugcgaccuuuaaaauauauugugaaaaauguacaaagaucuacugguagauucacuguaucucauguucccucuuuucuuucucaguuuuauacaucuuucugggaaggugccccuaugaauaaaagauggcauuaacauauucugucacuaucacaggguauuauuuuccucuuucuuacauguauacuucuucccuacagaugguggcaaggaggucuggguauuccauccuguuaaccauuccauccaccgcaagcacacagcuuccuucuacccuuccacagucuaauccuacaucugucuuggcuucuaucaaucuauucuugcacagucuuugcuuaggccuuucccucuaucuaggcacuagcuauuuacccuuaccccuccacaugucucacuugcuauuuuuugucacacuuuauacucccuuagaaaucugaauccauguuuuuaaaugagaaaauaaguuuaaaacuaauuuucuaacuccugauuuacggacuuucacaaugcacuuucccccaaaugugguggcugauggagugcuuucucuguugggguuuuuacuucauuguggcaaguuccucaaauaguguuccccuguacauugggaccaaagaaauagggauaaauuccaacucagcuucucaaguaagcaauuuaccauguuuuucuuauuucuuauauaugauucaaaaauaaauuccuaauuuaguuuaaaaguuuacuggcuugucucaugucagaagauuuuuccuggucacaacagauucacaauuaguacuuuucuuauggaaauucaacaaauguguuggcgguggacugcggugggaaagagaaauaauaaauauuacagguaauucuguccaccacugcacucaagugagcagaacugugugagaugggaaucucaaguucaugaggcuggucucaguuccuccaugagugaucucauaauguuagcaucucacugagcucgguggcuuuuauuuuaaaagagacagcacacauaguuuucaugaaacaucaccccuauaccuaccuauaaguaagcuaauuccuucauuagguggcuagugaaagaaaugaucaacauucaagaagagacugguugcucuggacucgcggaaaaaguuucucaguugccauauugugcuucuccuuucuagggcacucucaaaguuaauuuugauuauauacgcaauuucgcuauucuacagaagugugagugauaaagggagcuauaugggucugacaaaauguuugcuuugcuguuuucuuccuucauaagauauaaaaaaaaaauuaguaucaaguguuuuuggauaaccggaagcaacauuacaaacaaaagagcuaugaagcuucuuacuuaaguaggaacugggucauugguuauaacauuuuaaaagaaagguguuacuaagucaaagacaaauaggcaaaagccaagaccacguaguggagaacuucagcaagcuuugucaaagaaaguagggcacaggaagaaauuugucaagucuugaggcaccuggguuagagaagguccuggaaaagguggcagcugcucgcuggguagaguaccugcuggaaguucaguacccacuggcagcaccuacagacaacaaagggaaaaucaaguccgugagacgcuaaauauaaagacugcguacugaagagcaaaucaacuaauuugaaugcacaaacauaagaauaaaauauauauaguuaagacauguuuaucacugagguuacucucugguaucugucuuaaaaaaacggugugacaacuaauguuguuauuauagggguuacuacgauauaccuauaaaaugaauaguaaaauacaguaaaaaguuguccccuagggagaacagaacaaaggcuauauguacauaaguggcaguguccagauauucuugagcuacuuauuugguacaguauguaucagacuuucgccauguaaaacaagauuuucugagaaaagaaaacaguaacugguuaagaaauaaccaaugggcaggucugauaacaaaaggcaucagaaaucuaauacuauuaucaagaauuucuauuuuaucugagugaagauucugcauuauccuacuauaaaaagaaccucacaucaauggcaaugcagaaagaggcugaagcauacaauacaguagacguaacacagccuuguuauuuggagaagguggcagaacaagaggaaauccaccacagcauaauuagauaauaaauuuuaguuacuucaguccuaggauuagauuauuuauuucuccucuguaucaauuuccuuacuaacuuccaauuuuuuauaacccccaaacuguacaacuguggaaucuacaacaaaaccaaaaauuugcuucauucucacugaaacaaagacuaugaacugcuauuauuuacguacauuuugcugacagaugcauuuagcucccuuuugggauacagacuucuucaguuuguaccaauucagaagaaauaccuguauuuuacccgauaauuauaccaucuuggaaaacugugcagcauaauuaacccuaaaauccugccacacuugaaaaaaaaaucucauguucauuguagauauacccucaaacugcugucaauuuaauaaauacuauaagccagguaccuuuauaaauauguuucuaacuuacaaggcugaagugaaaaauguacucauuagggagaaaaaaaacugaucauauuuaucuaauuauuuuauaacaauaauuuuaccggagccuuaguuagagguggcuuggagggagcaguuccagguuucacuccugauguaguagugcugacugggguagaaacuugcccaggugugaccacugguguaacuggcaaagcaacuguuccuagugguaaauugguuggugguaagcaaguacuugugguagaagucaggaguuugcuuggugcaacagcaguaguugggaugccuggugugacagugcucucuaugacuagugaggucuccagugagacagaggcaugcugagcuccagaugagcuguguucacugaacagagaccgcagcuuuucuucuagagucuuuaugucaucaauuccaggagcuuuggguuguguaucagaaucuacuucaggacaaugaguauggggcugguugggaagcaaagcugguugaggcugacuaugaauuagugucugcuguacagcaggcacauuggcaacaggcuguaccaagggugggauacuagguacuugggguaauaaagguguagaaguagguccugcugcuuggggaagaauaggaguagaagcuaucacugauggaaugaccaaaggaugcagcccaccaggcugagaaauauaacuagacacuccugcuccaggagaggaagaggaagauggugcagagagggagaaagccaauccaguuguacugcuaugagaugucuuaucuagugagugugcgcuaacuaccacgguuucagcuaaaguaggaguagaaguacugcugcuaagcugaaugcacagcugugaagcugugcuugggaaugaaguggugguagaaacugauguuaauguggcucccacaguagugcugccugcugccugcugagauacuacagcuggaggcuuaggaccugggguagcaguacugcccccugcagaggcugaaguugcugaaacuguuacugaaggauacagugcuguacuagaaacaacgaucucagauguggauguggggacuugaagugacggggauguaguagauauugagacaacugcagguauugugauacuugaaacuacgcuggaaaguacuggugauucagacacaggugguauggggagaccaccugaaguuaccacaccugugcugguggcaacuccagcaauccccucuucagugggcacuguaaccucagacugaauuacugauguggaaaugucauuaggagggcugcuuguugcagggacuggugcuguggcugcugcugugguugggacuccagcaaugcuacuuaagaaaggagguacuacuggaaauguugguccuguaugacuaaaguuuggaggugcuguguuggguccuucugucauuugggcacgucuaaguucagaaaaggccuguuguagacuaagggaugaugcagagugagacaaguucauuccagggcucugagcuguagaggcagcaacugcaaaggaauacaaaaagauaagaaucagcugauuuuaaaaggauggauucaaaagauugucugcuagccuaagucagcuccuauaaauaucuguuuuugauaaaaaauauggaguaaucuuaaaacauagacaacaguacuaagugcagaaauaaacacauacuacaauaucuauuauacagacuauaucuugguauggccgugcuucuuggcuuuuucuguaauucucuguauucuucaucuauuucccucucccauauguuuaucuguugguuauaacuucaguuuucuauucuuuuuuauuaucugugucaucauaaauuacugcuuuaugauuaagcuuucaacauagcagaggcacuguagaauuuacauaacaauguggcagaaucaaucccuuaccuguaucuguuauuucacuggggaaaacuuuugauucucguaaucggcuuucuggcacaggacucacuauaaaccgccuucccgcagaaugaacaacuugaguuaaagaacugguaggaaugccuggucaaaaacaaacaaacaaacguaacuuaauagcauuauuauuauaaauauuguuagacuucauuauuggcacauacaacugcuuuuuuugaggcacggucucauucucucacccaggcuggagugcaguggcgcgaucucagcucacugcaaccuccgccuccuggguucaagcgauucucgugccucggccuccugaguagcugggacuacagaagccugccaccacccucggcuaauggcuucuuaagucaaagguaaaaacaaggaaagaaaauaaauucaccuauuugcuguggcauggaagacgcaggaauugguuguuugaacucuccuuccaauuucuacaacaaacaaaagugauuaaauacauucucaaaugcaaucucaaugacuaggcaaagcaaacugccacaugugaagagaacauaaaaguuuguugucggucaugggugucaggugauaucacuggacauuuugcauagcaaauuuagaacuaugaaaauauuuuaaaucaacaaaguuucacuaugggaguggugaaccuaccugagaaccugaaaagccauagucauccuuuccuuguagacucuccaaucccugaucacccucugguuccacacugacauccucacugagcauuucaucagcuuuuucaauaauuucucgcacuugauccacaaacgacucucucucuauugcuagaauaaagucauuguucaccuguaaaagaaaugugaugucagucuaauuagugucauuucucaaacuuuaugucacuuuuaugacuucuguccuaucugcauacuuaccuauauuuuuauuuauuuuguacucaaguuagcucuucucuuuuuaagaacuucaauaucuaguuagacauagccuagacaaaaacaucacuaaaucacagguugggugugauaguuuuauucacauugaaguaaaugcauaacuuuaaaaaaacauggauuauaaaauauggcauauuugccuagagcaauggcuauuaagaucaaguacuaaggaaaaaccuagaacuccaaaugcagacguaccauaauuguugcuaucuccucgggguugucaccaucuaggucaaauuugaauguaaccauuuuccuauuaugagucucuaauugacauucuacuacucggucuccuuuauuugaaaccuaaaaagaaaaaagguacaucaucuccaaagaccauauucagcuuuauuacugaauuucagaaaagcaaugcagauuagcacuugacuuuaugucuaaggaagcauaguguuaucgcuguuccuuggagcacuaguacuuugucucuuaaacugguagcaagaaaaaucuuugagaagacguuagccuuugagcuacuuacuaaaacucucuauucuuuuucuaaaagauaaguagugcuuuaucauagaaauauggaauguaagaauaucauuuggcuaauuauaagauccuauacauucaucaauucaucuaagccuuaagaaauauuuaaaugauauuaacugcuggcccuaucauagcuuuaugaacuaccuuuucauuuuucuaaaaaugugauauuuaagucaaagagacugugggcaugaaaugagaagaguacuauauaaauuaucuggcugggugccuguaaucccagugguuugggaggcugaggcaggugagucaccugaggucaggaguuugaaaccagccugaccaauauggugaaacccugucucuacuaaaaauacaaaaacuagccgugcgugguggcacgugucuguagucccagcuacuugggaggcugaggcaggagaaucgcuugaacccaggaggcacugcaaucacagugagaagagaucaugccacugcacuccagccugggcgacagagcgagacuccgucuaaaaaaaaaaaaaauuaucugucacacacagauaguuaucuuuauuuuaugaagugagugguuuggauuugaugaccucuaaaaucuuuuucagugucaaauuccuuuaacaacaugaaacucacaaauuaggaauacuuacauucaaaauucuuaauuuugggcgugaaguuuuuucaugucgagagcgacuccuuacagauuuucgguaaugccguuuuguaguucuuccuucaugccuuccacuggaagaugggacguucucauugccaucacucauaccugaagcaacaucugaaugugcacuuugaaauuuaaaaagaaaaaaaagugcaguuuauaauaugagauuuaaaggucugacaguuuggcguuucauaccgucuuauuuaccagucaaggaaggagaauucuaguuuuacguaccugucuacagaggaagccaaaguggucggcuggguagcuugggucugugcuacugcaacuggcucugcaggagcaaccugagagacucccugaguacucugugaaucgaaaagauaacucaaaucucgguaguaauagauuuaucauucacuauccccaauaaucuacuuauuuuuuuccuuaucccuccccacuacguccuagaagcacuaaauuuacuaguaaauucucaauauucagcaucuagagauaauggucuuaaaauuccaaaggaaguugcuaaagcuagucucugguauagacugcaugguaugaggucagccaacauaucugcuaggcagugugaaccuacaacuugccaugcagccagcaucuuaccaagagugugcaauagcgcagacagagcauaguacaaagaugaauucagaucuucuccuagcagggcaaaaaugauugcugagagcacaggaggguaagauacucuuaugacugccaauggaaaaaguuugugaaaggacaagaauaauggcuaaaguacuagcuagagaagugaagugcuaauaggguucaucuucuccaaggcacacucacuucccaacagaacagccaguggaaacaaggaccccacauuggcauuucauucugcuguaagaaaaagucaugcagaaguuaguuugacauggucuccaaauaaguucuaaaccaggggagccuguuucuuucuccuuuaucauuguuguccaauuacauauauacguuuuacauauaaacaugcaguaauucuauuuaccuccaaaacugcuugcugggaggauguagugggggcuugugcuaaacucccuccuggcugggacacuugaaccuguccuccuacaccacccauaggaacuaaaagauuugauuccacauaaggcugcaccacugugggaaaguacccagguguagccaguacuucugucggcaugggaggggauaggacuguagaauggaugcaaacagaagccacguuggaagagggagcaauauuugaaucuccuggguacugugguggcagucgaggugggaagcccugugacagaaaugaggaaggugaguuagagcagguugggggucaauaaauuagcaaaacagcaagacaugcaaaaaaaaaaaaaagaagcacacagcaaagaagaauaguagccaaucucuuucuaauaaucuaaagggcauauaaagaccacauucuugaaaugaaguaguagacugguuccaacagaagagacaggacucuacaauacuacuuuauugucgguuaucuucaccuagagaugauuuaaauaggaggaacacaauuucuuccuagccaaucuuaaauggaaaaaugcaaaaauucuuccacauaacagucauaucaugaaaugcuaauuuucccagucuaaaccccgaagcuuuuuguugauaccauguuggcuauucuauuuauucuacccauauauguaaaaguugccagguguacuauuaaccacaucuagcauucaaucagcuuacagugaauacugagagaaccauuuuucucugaagaagugucuugagaaaaauggaucaggaaucacugaacaucauuauccaauccuuucucagaauuuuacuauuuugcuucucuaguugacauguuauugcuaguuauucugacacucaacuauuagauuuccauguuccugaugaucuacuaggaucaaacucuguggugcccucuuuugcuaacuaacacaauaccugguacagaacaucuccagaggaaaguggaaccucagcagcuuguccaagguuagcugguauucccauggacugaacugcugguuguaggagcugugggugaaccugacuuggcagcugagucacaggcugcagaaggguuggaagcugacuaggaaccacaguugauacccccgggaucgcagcuguuguagcagaugaagccaacgugagcagaggcugaguaaugccagcugccauugugaugggaagggaugagaaaccugucugagccguagacacaugaggaguugauaugggaaucugagagacaggguacugagggagcaagggaguagggagcggcugucccacuggaaggaaaugagcaccagaguggacuggaacaaccgaggguugugucgcaacugggaucugagguucgccuuggauaguugguacuggcugggaaacuggaagcugggaagguaaagaaaaacaaaacagacaggcuuaaaaaaaaaaaaaaaaaaaaaaaagcaaggcugccaaaagcaagauuuauguauuagccaaaaagaaggaaaaaacaaacaaaaaaaaaaacaccaaaccaacaaaacccugcauacauuaguguuaaguuaauaugccacauaagaauauggaaaggagagcaggagagaaagaggcuaaauagacuauuacuguucuacaccuuuugucauagaaauauuugcuaaugcuucagcauuuggcaauagaagaggacccuuccauagacaagggguuggcuuuuuuuuuuaacagcuuuauuggaauauauuuuauauaccauaaugcuaucacuaaaguuacgacugcuguuacaguaguuacugaaauucaaaugaauuccuucccaguggaauuaagauuucauucguauuauuucuaaaauucuuaaguccaacauggcucaauaaaaauugguauaauucacauauuucacucauucuaggaugcaaucaucccucuccacuaccugaucauuuuaacaugugagaaauugggaucuacuuuauaacugauaaugugguacauaaaauaugguacauuuuaaaguugauagcaucucagaugugaugaaauauuaggguaacaauacacugugcacauacaugcacaacaguacucaaaaauaaaguugaaaaaaggucauucagaaaagcauaccuucuacaggguacuucucaagugauuaggaggacuacuuaagaaaaaaaaacauuccacacaguaaacagugcagaaaucuacaugaaaauaaagcauaguuucaaaccuagaauaucagacauagcugacacaauucuagggaaugucauagguucaguuaccagagcaccuuuauuuaaccuguuauuucuaauaccuguuacaucaauuuuggacugguaagacuagaagugaaacuuuggauugucacugcugucaguaacguacccauuuacauuaaauaaugcauaugcaccaaugaggugaucuucacuucauuucugcaaugagauuaaccuacuucaaggguugguuacccuuagaagaaaagguagaagucuauccacaugaaaggacaaguuacauggaaaucccuuuuagcacccuuucagaaauuaagaguuuaccuguuuaaaaaaaaaaaaaaaguuuaccuguuuuccagcugauacuugaggcaagacuuguggagcuugaggcugacucacuggcugugcaguaguggccucacuggagguugaugucugugaaagugaauacugcacugucuguugaggaggggcugucugcuguauucccugcugcuaagaauaaaauacaaugauucaguuuuauuucaaaucaauaacagcauguuucuaaggaagcauguuuaccuaaagccuucagugucuguaaauaaugaugauuuuaguaaucaagacaugcacaaacccaaauucaucaauuuccauuauauauuuguuuucccucugauguucuuugugauggugccaccaggaaaaauuaaccaaucuuuuaauacucaaguuaccauuggcucuucacccaauuaucucccucaccccaacaauaggucuuuacaaagacauuuacauaacauauccagacaguuccuuuccccaucccaucccugccauucccuuuucccuaucucuuggcaucagcucucucuuuggcaccuauaucagauagauccaauagcuuccuuuaaucuuuuuuccuuacccuauuuuaucaacuguauaauuaauaugcuugaagaauagcuuugauuauagcuacaaaauagggaggaaagcacuggauuuggaauaacagacauuuucaaauuuuagcuuuaauauuuacuagcuguuaaugccuuagauugcuuauuuuauuaaaaaaaugaaguuucucuuuuugaaacaaggacauuauuuuuuaacucaaaguggggcaaagggaaugacaccugggaaucuacuauguacuagggacucaaguauaauuuaaugcauggugcguaauuauacaccuaauuuaaugcauggaacauaacuguacucgaauacuaaauucuguaauaaaucaagcaaacaaaaccaaacaaaacaggacuaugaccccuagaguacugccccuucugucuaacaaauaaaaacuugaggcugggcgcgguggcucacgccuguaaucccagcacuuugggaggcugaggugggcagaucaccugcgguccagaguucaagaccagccugaccaacauggagaaaccccaucgcuacuaaaauugcaaaaaauuagccgggcgugguggcacauaucuauaaucccagcuacucaggaggcugaggcaggaaaauugcuugaaccugggaggcggagguugcagugagccgagauugcaccauugcacuccagcaugggcaacaagaucgaaacucugucuccaaaaaaaaaaaaaaaaaaaaaaaaaaaugaaguuuagggcugacuuucaagaucuucuaauaccuaauuuauauuuuuucuuuaauacaacaucugcuuguaauaaaaauuuuaacuaguacaucauauuauaaaguuaaugaaaauaccccuaauccuauucuccagagguaaccacuauuagucguuuggugcauaaccuucauggauuuuuuucuaugcguaaguggccauuuucacauaguuuucuuuuuuuguuaaaauaaacaaaacaaaaacaugccuuuccuauacauaguguucuauagcauacuacuuuaauuucuaaauggcaucagucuccuaaugauaaacacuuugguuguuucauuuuugcuacuuaaaauaaugcugcaaccaacagccuuuuacguaugugcugguauacccauacgacuaauugguuacugcugguauaaagauaagcuauuuauuuguacauuuauuauguaucuugccaccuugauaagugucuuagauuuuguuaggugauaaucuacaaauaauauuuuugcucuucuuauauuuaugucaauuaaaaucaccaaaagaaugcuaaaauauaauggcaacagcagucauguuugguuuauuccuauuuaauuauuucugauaauguauucuuuuuuuuugacacggagucucgcuccguugcccaggcuggagugcaguggcgcgaucuuggcucacugcaaguuccgccucccagguucaugccauucuccugccucagccuccugagcagcugggacuacaggcgccugccaccacgcccggcuaauuuuuuguguuuuuaguagagacggguuuucaccauguuagccaggauggucuugaucuccugaccuugugauccgugcaccucggccucccaaagugcuaggauuacaggcgugagccaccgcgccccggccucugauaauguauucuuauuuuaacuuuuaaagaagcagaaauggcugcugaauuacaugaaauuuauuuucugcaaacuaagauaaaccacauguagccaauucuaaaggugcucugaauauaagacaaauuuguuaauuucccaccugagaaaaaggaacuaaaaaaccagaaaaccuuuuuuauuugccaacuugaacaaauuuaaacuuuaaggaaugugaaugagauaucuauaauuaucuaacucauuaauuuacacacguaaauaagauugcauauuaaauauauuaauucagaaauacugcucccucucccccaaacucuacauagguaaagacaccagcaucuuuaccuucacugaagcuaaauuaugaacgcuccugcaguuuucuggcauaacauaacacauuccaucuaaguuguaucuucagguaaaaugugcagugaaaagcaccuauuuacauaacauuaaaauaaaacuagauuuuuuuuuccuuucucuuauagguuuuuauucauguaacccuuauauugacaucuuaaagagaucuuuaagccaguuguuuaaaaucacauacaguccucagaauagugaagucauauugcugagaauaaggacuaaauuuauguuuauuccuuaaaaauauucugucugauguucucaaugaacauuucuaacuacaugagcugaagucuuugcaggcacauuuguucucaccuguuucauuuuauuucauuaaccuuuuuugguuuguuguuguucaaaguaaaggacagugaaaacccuguaauaugagaguacgauaaaggucugaauacaugguuauuccccucuuuucuaacggauaaauuugaggaagaauucccauguuaucuuugggcauaugguaaucauaugcucccagcccccaauacauccuccuuaauucaaaauuaugcucauaucaaaauuuagacucuaucaacucuuuccugaacuuauaccuucacauaucuaugcucuaguuaaaccaaacuaaaggcacauuuguuuuuguacccuauuuuucuaucuuagggccuuucacauugcucacaguauaauuuuuuuaucuucuggccuggaauauucuuuauuucuacaucugagucuaacuuauaaucaaaguccauuucaaaugccuccuuuuuccuaaagucuuccugauauucccuuuccugcuugggagagauguuaauuucuucccuuuuuuuggacauaauuggguaguagucaaauggugagcuguggaauuagauuauuuggauuuaaauucuguuuuuaccucuuauaagcuguaaguuuggguaaacuacucaccuucuccagaucucagcuuucccaucaguaaaauggaaauaauuauagcaucuauacuuauaggguucuuaaaacgauuaaaugagaauguagguacaauguacaaagcacuuuaauauuagcuauuauccuuauuuguuuuuuagaaauuuacauauauauuuacuauauuauuuagacucuuucaaaguagucauaccugguccagcucgguagaccuucaguaucugaacucaauuaggaaaaaaagcugaaaggacugucaaaaaugagcaguuuuauggacaaauuauuucuuugcuuaagacaacugagaggcaucuaugacagugacccuuguauuaacaucuuaaagagaucucuaaaccaguuguuuacaauggcuaacgguuaauguuacaucuuagagcaucuggggagaagugucaccucuggauaugccagaaguacaugaugaucugcugugcgcagucccacugacuaauaaucagcacuucagccaggcagggguggucuagcuuaacaguuuagcaucaugcucugcccaagcuugccucaugaaaccaguucaaacagacuuuauggauaguaggguagguaguucacaacuucggugcuuuuuuuuuuuugagaugagucaugcucuguugcccaggcuggaguaugguggcaauaucauaguucacuguagccuugaacuccugggcucaagugaucuuccugccucagccuuccaaguagcuggcacugugucugacaaaguucacaacuuuguuuguggucacaaagcuuuucagcaggaggcagcuauuuuugguaccuugcuaagaucuaguauaucacuauacgagacccuacaaaaacacacaaaaaagcaauuccucauuuacuauguucaagaaacgcaugaaauaaaguaaauuuuagcaaaaguauauuucuuuccucacuaaaauaaaacaagagauaugguucucuaaggugggauugggaccugaaaguacguaaaacaaaaaucaugucuaaaaauagacuauccauauaguacaaaaaguuuucaaccuuucuuuuuucaaacguggaacuccaauaauuaaaacaaauaaagacagcuucugagguacauuugcagaaucauuaagucccugcagaacuuuauuuaaaauggaagaaacaauacuauucuaggaaucuugaauucuggguuauaauuuguagcucccuuauuaucuaagugacuuuggagaaguuaauuauucuagaccgaauacacuuccuauauauaucgagggcucaauuuugugauucuacaacacaugcuauaaaaguaucuaaaacaaaaacaucacugaaacaaaaauuaauuuuuguuucugcuguagagauagcauuuagccauauuuuuuucuccuggagagguagcuaccuaauucuuuuaaucugacauuuaugguacugcucucuucuuuucucacacucuuucuuaacaugaaacucaaugaauuauuuuauuaucuucuucauuugauaguaaguauacauacauauccccaaauacaagacagauaaccaauuccuuuggaaaagaaaaaacagagcacauacaauuugcucaguucauugguguucgucuacauccaaagauaagcaaguuaggagauuaguacucaguacuuccauucucaaccagcuuuaugugacuuguaauuugcauucuaauuaggaacuguuaauagaauaaaacagauuuuguuaagguuggcaaaaauauguuuacuugaauuuaaccagucuuguuuggaagaaaggacaggugcaaaacaaagcauauaagucccaguccuucaguucacggagugaaugcauguauaaacaaacuaaucaacuguuucuguagaaagugccuuuaagugauuuucaucuuguacaagcaacuccugaucuuaaaccaguaucgaaugacuacaugaccauauguuggacugaaaaagggccauuuguaauuaagaaccgaaaacuuuguuucaaaaccaaaaacuaauagaaacagaagccaguuuagaguuugcugauuaaaaaacccacauggggaacuaacauuaggaaguuugcauuacauacauaguggcuacaaauuuuauguagaauagcuaauaaguauucaauuaugccaaaaaugcauuauucccuugcaaauaauuacuauuaacuaauaucagugaugcacuauaaauauuuaauuuuagaauuaccaguuuuacuguuggauguaucaggaugacacuaaucucuugaauuccuugaacuuucuggaacaagccccccaaaacaaaaguuaaaauauuuuggcugggcacaguggcucccagcacuuugggaggccaaagcggguggaucacuugaggucaggaguucaagaccagccuggccaacauggugaaacgccaucucuacuaaauuagccaggcauaaguagaacguaauacaaaaauuagcugggcauaguggcacgcgccuguagucccagcuacucgggcggcugaggcgugagaauagcuugaaccugggagauggaaguugcagugagccaagauugcaccacugcacuccagccugggcaacagagcaaggcugucucaaaauaaauaaaaauaaauaaauaaauaaauguucuugaaguaauuguucuuagguuuucauuagaugcuucuuagcguaaaaucugacacaucauucuacagauuagaaauaauuaaaaagaagugcaggauuaguagaggcaagcacaaugaagguaaugacaaaucacugcugcaagcaguggaaaaaaagagaaaaggaaugacauacucuuuguaccguaaauuauguguagaauccaggcugggugagguggcgcaugccuguaaucccagcacuuugggaagccgaggaggguggauuaccugaggucaggaguuugagaccagccuggccagcauggugaaaccccgucucuacuaaaaauacaaaaauuagcugagugugguggcaggcaccuguagucccagcuacguggaaagcugaggcaggaggacugcuugaaccugggaggcggugguugcagugagcuaagauugcaccacugcacuccagccugggugacagagugagacuuugucucaaaaaaaagguguagaauccucuuuuaaaaagauaauuauaucaguaauaauguaugucuacuaaauuguucaaaaguauauuaaacaaaagagauuuuucugaaacacagaaaagucucuuuuuuuucuuuguuacugaacacaagacaugguaugccucuuaauuuuccuuucaaaaacuuagcaggccauuuauauaacaaaucacaaaaguuaaaauaguguucuggccacugcuaauucauaaaauguugcaaugcauuguucucaccugcugaggauguuguauggguugggaagaugaaaccccuguuaagcuacuugaggauggcugacccuggcucugccccugugccugaaggaaagaagugaacacaacaaauuagagaaggccuaaaguaaguguauagaggucaggcuuuugcaaugaauauuuaaucuccucagaguuugcuugaucaaaaugaaacauuaaccugauuauguaugggagaggccucugggucaacuuuuguaagaaaaauuuagaaaaggaucauaccacacaacauguucugaucccaacccaugcaaaacccacugacagugaaaaccuaagcugucaaugcugcucaggcuguaauuuuagcuggcuagaaucgucagauucauaauaaaauuuguuauuagaaauacaauaaucaggaacaaaguauuaauacuaucaaucugaaauuuaucugaagaauuaaagaaagguauuugguaaugcuaauuugguaauacuucuuguagugccacaaugacuuuuaucaaaaguaucaaaaaaucuguuaucaucaacugccaaguaccuagggcgaucauugcuauccaggagcaauccugccacccccaggggggcacuuggcaauauguggagacauuucugguugucacaacugagggagauugcugcuacuaguauuuaggagguauaaaccaaggauguucuaaauagccuacaauacauagaacagcccaccacaacaaagaauuauccaaccucagaugucaacaguguugagucugagaaaccccaacuacaguguuucucacuagaaagugagaaaugaugcaggacuauauauagguauguuaacgaaaugaaaaggcuaccacuuuugucauuccauuucaguuuacaagggguuccuuaaagcuuacauggauauaauaucacauuccacugcagcuuaacuauuauaaauauugauuccuucuguaguaugucuauaaauuaacuaccugguauuuuuuacuuuggaaagucuaaaggauaauuacuggcaauacauuaauauuuauaauaggggcugcaacuugaauacugaugugaauauacugcaugcccauguauagcugucaagcuucuggaucuuuuugugucuuaguacagcacuaaauaauugauaauuugugcacauuuugggaguuguuuaugcuccugaugagggaagaacauaggaagaaaguaggaagaacaacacauaguacuuuauguaggauauccaaaugucuucaauauauaacugcauagucuucuauguagauuuuauaagauguacacauuugauaaaauauaccaaaugaauauaugaaacaguaaacacugacuguacuuuugaauucuauuacauucauuacauugucuuuauuugcuaaguguguauaugcucauacacauaaauaacuaaaauuaaauuuguugaggaaaauacaaggccuaagaugucuacuguuccuuagcuugcaacauaucacaaauucuuauaacaaaaaaaaaaagcccaccacucacuagauuguuaguugcuaaaaauuagaaucaguccuuaauuuuaugaauuagcauuuuauuuggacauauaauaaugcacagcaacuugcuugacugaugccauuuuaaaaaggcauuuucauuuguuaaggcaaauuccuaaacuguuuccuuuucuaucuuuuuuuauucccaugauauacuuugucuuuuuagauccuucgacacuaaugaaaauucuguguauuauuaauauuaccucaaaaacagcauucccuauuuuccauguuuuauauuuuauagaaaaaaaauuuauccuauuuuuuaaaaacuuguuuggaggaagaaaguaauacuuaagauuuguauuccuaaauaaugcugggucaaccauacauuacauacacuugcauuuucacuacugguugaaaauaacgugcauagaagucgugauugugaagaaugacuaaaauucuaguuuuuguguuuuuuccacugguuuucacauauaauagguaaaucagguagcuucucucacauuuuguuuuuaaaugcauauauguaguucacaaccccccaaagauggggaaacucuacugauaaaauuaaacaauauuucuccaaaauccaugauucagggaaauaaggaauagaaaauuuaaauguuauggugcaaaguaggguaguuuaaaauaauuguggaaguuuuccuauaaccuguggaugaagugcagauccuccugaagaaaaugaggcaguuaagaccugcugagaugugguuccuugggggaaacagaagaaaaguggggauucuuguaacacugucugaggcagauggauaaagggcauugagacgucagagccaaaaggugcagcugcucccccuguagggggaggugacugaaaaucacuggggucugaagaagugauuugugaggaaucacuggaauauucugggcuuccuauuggccaguucuguccgauaggcucuaccacagaaacggucaauucuggggcaugguaauuaugcuuuucuucagucacaggcugcaaguagccauguaauccaacugauugaggaggcaguucuucuugauucaaguccacugcaaccugccgauuucgguaaacacgcugagguaaaauuccaccuccuucuccugaagaggagcuuggugugugaacaugaaauucaaauacacaguugcuucugcucucauuguuaugaguuaacacagcaggcgcagaaugaggaacaaagacagggugaaauuucaaacguguagcaucuguacugauaggugcagaaauacuagagaggggagaucccggacccaauccagaaucuaaucuuagauucugaagguguccuaccaggaaagccuguccagauggaaauucaaagacagaacuugaaguagggcccccuuguacuggcuucuguucagguaucuguuucauaggacuugacaguacugaugaguuguauggaaugcccucauacuguucugccacccgggccugguaauguaccccagcuacauacacugcuuccugaggaauaaaauagugagcuucuucuggaaguacuaguccaggucuauagucacuguaaacuugagaugguucaaacauaggauggaccuguaucucacaugacucuccaguuacucuacuggcuguaguacccaacauaacuacggccucugguguccaguuaguugggcugccaccagguggaagaagacuuuggccaacaguccucagcagggguuggaaguggugaguuugggcuuccaggaaggaggugcucuuacgccgcugggaaauggcuacuuucggugggcaggugggagguggugaaaaagaaacuggacguucaugaauaguugggaaaaauaucugugauucuggguauguugggguccccccacacggaugcgccauggacugaggcuguaucaacaugaauaagacaaguaauucauacauucauaugugaaauuacaucagacaugcacaacuggguaguucuguguaacccuaugaaaugguuacacuaaauuuauaauuaauaaauaaauaacaaugcuucuggaaauuaugugcauaguaaaaauccauuaaauacauccagggccaaugaaaucaaucugugggcucuuugcuuuagauaagagcugcuuuuccauaacuuuccucucucaaaggaaauggaagaauuaaacuuuguaaguaauuauuucguuuuuacccacacuuaaaaaguucacucuuaagcauuaauguaaauuacaucaacagaaaaagaguuaaaggaagaguaagaacuaaaacaaggcauaaaagcccgacuaguucuauacuguaagaagugugcuuuaauuuaaacuauugaacuaacuuucccuauauucuuauuacccugugauauguuagaggccuucaguuuuauuuucuuaucaauuaauaguaugccuucuaaccagaaaucagaagagauuuuugguggauaguaaaagauauauaauuugacuagugacaguaaugucuuucuccuaucucucccaagcuagaugauuaauaguuuuauuauauuuuuacuacaugaaacauguuacagaguuaaaucacaaaauguccauuuuucugaucauaaauaagaguugcauaaccaugaaauuucuuuuuucuuuuuuuugagauggagucuuccucuuucgcccaggcuggagugcagugacaaucuuggcuuacugcaaccuccgccuccuggguucaagggauucuucugccucagccucccaaguagcugggacuacacgcgugcgccaccacgcccagcuaauuuuuguauuuuuaguagagacacauuucgccauguuggccaggcuggucucgaacuccugaccucaggugaucugcucacuucggccucccaaagugcuaggauuacaggcgugagccacugagcccggccguaaccaugaauuuucugauucugacauccugguguucuaaucaacugaaaaggguaauauaaaugacagccaauuuuauuugauagcacuuuuuauucuagaagcaguucuagauuuaagacuaaauuuagaaacacagcuugccaaaugcaaacaauauacacuauaauaauucauuacccgcugggcgcgguggcucacgccuguaaucccagcacugugggaggcugaaggggguggaucacaaugucaggagaucaagaccauccuggccaaacauggugaaacccaucucuacuaaaauacaaaaauuagcugggugugguggcaugcgccuguaguccuagcuacucgggaggcugaggcaggagaaucacuugaacccaggaggcagagguugccgugagucgagaucgugccacugcacuccagccuggcgacagagcgagauuccaucuccaaaacauaaauaaauaaguaaauaauaguaagaauucacuaucacagccucccccgcuuuuuaaaagaauucaguuucauucuuccauagggaagauccuuaucgagcuggcaaaguagaucaacuguucacaauagcuaaauaaggauuucuauuuucagucagaaugcucauuuuauuguuauuuacucaugguaugucucaaagccauaauaacacuguauaguucuucauucuccuaaguaaaaaucugaaaauucugggguugcuaguucagaaaguuaacuauauucuuuauuuggaaaagcagcaaggacccacaugcuuaaaauaauuuuauaagauagaucuuuuauaaacauuaauggagccaaagaaagucauacauacuauauaugcaucuaaugcauucauuagagcuacagucccaccuuagguugaaaccuaaggaaaaaauacuuccaugggggaacauuauguaguucuuugguuugcugauacaucaucuuacauaaaugauuaaauuaaaauaaauguucacuccaagguuauucuuugcugacuaagguuauuaaaaaaaaaaaggacucauccaguuuuauuagugucuccuuagaauaaagugaggagaaaaaauguuuggguaauguuugauaaaauuugcuuuugauuaaggcaauaacuuuaaaauuaauccuuuuaaaacuagaauaugaaaaugaaagaauuuuaugucgauaggaaacaggaagauauaaugaaagguaaauuuuauuggacacaugcugguaugugccaaggacauuauagguauucucucucauuaccuccuugcuuuuuauucccccuuaaagccuuauuacaaaaaaguuuccuacaggaauaacugguauccuagaagcauaauauaaccaaguuuaguccuguucuuuauucaauuuuaauuaaaauucuuguugccuggauguauucauugguaauaauuguucauuugucagaaguuuacaguuacauacaguacugacaaagagggaaggcaggcuggagcgucggugcuugcgcugagaggcagagugcauaggcaggacacucuccaaugcuuuagaaagcuuuucggcaaaaguuuccucggggcaguccggaggagggaaggagaaagaggugcagacaguacuggcggugggguggaagagcacugggagagaugcgggacacagaggcaacagcagaaagaugggaacacaaaccgacaugcuacggccacgacgaggcucaacacaaaacaaacacacacaugaaaaacacaguacugugaaaacaaaauaaacaaaaguacaaugauaacagggcauaguugcaugaagaaauguuccauccucucccaauuccacaaagucaguuuuuuuuuugaggagagcuauaacucaacauagcacaucugacagaucacaacuauucacaacuauucugcguugucagucaaggacagguuuaaugaaugaucaugauaaugaucaguuaucaugcuaaauauucugaaauaacaccaaguguuacaaguguaugaauuuaagaaugaccaacugacugaagggugcagacagggaaaacaaugaauauuagcuugcaacuuuggcaaacuuaagauucaacaagaaugaauucuauuaguuuaaaguacauuaaaagauacagagaauuuuaagauuggauuauuuugcaagagcucuggaaaccucagaaaaagauucucauuucuauuuuagaagacaugagauggaaaguuguuggcucacaguauuucuuauacuugccacucuuuauuuguaaagguaaaaaagucaugaucuacuaggaaaaaguuuagcuuucuagaagaaauucacaacuggauauaggaaauauuuuguacuuuuacaaaguaaucaaugggagaauaucuucaaucugaaucucuaaauaauaauuuaggccgggcaugguggcucacaccuguaauccuggcacuuugggaggccgaggcagguggaucacuugaggucaagaguucaagaccagccuagccaacacggugaaacugugucucuacuaaaaaaaauacaaaaauuagcugggcguggugaugggugccuguaaucuuagcuacuggggaggcugaggcaggagaaucacuugaacccaggaggugaaaguugcagugagccaagaucacgccacuguauucccaccugggagacagagugagacgcugucaaaaaaaaaaaaaaaaacuuaaaaaaauguucaggcacaggguuuaauauggcuauaaggcaguaugaucaauaccauaaagguugucuugaauaagacuguuauuuuccuuuuagauguugugaacuaugaaacuauguuuucauuuccaaaacuuggcuguguagaaugcuuugggccaaaucuguggcccaccaauaccaaguauuuacauaucaucauaugauuguuuaguuucauuccuguuuugauuucucucuagccuuauuucuuuuauucuaauuucuaaaauuucacuuauaauuuguccauauuauuguaagccacauuccugaaaugagacaagaauagaauuagacaaauuuuuaaauucucaauauuuaauaauucuucauaauaccuccauagaauacugucauuaaaaagcaagaacgucugcuuuuagagcaucaauaaauauagcuagauuaauggcucaaauaauaucuucaugucauucuacuugcuuucuaaaauagagaccuaaugcucccccaugaugaguauagacaagagaaaauuuuaaaaaaaaagucuuagcaaaaucuaguuauaauaauccagaaaaaaaacaauuaaagguagaaacugacaagaaaugcugacaaguaauauuugucagaacacagaaauauauuuucugugcagucuuuauaaaguucuucuauucuacccucaauuauuuuaaagacagaaaguagauuguuuuaaaaaguuaguauauuaguuuuuuauuuguguuacuguggccauucauuuugagaccuagccaaagcaggauuaaacggacucugaaacaaaugaacaucuuuuauuccaagcuguaggauaaaaaaucgaacaagcagaaguauuuucuuaacagagaaagauuuucauuuaaagaagagcaagaauuccacaaaguuuagauuaaaagcuuucugagaaggggaaaaucugucugcuuaaagaucucacuaaacaagugcuguacagugacaaguuacuuauuuucuaauaccuuucagaggcagaugacguauuuuauuuuccucugaggucaacaaaagaaaugggguauuaucugaugaucuacuuuaacauucucuauaugagaaacaagagugucuaauguaaaacacaggauaauuguguguguguauguguauacaagcauaaaauguuucaggaaauaauuucuauaaguugauucugaaaauaaaucaguaauaaaacaguuaccaacuaaagggaaaaagcaaaagaacauauacuggggaaggaacuuguguccaacacagacuuuaaaaggcaggaacacacacagcaacugaugauuaacucaacacaagcgcuaaauuaaacagucauucaaauaaaggauucccucaaucuagaguacucacaugcagcauucuauaaugguuugaaggucuuaccuguguuuuguacaauagggaaucuuacaggaaauacuuaguaaucauuuuaacaagcuuuugaaaaacucuucucgccccacccgcaaaacauuuguauguccagcuuuuguugcugugaauaguuucaacaucuuaagugcuaaagagagcguucccuuuaguaaaaaugcagacuaaucuaaaucuugcacauagcugcuucauguaggcaguucagcuaaugcccacacauuaaugucuauauccuacucuauaauaaggcuuuagagacacagcauuuuauauuuucuacuucagacucauacuguuacuugguuuguacaaagaauuuuaauuuagcagacuauccauuggcucucauuguaguauuacaugcucuuaagcauuuacuuaccacacuugaggguggauauaccccauggggcugagacugugcuuggacaguagaagguauaugcccugggacugugccuguagaaugugccuguucauguugggaaccauaugaaacugucuguuggcugcucacucgagauucugugaagacagaggaucccugaccacugucaaccgucccaucagcugaaggaaaaaugaaucgccaaaaaaaagagagagagaaagacaaaucacaaaauggagguucacauuuucucauauuuagacccauuauauuagggguaacuaguuauuccuugcacagauuugaacuaaauaaaaaaugaauuguagccauauucaguagauuucuauauuuaaaugaggaauccauauggcuaucacagaaucuuaccaccugaggaguaagggaaacagcaugaaacacuauaagccuuaaauuugacacagcuuucaaagucuuaauuauggaggccaggagguucucaguauuaaacaaguaauuaaauuaauaaccaguguucucauuaguuuuuagucuauauaccauucagcuuugcuaaaagagcucaaccagacugauggguucaauuuuaguagccaagcuuguucauucuucauuauuaaaucuguuuuauuuaaauaaauugugaaaaguagaaaucuacaaauugaaaccuccaagauguugaagcuuauaaaauuauuuuguauccuaaucacauuuccuuaccaccccauccuucuauucuccuagucacagauauaagaauaaagagaagcuagacgacaaccauuucaaauuuuguauaauaguaggauucauaauucaaaaccaaaaagccagugcaaaauaacaagaagcuaaaaaaaccaauuaggagaaucauuagccuaucuguccacuucccaagauacguacauaacacagauauacuggguugcugguacuguaguuguugauguugaucugccucagguucuucagguucuacuuguguagaaacugaagcugaagugguagaagcaguagguaugccggugcuagcagaagggagcugcuugauuccugucugggaagcacuggauuguucuaccugcuguuugagacugcucucuuccugcuuuuuuuuuucuugcuccucccguaccaacugccgcugcucucguuuccucuuaauuaaugauacucugucuuugauagcuuuagccauggucuugugaucaccuucacagacauacccagacucuaccuacagaauaaaaggguaaauuaagcaguaguauauugaaagaaaacaacaccccccaccaccaccccccgccaaaaaaaaaaaaggcauuguaaaaaaaguagagaagaggaggaagaaagaauucucucaggacuggccuuaaccgaacuguaaaaucugcauuaugcauuucccuaccaucuuuguagauacuugagggguggguaccaccauuuuugcagaaacucgaaggguagguauaccuucacuccuuauaacaaacaacgaaacaauagggcaacuaaaaccucaguuccuaaaccaaguaagguacucuguucuauucacuguauuucccccucacacguaaccacuaacauuaaccuguguugauuucacuuucuuuuacaaggcaacuacuuaaucugcuaaaacaacugugguacgaauaugaagauuuaacacugcuccuccccuccaaaaaagcaaaaaagcucagacaauacaaacagcuaacaauuaaacauaaguaacucauaccugaucuccucucagaggcaacuaccacuuuugaaugguucugauaaauccgaguagagauauucugaguuaucuuuccauaauaaucagcuauuuugggcacuauggcaagcauaaauuuggggaaggguuuccuuauggaagagugaucuuuuagacauacuucaaauaauaauacaucaaaggcuuccuacuaguauuugaucaggaaaacucucuucaaaguaaaaacaauucaugguccuaugucuguuuauagaguucauccagauaacugaucaaaggcuaauguaccaauauguagaaacauaacuugucauucuuaaugaaugaugcuuauacaaacugggagucacucaaucuuacagacuuuucaaaaugacuucggaaugcauucuacuaguucuaccuaucuaucucaucuaucuaucccuauguauauauauaucuacauauuuucucaaaaauaacuuuuggccgggcgaaguggcucacaccuguacucccagcacuuugggaggcugaggugggaugaucacuugacauaaggaguucgagacaagccuggccaacauggugaaacccugucuauacuaaaaauacaaaaauuagucaggugugguggcacgucccuauggucccagcuucucggcaggcuaaggcagaaggauugcuugaguucaggaguuuaaggcugcaguaagcuaugauuaucaggccacugcacuccagccuggugacagagcaagacccugucucucucuccaucaaaaaaaaaaaaaauuuacuuuuaaaaaggacuauaaaaucuaacacccauuauaaaagcaauacaaagaaguuuaaaaaaaaaaaaaacacacacacacgaaaaucccacuaaucaaagauaacuuuuagggccaucacaauuuuaugucaaugggauaugccacacacggcacuucaucaacugcuuuuuugcuuaaugauaguauugauauauauaagucuaaaucaauuuuaaaauggcuaaugucaauuuaccauuucuugugcaacaucuucugggacaucucucucuaaaucaaaagaaaacucaauagcuucauuaucuuuguauuuucccuuuaauuucuuaauaucuucaauacguagccauaauuuuauggcuauuuuuucuccaucaucuucuucugcuaauucuacccguacuccuguuuccucuuggaagaaggcaugguucaaaaggucuuugauggaauaucuuccaaacagagggaaaagaaaaggaacaaaaauaaaacaccauuaguuugaaaaaauaauuuucaaauguggccaauuauuguuauucgcagaagaaaaaaaugggaaaaaauacaggggaaaguauaacucauuuuuacauugcugaauuugaagggugccuacagagguuuacucugaaguuauaaaacaucauaacaaucucauucaugaauaagagcugacagugauaauuuuuaaauccaaugaucucauuaguaauaguauacuaguaauggcgagcuaacacaauuguaacauaauuuuuaaauccaaugaucuuauuaguaauaguauacuaguaauggugggcuaacacaauuggcucuauuaaagcuucaaaauaccacaugaucauuuauauagcauuuuauaaguaacacaaaucuucauauuuaugaucuugucugaccaacacccaauuugauaucaucuccugauuauuaggaaauggaggcccagaaagguugagaaucuugcucacaguuauaaaagcuguaaaugcugaaauagaaacuagaaaauaaauauuuuuguuucuaguuugguacuuucuaccacagcaagcuuuauuuacaccaguaaguucucuuaauuccuuguucaauaauuuguguacugggcaagcagaagucugauugugaaacaaucuuaagauaaaaugguuucaauaugccaaucaucuaauaaacugcuccaacaagaguugaaacaggcugggcccaguggcucacaccuguaaucccaguacuuugggaggccaaggugggugguucaccucaggucaggagucugcaacccgccugaccaauauggugaaacccugucucuacuaaaaauacaaaaauuagccaggugcggugaugugcgucuguagucccagcuacucaggaggcugagacaggagaauugcuugaaccuggaaggcagagguugcaguaagcugagacuaugccacuguacuccagccuaggcgacgugacaagacuguguccaaaaaaaaaaaaaagaguugaaacaaacauuccuuuguuuauaguaaaaaguucuuaaagagauuuaaguacccagcauauauaaaaaugaaaacucaaacuaaauuuuuacuuaauaaaggcuuaaaaaccaugaaguuaagcucuucuaaauaacgauguuauaaaaagaacgagacuggagaggugaaaagauggaauucuuuaauucgguugauacaucugauagcucucauucuucaagugguagauuaugcucaauuugcaauuuguauuuguacuagcuggucuccuuuuucuuuuuuggaggauggaaggggguggcaaagauagacuguuuuucagaaacagacacuggaccuucgccaugccugacgggugaugaaucagcuacauggcagaucagauacuugccacuccucuaagagaagcccucuguuaguacaaaugacuaagccacaucuccuuccaaccccugggccaagucuucucuuuuuacucaaggaauuuugauguuuugcucuucuucaauucuggcguaaggacggcaaaucagaccuguaauagcugagcugacuuuaaagagccaaaguuuuauuucaccacuuagaauucaaugguaaaggacuaagaaaagauuuccuguguuagauauuaaacucuuuuuugaguuuuauaaaucaugcugauguuuuaaguaagcaguucucauggaauguagcuauguuuauggugguucugguuuacugaaacucuaccaaaccauauuuuuacaguguuccaguauaucaaaucugaauaaccacaaugaacaaaacccuaccuuuaaaaauguuacaggcacaaauagagaaaccaaucacaaauauuaaauacaccguagaauguguguuguacucaaagcacauuacuuuuuagguuuuguucaaguaucacccagaucaaaagaggcaacuuaccuuucaucuuuguuuugucguaugcauccuucaauaauuuccuucacuucaggaauugcuacuuugucaaaacuggcuggcuucacccccugaaaaccauaaacagaaauacauuaauaaaagcagggccuuugaacuuuguuuuuuaaauuuccaauuaagguucuuuuagguuccuuucuuacuaucccggcuuuuuuucugacucgccugcaggaguugguccaugcagugucacaguuggguagugacaacuuagcucuucacaagaaaacauggaacagugacagcagggucacuuacuuccauaugugacaaugaaaaaauuuaggcagauguuaauaucuucugcuguguuucaaguaaaggaauuuauugccuaaaaaagaaagcuaaauguucuaauugguuagaagaucuuuuguucaaccuuguucccuaaacacauaaaucaauacagcauuuaacuauuuugaacacugaacccaugugugggcaugaauucacaugcuuaguuuggcagggauuauauuauuauaguaaucuuuaacaaacucaaaggaguugaggauuuauauuguuuugguaugauaacugaagagcaaauuguccugcacaaauaaaacacaaugaaaaguaauauauuggacccauacgaaagacaagcucugcaauuaaucucagaagaaaacucauuaccacuaucacaugugauacuacauaguagucaucacaguaauaguuuaaaaucuuuauaaaguauaaauaaauucuuucuuauuuuuuuuuuucccucgagauggagucuugcucuguugcccaguauggagugcaguggugugaccuuggcucacuacaaccucugccuccuggguucacgugauucuccugccucagccuccugaguagccgggaauacagguauacgccaccaugcccagcuaauuuuuguauuuuuaguacagaugggauggggguuucuccauguuggccaggcuggucucgaacaccugaccucaggugauccgcccuccucggccucccaaagugccgggauuacaggcgugagccaccauacccagccaauaaauucuuuaaaaauaaauuuucagguugggcgccguggcucacaccuguaaucccagcacuuuggggaggcugaggugggcagaucacgaggucaagagaucgagaccauccuggccaacauggugaaaccccgucucuacuaaaaauacaaaaauuagaugggcgugguggcgcaugccuguagucccagcuacucgggaggcugaggcaggagaaucucuugaacccgggaggcagagguugcagugagcugagaucaagccacugcacuccagccuggugacagagcaagacuccaucuuuaaaaaaaacaaaaacaaaaacaaaaacaaaacagcaauguguggaaaauauacauaagauguaagaacaaaaugcuacugucuaagagguggggugaaagagaaaaagaucucaucuauucugaccucaucuaagucaccacacggaucaagaguugaagcacugauaugcuguucaaguggcacuguaagucaacagacacauaaaacaaagggaauggaguuggggugggguggucagaaaaguuaaguuauuaaauauacauaaauucugauuaucuauagugucaaugacagauaugguaaaacaaaauuagugacuaauaaaucacagaaaugcauguaaucucucauagaucuaaaugaaauaaaugaaauacauaaaaugauaagcucuaaagucuuuuaaguacaagaguuauauccaaagcuggauaaugcucaauuacucauuguauuauuccgaagacccaauuuggagaauucuacucgcagggcuaacuuuucacagcaaggaacuguguagcagggcugacccuaaaguuaaauucauguauuuaaaagcuucauuuaugagaaugacuacaaagaucacuaucuguauuuuccucaaucuuauuuuuccaacuccaccuaaguuuuucccagcuuguuuuuaucuucauauaauucuagugaagacaaaauaaugcugcugaagcaaaagccugcuuuaauugagcaagcugguauuucaaacuuaagacuuaugaaaauaggaaaugcaagaaaaaaaugaaugccacacacuaaaaauucucugauaguaaaaaacugagcacaguuggcccuccuuauucaugguuuccacgucuguggauucaacgaacuguauauugaaaauucaaaagagaaaacuguaucacaguacugaacacauacaggcuuuucccugucauuauuaucuaaacaauacaguauaacaacugcuuacauagcacucacgguguauuagcuauuguaaauaauuuuuacauguaaauacuaugggucauuuuauauuucuggaacuugagcaucuucaaauuuugguauccacaggagugugggguccuggaaccaacuccccagacagggaggaacaacuguauucugguuuacauuugguuuuaguuuucuacaauaaacauauaaaaacugcauaaacuuucuuuuuguaaagauaaguucuuggccaggcaugguggcucacaccuauaaucccagcacuuugggaggccgaggcagguggaucaccugaggucaggagugcaagacagccuggccaacauggugaaaccccgucucuacaaaaauuagcugggcaugauggcgggugccuguaaucccagcuacuugggaggcugaggcaggagaaucgcuugaacccaggaggcagagguugcagugagcccagauagugccacugcacuccagccugggugacugagcaaaccucugucucaaaaaaaacaaaaaaaaaaagauaaugauaaguucuugcucuguugcccaggcuggagugcaguggugggauuguggcuuacugcagccucaaacuccuccugccucagccucccaaguagcugggacuacaggugugugccaccaugcccagcuaauuuuuugucuuuuuggagaaacaaagucuugcuauguuccccaggcuaaucuugaacugcuggguucaaccgauccuccuaccuuggccucccaaagugcugggauuacuggcaugagcuaacacaauuggcccuucugauuauuuugauagcauuuuaaaagucuagggccaggugugguggcucaaagcuguagucccagcacuuugggaggcugaggcaggaggaucguuugagcccagcuguuugagaccagcaugggcacaaagcaagacccugucucuccaaagagacaaaaaacuagugggguguggcggcacauacgccuguagguccaccuacucaggaggcugggccagaggaucauuucagcccgggagguaaaggcugcagugagccaugauugugccacugcacucucgccugggugacacagugagacccugucucaaaaaaaaaaguuccuucuuccauaagcacauacauuucaagggaauguauguagccuacuggcaauaaaacuauguauuaauuuaacaaagcaaauguauacugauucuucuguuuuaaucuagcauaggcacauugaaaggacaaaaacauuuaacaauaaaagacauucagugugaacuggacaaguagaaguaguucugagcuucagguuuccugucuagccaauaaugauaacaccuguccaacugaauucaaaugucguaucuggguucaaagcuccuugaaguauuaaguuugcugacccaaggcuaccucugaguauaaaggcaaucaccaaagauaauaaaggaaggaaaaucuuuucuugaaccugcuuucauccuugauuauccuuaauaauaauccucuuguuaauccuaucccugcaaacauauaugaauucaugacuuuacaaauaggaauacucacugcgcaaaagauauuaagauauagcaaaaccaauaacugugcauaauacaaccuuaaauuugguagguuaugcugcuuuuucaaccuacagccaagaguuuuguauagaaaauuccauaccaaugcuauaccacauauuuagauacuacuacugccuuaaaaaauguaccauaggugccaaguuagccaauaaaacugagacacaccuuaccaguccaguagcugguauuaaaagauuaagacugcuuaaugcuacccacuuaaauacugaaaaauauaacaaggaauuuuaccagucagcaaccaucaauaagccaggauuauuaaaauaccuagcugagguauucugaaucauuuaagaagcaagcauauacagguauuguauauuaaaaguaaauguguacauggaaugauuaugaaaccucacugauccuaaaagugacccacagaaaagucaucugggacauguaauagaaagcuguuuaaaauaaauacaaaguuacaguuuuuaaaauguacucauagguuucucguucuuaagacaugagaacucaauguaauuuuuauaacugauaauuuuugaaaggugaacuagauuauucuuaaacacgauuuuaagcaccagacagaacaaaguaaugauaacaagauguuuucaugauaaaagaagaaaaaagaacuaagcuagauaaauuggguuacuaucuuacacagaacaaaacuagaguuuguuaaggacauacagcccucucauuccacuccuccagagccaacaacucacuggcucuacagauauuuuucucuuacuuuucuaauucacaagaguuaucuuuaggcaguagugucauauguuuuuugacaugggacaguagcuuauuuuucuucauuaaauauaaguauuucuugaauaucuauuguacacucauuacaaaacacaaaggccacuucugcacaauuuuaaaugggguacaaaaaaaugaacaacuguaacucuauaauagcacauugagaguccgauauaagacaaauguuuaucaaauuuuauguuguauuauuugaacuaaaaaaaccccacaaaaacauaugcacauuuuauaggcugacuucucauuugaauucuauauacuguguuuugccaacuaaucugcuagaaaaauaaaagugagucacaacacagaauucucugacgcaaucuuucagauccuaagaauugccagcacuugcuucuuaaaagcugaugcuucaaaugucguaggguaacauuaacauuaacucuuaauaaagguaaacuuuucccuaaccauucagaauuuacaaaagccuacccccuccucacacagaauacaccauaaauucacuaaauuacagaacucuaaauauuuuuaaagcauucucaaguuaacaauuucaauacuuuaacugaaaguuaacaauuucaauauuggaaacuuucuaccaauaucaccaaaaaggcuacaauauaaacuguuacauauacuggaaauucuuaccuaccucauuuauacaauccuuuugagggcagcagcagcaaugagaauuuaugaugacaaauacugagcaaaaaucuuucuuuuuaauauccaucagaaaaggcaaaacagauuucuuauuggaggaaaaugaaggaaaaaaugucucugauguacaucagcccacagcauaaggaaggcagacaucaaagucagacugaaacacaguuucuuguuuaacacuagccaugcuuccccaacucucagacaggaauuugcucuacucagccaacaacagauuuauucuagauggacaaaacugcaugcccaacagcaggaaaacuauucuguuaauauuccuucugcuucucugccaacaguaauagauccuagacaagcaaaaugggauuuuuacuugcucaaugcuccaccuacuuugcgcacaguuucuaucuccuggaccuaucaaaaccuuucuuggaugcuuaacucuauguacacuagaaacccauuuaccaaaaacacucccuuccuccaaucauuuugaaaguguacuuuaaaagaaaaaagggauugaguucaaugaacaaaguguaaacucagaauauguagccaaacgaacacuggacagggaaucacaauacuggggcuggguucucaguucaauccaucacauacuauguuugcaugaccuggaccauaucccuuaaauucguuuuuaaaguggagauaauaguuccucuguucaccuaauuuaaaaggcagugauauuaagguagacuacuuuacuacucuuucacagaacauuuuuuaaaaaucaacaguauuacuacaaggcuaguaaccaaaacagcaugguacugguaccaaaacagagauauagaccaauggaacagaacagagcccucagaaguaacaccacauaucuacaaccaucugaucuuugacaaaccugacaaaaacaagaaauagggaaaggauucccuaucuaauaaauggugcugggaaaacuggcuagccauauguagaaagcugaaacuggaucccuuccuuacaccucauacaaaaauuaauucaagauggauuaaagacuuaaauguuagaccuaaaaccauaaaaacccuagaagaaaaccuaggcaguaccauucaggacauaggcauggguaaggacuucaugucuaaaacaccaaaagcaauggcaaaaaaagccaaaauugacaaaugggaucuaauuaaacuaaagagcuucugcacagcaaaagaaacuaccaucagagugaacaggcaaccuacagaaugggagaaaauuuuugcaaucuacucaucugacaaagggcuaauauccagaaucuacaaugaacucaaacaaauuuacaagaaaaaaaucaaacaaccccaucaaaaagugggcaaagguuaugaacagacacuucucaaaagaagacauuuaugcagccaaaagacacaugaaaaaaugcucaucaucacuggccaucagagaaaugcaaaucaaaaccacaaugagauaccaucucacaccaguuagaauggcgaucauuaaaaagucaggaaacaacaggugcuggacaggauguggagaaauaggaacacuuuuacacuguuggagggacuguaaacuaguucaaccauuguggaagucaguguggcgauuccucagggaucuagaacuagaaauaccauuugacccagccaucccauuacuggguauauacccaaaggauuauaaaucaugcugcuauaaagacacaugcacauguauguuuauuguggcaguauucacaauagcaaagacuuggaacuaauccaaauguccaacaaugauagacuggauuaagaaaauguggcacauauacaccauggaauacuaugcagccauaaaaaaggaugaguucauguccuuuguagggacauggaugaagcuggaaaccaucauucucagcaaacuaucgcaaggacaaaaaaccaaacaccacauguucucacucauaggugggaauugaacaaugagaacacauggacacaggaagaggaacaucacacaccggggccuguugugggguggggguaggggggagggauagcauuaggagauauaccuaauguuaaaugaugaguuaaugggugcagcacaccaacauggcacauguauacauauguaacuaaccugcauguugugcacauguacccuaaaacuuaagguauaauaaaaaaaaaucaacaguauuuauguacacaagugguacaaauuuuuugccucuucuucucccuccuauaaaagucucaaaauuaagacauuccauuugccaggaagaucucauagacccaaauaaaaacuacuuuaauuuuagugauuaagggaaaguuuuucuucagggcauuaacaaagauuguagaaacagcauugcucauugcuuuguuguaauggguaacagauuaaaguccucucucccuuguaauuuuguaagcuugaauccugaucaagacagugaaugcuaaggcuucaauuaccaacaguacauaagauaauggcuuggaagcuguuuggaaguaauacaucuaaagguuagaaaugcuacuaauucuaacaagcuaucucaaagcaacuaccacuaaucucuggcucaacacaauuuguuacuacuaaguagucuaggaugucagguauugcucagaaaugcagcaaugugugcugcaaaagugcagccuaccucuaacuuaacuguaugagcaagccuguguaggaccaugcuuggcuaaaugaaagagcuagaaaacaagugccacguguccugccucaaagguccaucagauauaaagauguggguaguuuuaaaacucuauuaggcaacaaauaaaccaaacugagggggcuuuggggggcuugaggagacaaagguacgauguaggcacaaauaucuagauucuauaaagagcaaccuuuucuauaaaucaaaauaagaguuuucaauauauuacaacaaaaguaccauucacagauaacaguuuacauaucuaaacuuauuccucuuucucucaaagucagugccuuucucuggauuuccccuauuucuuucaaucgugucauuauuuccauaguccagagaagaaaccuuagucaucauuggaugcuucuucccccacaauauuuaaguacuacuauuauucucuaugggcucuuaacacaaagauaaaguuaaaaacaacugggaaaugguuuugugacuaguauucuuacucuucuccaacagccaaagaucucugaccaagcaaaaaaaaaaaaaaaaaaaaguuuuuacuggcuucuuugcugccucacaagucauuguuuuuguauuacaaaaguaaccaucaaaguucugauuucuaauaccucaucucuuuaagccuagaccaguuuaagaugggccucauauuuccauucucuucaucuccaauuuguguuuuacauuguggcuagcuccuaccaucugacuccauuuaagcaucugacauuuaaccauuuccaaucaucugguaucauuuaacucauaaucacacugcucaaaaacgguuaauaguucuccacaccuacuaaaugaccacaggaucacagaucuagaauaaaccagauuaagaguccuuccuuguucaaauaacagaaauguuaauucuaugucaaaguuagaauuaauccauuagccagccaggcgcgguggcucacgccuguaaucccaacacuuuggagggccgaagcgggcagaucacgaggaggucaagaaagaccauccuagccaacauggugaaaccccgucucuacuaaaaacacaaacauuagcugggcauguuggcacaugccuguagucccagcuacucgggaggcugagucaggaguuaucacuuaaaccugggaggcggagguugcagugagccaagaucaugccacugcacuccagccuaacgacagagugagacuauaucucaaaaaaaaaaaaaaaaaaaaaaaagagaauuaauccauuaauucaacuaguugacuauggagugucucaucuagucuaacagcuaucaggcaaucugcuagauacacugcaccaccuucaccaccuagaagauaaauauaauuuauacuccaguuaaguacgggccgaaucaaugguaaaacaaaaacuagaauccagauuuuccagcaucuaguuuaauguuauuucugguccauguuauugugcuuuuaaaaguggugugaaaaucauaauuuaacuuccacccacaucuuuacccaaucuccccaaaguaaguucagucaaacugguuacuuguucacugaauacuuuagugaacacuucuaccaacaagaauacuuuuccuauucugcccccuuuuuucagucaacugagucuuaugcuucuuucaggguauaccucaaaucauauauacauacaauccauuagagaaaguagcaauuacaaaguaucuauaugaauccuuuagcauuuagguuauuuacaguauaucagaaaacucaguacugcuguauuuaaauauggaaaacaaucuuucuauauccuuuguuuuuauucuguagucuaccgccuugugaauuacagaucaauauucaggguagguaaguaaggucagcuuuuuugaggaauucugaaauaaugauuuaauaauuauuauuuaguaccuaaaacacugggaaugcuaccaccuuuaaucuuaauuaaaucacagcagaauaaugaaaugcuucugaaaaucaugcaaaauguuccuaagauauagcccccuaguacuggaacuuuucuuuuacaauuauaaccuaaauuugcuggauagacauagaaacaaaauuuauuaaggaaccaguucagcuaauuccaauagauuuucacugauagcacaacaaauucuagcugcuaaagaaauaaauacaaaguuuccuucaacuuuuuaaacaccaucuaaucaggaaucagucucacuuguuucaguaaaaagguagggugaauugcaaucuguuauauaaaaacuaaaaggaauuuuacccuaauggcuuuaguucuguuuuuucccagacaaaauguucaaaccuugcaauccaaaagcuaauggaaucagugacaaagucaaauuacacaaacaaaguaauuaaaaauccccauuauuucuaacuugguuguuauagggcuggauucagccagauucuuacaguuaugaaccauuaguuuacaggaauuugaacauacccuaugaucccauuggaaaacaagccucuuugaacucccuaccaaaucaagcuagcucuaucaaagaaauuaacuuacucacgauuccccaaggcucguuacucucugaauacaugaaagcuuguguacugcuccaguucaaacgcacuauccuucauauaaaaaguugauaucauugccugcuacgguuuuuauuauuuuaaaagcacaccaaaguggugcuaaauauauuccuacuuuuacuuggaucuucucauuaucaguggcauagacuuucaugacaacugggucaagacuacaaguauagcauacaauuaauaaguuuuucucuguuaaauagggggaaugaaccuuuacucagagcucaaaacugcaguaccagacuuuuguuacucacaucuccuaaacuuuuuacccucaguuuuccuugcggucuagaaaacagguuaaaaacaaaacaaaaaagagguaaaggaaaauaauguuaauguuuguauuaguaucauguuaacagaaccuugguuucugacuacuauuauuucuccugcauguccuuaggcaaaaugcuuaaacucugagucuauuuucuuaccugugaaaugaagacauuaucuacuuaucaugauauaaaagauuaaaacaguauauguaaagcacuuugcaaggugaucgacaagauuacaaauaaauguuagcuuguucucccauuuaaagcuugauuuuaugugacacuuaggaagcacauuuaaauuaaugcaauuugcugaaugucacugguuaacauaaaaagagacaccuuauuucacuacuaaauauguauuaauaauaaugauguugaugauaauggugauaccuauuagguacugauugauaacuguaugccaggcacuuugccuuucucauuuaaucuucacaaauacuuuaggcucagagaaguaaauaauuugcucaaggucucacagcuaggcaaugacauugccggaauuugaaaggaagcagauccaacuccagagccuauuucuuccaccugaaaaggcaauccugagcuguuaaauacaaacucuucuuuguauccuuuuucuaaguuaguacuaaaucuacagaagggggagagugguuuacugguuacuaauagccaggguauacacaauagaccugggaugaaaaccagaaaucuagaguggcuggggucuguggguguguuuguaucaggaagcccuaggaucgaucucuuccaauggauaaccacgcauguuucuuuaauaaguaugcaauaguuaagcagacagacacuaacauauuuuaaaauuaguuaaauuuacuaacuaaaaauuuaaauugcaagcugacuuaagagaagguacaggccgggcgcgguggcucacgccuguaaucccagcacuuugggaggcugaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggugacagagcgagacuccgucucaaaaaaaaaaaaaaaaaaaaaaagagaagguacaauauuucaaggccuauuucaacacagaaucaucaugauugcuuauauaauuauauaaauuauauuaucuaagaacuuauuuaaacccuccacauuuaucucagcacccaaaacauaagaaaacuuuuaggaaaguaacaaagaccacagcccuuuuuauucuuuacuagaagccagaagaugggaauggagauugguaaaaucuagacaguauuuccuaggcaagaaguaugguaauggacagugcagaauuaaggacuguagagcauacacaacuaaauuuucauagcuuagaggaaaaauaaagcacaaaugcaugccaccugcggcauccuuagaaacuaaggauucuagcacaguuccaauggacuuacucuucaaguuuuuuauuccacauuuucuacagcuugauuuaccgguuuuccuuuuuaaaaagcaacaaccaggccuggcguggucguucacgccuguaaucccagaacuuugggaggccggggcugguggauugcuagaggucaggaguuugagaccagccuggccaacauggugaaacccccaucucuaccagaaaauacauguuagccggcugugguggcccaugccuauugucccucccaguuacuugggagguugaagcgggagaaucacuugaacccaggaggcguagguugcagggagccaagaucgcaccacugcacuccagccugggcgacagagcaagaccccgucucaaaaaaaaauaaaauaaaauaaagaaaauuuuuaaaaagcaacaaccaaaaaggcagaaaaaaugcaaaauugcauauaaaugcuauaauaauauaauuuuuaagucaaauugguuacuuauaaugcuacuuaaaaguuuacaugaaugacugaacaauaguuuauuuaaauaacauuuugguauuauacuauauagccuacuuuuuauuuaauuaaccaaauaaagguacauggaacugaaaaagaccuuaagggauuacugacccagcucauacuucucaaacuuuaauguacauaugaaucacccuuggacuauguaaaaugcagauuuuaacaggccuggaauggggccaaaauuuuacacuaaauacaagcacccugagaugcugauucuguuggucugaggacugcacuuugcaugguugguuugcuaaaacugugguucucaaaggugugguauaaagacccuucaggguccucaauauccuuucuuguggucuauaaaguauuuccuuuugcaacuacauaucugcaugaggccagauuuucuucauauacuucaacccaaacagcauauuguaacagacugaacagaaaagcagauaugagaauuuagcaaucuucuuuuagacuagacauuagauuugcaaaaauguggaaaugccccucuucucaguaaguuuuuaaauuuuguuuuggaaaauaguuauuugucauaaaaauguuauugauaccaacauauacagggcuuauguuauuuaucauuuuuaaaugcuuuugcaaauucuauuuuaauuuauaauacgguaaaguagauagaacacaaguaaauaaaagcucuuugggguccucaauaacuuuaaagaguguaaaggauuacugauaccaugcugaacuaaucacucaagccugggccaggcguggucgcucacaccuguaaucccagcacuuugggaggccaagguggguggaucacuugaccucaggaguuccagaacagccugacuaacacgguaaaacccccguuuuaacuaaaaauacaaaaauuaguugggcaugguggcgggugccuguaaucccagcuaccugggaggcugaggcaggagaauugcuugaauccaggaggcagagguugcagugagcugggaucaugccacuacauuccaaccugggcgacagcgagagacuccgucuccaaaaauaaauaaauaaauaaauaaauaaaaucacuugagucuguuagcugucuuggucccuucucaaaaauucucagaugacagaaucucaaaccuuuaccaccaaggccucugcaauauuauacaauguugccaaguucuuauguucaauuacaguuucucuuccuucuuauguaaccuccugaagaucaagaaaacaguugcugagcaucucccucuuccaauaaugcauauaagccccuucccucaagaaauucaaaggaacaaguuuuacaaauugacaaugaugggucuugacaaaaaaggacuccuaacauuagaaaaacugucuugaaacauuuuacggacuacaccaagggaaauuacaauuuggucugcccuaugaagucucagggaagaaagaacaaagugagaguaguaauuauaggguaaaaauuaaggggaaauaccuaaaaaaauaaaauaaaauaaaauacagaccuagccccauaauggaaagaguuaaacuaguuguucagaaauuacaacugagauuugagaaccuacagaagagccuuucuaguccugggauagccuuucuaccuauuauuguuuucugcuuuauuugcaccaaauaguuuuuccuauucuauuagguucaugcaaaaguaauuguguuuuuugccauuaauauaaaauauauugcuuuuauagguacaucaguuucuacuugcugcuauucaacuucauuuuaguaggauaauucugaaggucaccucaaauuucacuucucuuucacagaguaaauacaacucucccaaauauacauaaugucugauuuugacuauauuugacauuacuuugaaucauuuauucuucaaaauauuaaugagugccuacggugugcugugcacaaugaauacaaacaacgauauaauaaaccuagcucuaggacaauaccuuuuaagacacucuauauuuccuccuucauguaugcuauagucugaauguuugugucccccuaaaauuuuuauguugaaaucuaacguccaaugagacaguauuaagaggugaaggucuuugggaggugaucaggucaugagagcagaucaggucaugagggcagaaccgugaaauggauuacugcccuuauaauaugaguccggagggagcuuuuugacucuuucaccaugugaaaaugacacgagaaaguccggucuaugaggaacagaaccucacuagauaccaaaucugauggcaccugaucuugggcuuuccagccuucagaacugugagaaauaaaugguuguuguuuauaugccaccuaguuuauggcauuuuugauauagcagcccaaauggacuaaaacauuguucucaaucucucuccagauuaagaggcagcuauagagucaagcaguuuaacauugagaaaaagaggaagaaacuaaagaacuaaagggaaauaaaaccugcugaauagaacaaaauguaguauauauaugcaauagaauauuauuuaacuauuaaaaaguacugauacaugcuaccacauggauguaccuugcaaacauuuugcuaagugaaagaagccagacacaaaaugccacuuauuguauaauuccauuuacaugaaauaccuagaauaggaaaaucaaauccagagacagaaagcagauuaguggucgcuaggggauggguuggagaggagaaugggaaaugacugcuaacugguauggggcuucauuuuggggaugaugggaagguucuggaauuaguagugauaacugcauuaacauuguggauauacuaaaaaccagugaacaguauacuuaaaaaugguuaaaaugguuaauuuuaugauauaugauuuuugucucaguuuaauaaaaaacaaaagcugcugaacaacugaaaacagguuaaacacuauacugagaauacagaaacagugacaccagucuuuccagguucuguuaaacuuacuaucaaagacaucuuucauuuaagaagauuuucuucucaacugagcuuuugaguuugcauuuggcaaauaaaaauguuaaaguuuuaguucuacucuuaacagagagaaaagacugccuacacauuuucugaccuguuaaguagcuacuuguuugcaccaagauucucaugucuuuacaaauacagaggcuaacgcauucuuauagaagaacaucaccacuacuuucguagaucaguaauuucuuacaggacucuacaggggaacauguuuuacaaaguucuggugacauauguuuaacacaggaguaaguaaauuuuccuguuaagggccuaauaguaaauauuguaggcuguauguaucauacagucuguugcaauuauucaacucugccauuauagugugaaaacagccauaaauaauauggaagcaagugaguguggcuguaugccagaaaaacuuauuuauggacacugaaauuugaauuucauguaguuuucguaucauacaaaauacucuucuuuugacauuuuccccaaacauuaaaaaauauaaaaaccagccagucaugguacucguaaauguaaucccagcauuuugggaggcuaaaguaggaggaucacuugaggccaggaguuugagaccagcaugggcaacauagugagaccccaccucuacaaaaaaaaaaaaaaaaaaaaagcuggacaugguggcacaugucuguaguccuagcgauucagaaggcugaggcaagaggaucacuugagcccagaaguucaaggcuacagagagcuaugauuguaccacugcacucaagccucggugacagagugagacuuucucucaaaaaauuaaaaacaaaaccaaaaaccauacuuaugucaugggcuguacaaaaaugggcaccaggcugaauuuggccaagaagcauaguuugcuacuccauuuagaauacgacagaaugggccaggugugguggcucacaccuguaaucccagcacuuugggggccgaggugggcggaucacuugaggucaggaguucgagagcagcauggccaacauggugaaacuccaucucuacuuaaaaaaaaaaaaaaaaaaaaaauuagccaggcaugguggugggagccugcaaucccagcuacucaggaagcuugaggcaggaaaaucacuugaaccugggaggcggagguugcagugagacaagacugaaccaugcacuccugccugaaagacagaguaagacucugucucaaaaaaaguaaugauugguaaguuaguaaauaaaauauauaaaacauuucauauacaaauuauaaauuuuauaguccccaaaucuaaaguuauauauuuaaccucacaaucagguuugauauuguuugaucuuaaguauauauauguacaugagcauuuauuuucauaaauguuaaguggaaaaaaacaaaugagguuagcucaaaucuaauucacaaacaaaaucucucuaauccauccacuuuggccuucucucuuacaacuccuuauuucagacuauuagucauuucccuuagauuacuucaauaccuuuuuaacugaguuuucaacauuuagucuuuccucagaaauccauucuccacucugcagucagaaauaaucuuucuaaaauuuaagucuguagguguugacauacaugauagcuacccacuuuuaaaacaguccccucagugcucuacauuaaagucuaagcuuuccuuuugucccuuaucccuugccuuguccuuuuccuacuuccaaacuugacaagauacucaaaaucaugcaucuucauauauaacacuaucuuagucuuucccuaauucuuuaacaccauaucccuaaccuguccaaacuugauuagguaccacucuuacaugcuuucauuaaguaccuaucccuaaaauaaguguuuucuauuguauuguaacuguuugcuuuauuuguuuguuccccuucccuugguaaguucuuuagagacagggacuguguuugacauaacaauaauauucaauaucuaggaucuagaaaacagucuggaacauagaagagacuugaauauuugcugaaugaacccaugaauuguuaugggguugaacugugucccucaaaaagauauguugugguuccaaucucuaguaccuuacaauaugaauuuuuuuggaaaaaaaauuaguuaaguaauuaguuaagaugaagucauccaggagcaguguggguccuuaacccaaugacugcuguccuuuuaagaacagaagacacaggcuggcacaguggcucacaccuguaaucccagcacuuuggaaggccaaagcaggcagaccgcuugaucugaggaguucuagaccagccugggcaacaugacaaaaccucgucucuacaaaaaauacaaaaaaauuagccagcauggugguguguguccauggucccagauacucaggaggcugaggcgggagaaucacuugagcccaggagauggaaacugcagugagccgagauugugccacugcacuccagucugggugacagagugagauucugucucaaaauaauaauaauaauaauaacaacaaggauuggcaagaauaugaagagaucacaauucucuuacacugauggugggaauguaauaugguacagcuauuggaaaauaggcuggcaguucuucaaaugguuaaacauaggauuagcauauacacaugguaauuucacuucuagguauauaucuaaaggaaguaaaaacagauauucaaacaaaaacuuguacaugaauauucuucguagcagcucuauucacaacagccaaugguaggaacaguccaaaugucuaccaaucgauaaauggcuaaacaauuguguuuauacauacacacacacacacacacacacacacacacacuggaauauuacucagacuuaaagaggaaugaagcaugaacauuugcuacaacauggacgaaccuugagaacacuauacaaagugaaagaagcuaguaauaaaagaccacauauuaaaugacucuauuuagaugaaauguccagaauagaaaaaccuauagugacauaaacagauuagggguugcacaggaguggggggaauguuuguauagaaaagugauugcuacagggugcagaauaucuuuaucaugugauaaaauuauucuaaaguugacuguggugauggcugcacauaccuguuguuaaagcaaacuaaauauggcccgagaaggacuuuguacuucuaauuugagucuguguggacuaauugcaaccuaacuuaacagguagacaagacugaaaaccuaacuuaggaguaugcccguaacaacugcugagucuuggccaaucccaacagccaaauuucuaucuuuuuucuuuucuuuucuuuuuuuuuuuuuuuuuuuuagacagggucucacucugucacccaggcaggagugcaauggcgugaucucggcucacugcaaccucugccucccggguucaagugacucuccugccucagccucccuaguagcugggauuacaggcgcccgccaccgcgcauggcuaauuuuuguauuuuuaguagagacgggguuucaccaugucggccaggcuggucucaaacuccuggccucagguaaucugccugccucagccucccaaagugcuggaauuacaggcgugagccacugcgcccagcccucacggcuguauuucaaccacucauacauugcugaguguucaaauaaggcaaacagcaagcuguaaccaauccaguuguuucuguaccucacaucugguuucuguaugucacaucccuuuuucuuaucuauaaaucuguucugaccaugaggcaucccuggagucucucugaaucugcugugauucuggggacugcucaauucacgaaucguucauugcucaauuaaacgccuuuaaauuuaauuuggcugaaguuuuucuuuuaacacugugaagaugcuaaaaccagugaauuauacacuuuagauggguagguauauaauauauucaguaacacugauagaaaaaaaccuaaauguacauuuuuaguaugcacauacaaaaaaaaaauauuucugauuaauacucugacuuggcacguuaugccaugcagagaaucaaucaaguccccaaaggucuucuaauauuuaauaugauaagcacaaaauauucuauaaacaaacuucaaaaauucacugaaggauagaaagcagacuuuaaggacuacugaaagccuaugacuugauuauguaaucagaaucauacuuuuaaguuuuaauaucuagauauucaucucuacacagaauaauuugccaucuauuuacuuuuuuauugaaaaguuggaggcauuuuuaaaaauaaaauuccuugaauauaucacaaucacagauuuuguaacuucugugcaaauaugagccucauuacacuuaagaaagccaguuagugcuacuauccucccaaucuuuuguagcagaaagccuaagucaaacccuucugaaacaucaagaaucuauugagauagaagacauuucagagucaaucuaguuauaugucaaauacaacaaauauauuucucaacuuuuucaaauguacuuucuuauauaauuucaacagauuuguuuuucgcaaccuuaguaggccuggcaguuaugacuaccauaaucauaugaggaaauuaaggcucaggagucacauaacagaaacaccuguuacuguuuagcaguaucacucauauagcauguugaucuacaaaucuacuuugauccacuacaacuuuuguuauuuuuccccucaguuuugaaucuacuggcuuauauuuccucccuaauuacuucauuacauguuuuaauaaaaaagucagauuguauuaguaccuagucauacauuucgggcaaaaagaaaugauugaauuugcugugcuguaacaauaaaccuaguucagcuucucacccuuuaucucccaucuauucuagacacaaaccuuaucacucuaauagaguuaucaauuuuuuuuuuuuuuuagaccaagucuugcugucacccaggcuggagugcaauggcgcuaucucagcucacugcaauuucugucuccuggguucaagugauucuccuaccucagccucccaaguagcugcaacuacaggcacaugccaucaugcccagcuaauuuuuguauuuuuaguagagacugggguuucaccauguuggccaggcuggucucaaacuccugaccucaagugaucccccagucuuggccucccaaaguucugggauuacaggcgugagcuaucacgcccagccaacuuacugacuucuaucaacauuuuuuuuuuuuuaacaaaacugaauguaaacuccaggugaggcacaacuuuuugacuugguauauccccaauaccuaguauagugcuuggucacaguuuauaauuaauaaauauucacaaauacacagaugaaacuuauucaguagaaaauacaccaaguaaaauuaacuuuucuccuaugaaaccuaacucauuuaugucaauaacuucuauucuauucuucaaacccugauacacagaauucagaauauagaaaacugaggacuacuuuagcaaucuaagcuauuguggguuuuuuuguuguuuuuuuaagacaggcuuucacucuauuguccaggcucgagugcaauggcacaaucuaggcucacugcaaccuccaccuccccggcucaggcgauccuucuaccucagccucccaguggcugggacuacaggcaugcaucaccacagccaacuaugcaccaccacggccaacuaauuuuuguauuuuuuguagagauaauguuucaucauguugcccaggcuagucuugaacuccugagcucaagcaaucugccuaccucggcuucccaaagugcugggauuacaggcgugagccuacaggcccagccuauuauugguuauucacaagaaagaaguauguaauagguaaaaauuugcccuuuuccacuugcauacacauagacacgcguacaaacaauauauucauuguuuacauaauaguguuuaucaauacuaaaaaggaagauucuggaugccuggugcugcuucacaauuauuauuuccuaaucaguucaaaguuucauagauguuauuuuaagccuuuaucauccuuaaaggccaucuuucauucuacacacccccccaagaagaugacaacucauauuucauagacaauaaccacagccuacuaucaguaccaguacuaucuacugugcuaagcaaucuguaagaggguaauaguaucucuuuuacagagaacaaaauaauugaaguacagagaaauuaagugaauugcucaagaucguauggcaauaacuagggcaaggaugugaacccaagacuuugcuuccaaaacccaucuugcuucccuuaccucaggagaaaaccuucccuaucaagacuuaccauuauaccaugucacaagcccauugaauccuggauauuacucuacccuauccaccaccacccaccaugauuucuacuucucucucucuuccucuugcuccuuccaaaagccuauaaacagauaaagucucuuucaccauuaaaauacaacaauauaauagcaguaaaaacacauaucagcagucagaaguuugccucuuaauuaccaaccggaaacucucugcucugagaugagacaggauuugggagcaggagaaacuaaguagcaauugauuuguccuuggaucaaaaauugauuuguccaagacaacagcuucacucuauuugaucaauuugccuuuccuuccauuguacuacgguguuuggcaucucagcauucauguaaauccuauuccugcuucuuagaauggccucucaccauucuucuaccuucucuuuuugacaguucauacaacagcucuuuuugugaaaucuucccuaauccauagcaggguuauccauuguuccuccacucuccuuagugcuugucuccauuacaauacucaccauaauguaauuauaauucuuuguuuacauauuaaucuucuauauuagagguaguuuucugaagacagggaauaugauuauucaccuuuacuuaguaucaagcucugggcaugggacauagcagggauucagaaaauguugcauuuacuggcacugagauuuauuuuguauuuaggauagugcuacagauaaggaugaaauuauacagauguacuagauuaaaauauuuuaaggaauauaaagcaauaaaaauaauaagcaaguacauuaauugaauuuaugaauuuauaaguagaauaaccacuaauaaacaaaauuuuaucauucauaucaauugagaagaaucagcucagaaaaggcaaagaucauuauacagugaaaccaaucagauaaaaugucauggaggaagaccguuaaguauauggauugacuggauagcagaaaagcuuauaguggagguacaguauuauauaacauuuacaaauggauaggaauacaggaaaggauguggcauaugugcgagauaaugaagagaacugauuuaacuaaaauagagugcuuggaugaagaugaagaauagcaaagauuaagaauuuguacuugcucugauaucagcaaacugguaucuuaaguuccuuauaccaagaaaggauagcaagaaagcucaacaaguuuaagugaaauaaaaaaauaaauucacaauguaaauuacuucuggaauauaaugcaaggugugcaguaaggaagaugugaaaucagaguuguggcaaugggaaugaagaaggcuugcaucuaagagguauucugaagcaagaaccuuauaaacuggaaguaguggaagcagcgaguaaaaaacaagaaaucaaauauaccucuuaaguuuucuacaauuuuaaacaaaauaaaggaggaaauuacccaauaaacagucgacccuaugcucaaaggaaaaaaaaaaagagagaauguaaauuacaacgcaucaggggaagaaaggggaauaauaagagacaugaacugggaaugaugauacagaacucugaaaggcaaagcagaugagcuuucuaagggcauaaauguagaauaaugauuaggguacuuaucagaaucaucugaaggcauaaaaaaauuucuccugcccccauucagcccaaauugagagucagugcuucagggauuacaauuauauuguguauuagaaucugggugaguauuaagaagagguuaauaaauuuaacaguaaggccucaggccagacacuuguagacauacaccuaauaauaauaacugacaaaauaccaucccaauuacaaagccagaaguaacuugagaguuacacacuuucuccauaaacaauagcugucauuuuuacuggguaugaaaccucaaacuucauaugaaauuaaacuaauuguccaaaguagcuccauauccaucaacaacagaaucacauacaaauauacaacaaggauauugaaggaauauucacagcaauaaauaauuauaauuaaucuuugacuccaaagauuucucccaagccuuuaugaagagguaaaauuuggucuaccuaaagcaaaauguuuccuaucaguuuuuaauaauaaacauuucuggcucaugccuguaauuccagcacuuugggaggcagaggugggcagaucacaaggucaggagaucgagaccauccuggcuaacacagugaaaccccaucucuacuaaaaauacaaaaaauuagccaggugugguggcgggcaccuguagucccagcuacuugggaggcugaggcaggagaauagcgugaacccaggaggcagagcuugcagugagccgagauggcgccacugcacuccagccugggcgacagagcgagacgccgucucaaaaaauaaauaaauaaauaaaaaauuaaaaauaaacauuuccauucuguucagcuaucaaaaucuaaauaagcaauugauaauuacaucuucuauaucaaaauucaauuaaauuacaucacuaaaaaugaaauaaugagauacuaugagcuucucggugcaauauaacauauacagcaccacauauuaaguauccuugcaaaaaauguuuagccuaaauuuuaucaagacuuuugaacagugguucucaaacuuuugucucaggaccccuuuauacucuuaaaauuaacauuauuggggaccucagagggauuuugucuauguguguuacaucuauuaauauuuaccguggcagaugguaaaccugagaaaguuuaaaaauguuaauucauuaaaaauuauaacucauuauguuacaaauauauauuuaaaauuaaaaagucaguauuuuccaaaacaagaaaaauuuagugauaagacugguauuguuuuacauuuuuguaaucuuuuuaaauauaugguuuaauggaagacaaaggaauuuuuuuuuuuuuuugagacagagucuuacucugucacccaggcuggagugcaguggcacaaucuuggcucacugcaaccuccaucucccggguuccagagauucucgggccucagccuccaaaguagcuaggauuacaggggugcaccaccacgccuggcuaauuuuuguauuuuuaguagagaugggguuucaccauguuggccagucuagucucauacuccugaccucaagggauccaccugccucggccucccaaagugcugagauuacaggcauaagccaccacgcccggcccuacaaaugaauucuuuuauaugcuucuguauguacucugcugcaauaucauaugugcaguaucauauagccucuggaaaacaacaacguacacucuugggugaaugcgaguaaaaaagacaaaauuauuuuuacauuguuaaccuaccccaaccauuuuaagguaaacuucuccuuacagaaauauagaagaauaaacuaguuaaaugacaccacgaggaaaauucagaauguggaacauuccucgaaauaaucuaauuuucucaauaaaucucugacaugcaugcagaaaaagaaaguaaaagcaauaguucuagauuaagaacuacaacaauaaaauauauuuuguggaccuugauggagccuauuuugaacacugucaacggacauuuuugaaacaauggagagaauaucugaacagguucaggguauuggaugaugcagaaaugauuguuaauuuuuucaggcauaauaugguuauguaagaaaauguauuuuagaguagcauaaugaagcauguagugauaaaguaaaaugaaucauaacaacuaccuuucagguuucaauuagacagcuguagaaaauaucucugucagcagacaugaacuaccaugaguaauuuaaacuacaauaagguauuuauuuaugccuuaaauaugguagguacuaauauauaagauuuaauaaaucaacucaagucauucagagaaaagucagugaacaaauuaauuugacaaagcaucuugaauuaaaaacauuacuuuuaacucugaccuauguggugggagacaacaggaguuuagcugaauuaauaggggguuaaaaaguagguaaugaggguguguuuuuaaacauaauaaagauuuaaaugaaugcaagguggguacaggauaaacuagugguucuuugaucuuuaucuuucacuguaucaugagcaauagccuuacacauaccucaacaccacccccccaaccccaacaguucacucaguaugccuuccacuauuguccucuuuuacaugguuugaugucauccaccuugggauucuuuguuagauaugccccaaguucaacaaucaguuaggggaagacuuacacuggucacgcgacgguagaucugugcagcauuuuggcacuccgaguaaggauauucagauguagccaucucaagcaugcacaucccaaaagcauaaacgucaacggauucaucauauuucuccucauacaucucaggggccaugaacucugggguaccuuaaauuaaaagaacgauucagacucaaugcgagcagaagcuucagacguuacucaccggggugagaagcagagggguugaccugugagagagaagaaauuggaauggggagaaaaaaggaaagggggagaaaagaggaaggaaaucuucucagucagucuguuccaucaaauaucucauaaaagaucuuccacugcaaggccuuuauaugaaacuggaauaaggucaaggaucuauuuauugauuuacuguguaaaaugaauuucuuuauacaauaugccaaaauaaaaccuuggcuaagauaauaaacuaauauaauucauauugaaaacaaauagaaggaaaaggaaagacacuaugcaaggaacaaagcaaauauaaugguacaucuguaagauaagaugauggguuuaaaaagaucaaaauacuugugugcccacuaauguaugguagcuguaggguuaauauuuacagcuacacucuuggcauuaacacucaaucuaauuaguuucacuuuuuaagaaggccuugcagugaaaaacccgauauucaauacauuuuuuaaaaaaugaaauaaaacguaauugucuccaaaggccacucaccagagcccuuuucuucacauacuuaccaucccaccugcaguacacaaauaagccuacuacagacacaagaaauguagugagggacauccuacaggcaaaaagacaaacacacacacacaaauauagaacccaaauacagacugauuuaugagcacagugugugaucccacaagacuagguuuuguaaugcuuccagaaaauuaggucugcauaccucaaauuauuaggcauuuccaagaaacaggcaugcacacuaucauuuaaucaacaaagaaaauaaaaacucuauugggccagagauuucaggaugccaaagacaaucaaagaaauguuuccugugaagaaggcaaaaaaagaaauucagcuuuaaaugacacuuuucccauucuucuugugaauguauuauaagaaaaugugaaagcauuccuaacccuaguuacauaauauuccaaggagaacacuguuuuugaaagauguacaaauaacugguguucuguguuuuuccuaguaauacucaguauccaaguucacuuaaaaauuaauggguuucuuuuguuauugucaccuuuuggagggaguaaauagaauguuuaugaagaccucaaguuuuuaaauugugauauccucuucauagagugaaagcuuaucaaaauaggcauuaaauuauuuuuccagcuuugaguuucuaacauauaaagucugaaagggacagccuuguucuuuagauaagugauucucaacagggggcaauuuugucuucuaggggccauauauagcaaugucuggacacacuuuugguuauaacaacuagaaggcagguacagagggagcgugcuacugguaucuaguggguagaggcugggaaugcugccccagagucuuacaacguacaagacagccccuugcaacaaagaauuguccaaccccaaaucucaguaguauugagguugagaaacacucuuuuagauagaucauaaauucugaagagugagacuaagaaaaaaguugauaaaaccaacuuuucagaaugaauugucauauuuauuuucacaaaauguuaggagguuauucuuuuuauuuuuuuuauuuuggagauggagucuugcucuguugcccaggcuagagugcaguggcgcaaucucagcucacugcaaccuccaccucccggguucaagugauucuccugccucagccuccugaguagcugggacuacaggcacccgccaccacacccggcuaauuuuuuuuuuuuuguauuuuuaauagagaugggguuucuccaucuuagccagacuggucucaaacuccugaccucaagugacccucccaccucagccucccaaagugcugggauuacaggcaugagccauugugcuuggccaauauucuugaauauacauauauauccaacagacauuuuauauguuuaaaaauuuaauuuuuaucuuuuaauuuuagaaaguaaaacuaaauauaaauuccauuucuuucaugaagugacauacuguauguauuaaauaaauaguguauaauguuaaguaucaacaguguguaaugaaaagauggcuggcugggcgggguggcucacgccuguaaucccaacacuuuaggaggccaaggcagguggaucacuugaggccaggaguucgagaccagccuggccaacacggugaaaccccauuucuacuaaaaauacaaaaauuagccaggcauggugaugcaugccuguaaucccagcuacucgggaggcugaggcacaagaaucgcuugaacccgguggguggagguugcagugagcugagauugugccacugcacucuagccugggugacagagagagacuccaucucaacaacaacaacaacaacaacaacaaaaaaggcuauuacauuagguuuuaucaacaaaguucacuuuauuucuuguaacguaauguuaccaauagucucuaagaugauuccaagaagcacaaauauagagaauccuauaucucauaaguacaauggaucaccuccugaguucaagcuaugaauuucuuaagguuuauaucacuuaaaacucugacagagccaggauucuaaauaaaaggaaugugagaaagccagucaggcuccaagguacaccugaaacauaccuaucacacucuuggcaaaagaagcccgcuucaggguugccagaccgaggucuccaaucuugacugagccaguagggccggugauaaagauguugucacauuuaagaucgcggugaaugauagguggaguucgaguaugaagaaacugaagaccuuuaaggaucugacggcaccagcuucuuagaacuuugaucuucaucacuuuaaaccuuuucagauaccuagaaaaagcaaaguauaccaaacaaguuaucaaugauaggaguuuguugcuuugaagaauuccauuaaauucuaacaugacuggagaugggaauaucaaauuuagcauacuaagauucaguaacacuaaagguuaauaauacuuuuaguaagcagggcuaugauaguuuaaaauaaaaauucuauuaagagacccagaaaaauaagucuuccaaaugcuuuuucaucuaaacaaugauaguauuagguaacuaguuuuuucuuaaagaaaugggagaucaaguuggcuauaucagcuaaauauuucagagccaaaaauauuuaauuagugauugguaagagaauuaugguaacaaagcaccaaauaugaauuccuuaacauuaggucaccauuuaaaugauuaagagguagaguucugcuucuguuaaauaguggaguaguucuaucagacacagauguauuuauaaacucuagucaaaaauauacaaaacaacuauuacuugaaggcucuggagagcaaucaaaaucagucauaguuggaagggaaaaagggaaagcacuacuugaguuuccuucuuuauaauacauuuuuaccuaaggaaagggccuguucugauucugcaggucugcuaaaccccagacagaaauggcgacugaguuuggaaugaccacagcaucaagaacagugcugucuaacagaccuuucugcaaggauggucuguccaauaaaguugccacuagccaaaugugacuacucaaauguagauuaacuaaaauaaaaaauuucauuucucaguugcacuagccacauuucacgugcugaacagccacaugaggcaaauggcuaccauucuggaugguguacguuauacaacauuuccauaauggcagaaaguucuacuggacagcacagaucuagaaaggaaaggaggaaaucucagaaagcaggcaccaaaggagagcccuaaauucuguguauccacucugcccaaaucucuaguugaccucugaaauacaugaauguaggaaagauuccaagcagcccaaguaugcuaaaagaacugaacagagaccucuggugcuacccacuguagaaaagauacaucuggggauugaguuccaaugccuauuuuaucuggaaauauucaggaaaaaaagagcacuaaaaauguuaaauagaaaagacuacauuuuccuuucaguaucuuuaaaauacacacaugauugguuaaaggaaaaucuauaauacugugauauauaugauaugcuuacauauucuauuaauuauuguuuuucaguuccugaauuuguuuaauuuuuguaauuucuaugucuuuacugauauucucuauuuguugagguaaaauuuucuauacuguuaacauuuggcugucacuguuuccugcauuuaguauuccaauuuuguugaauagguacuauaauuacucccauuuaauaaugacuuaucuauguacuuguauaagauaugaaauuacuuauguaaucuuguacuuguauaagauaugaaaauuacagcauacagaacaagcgguagagggguuauaugaaaaccuuauuugugcaaaggucuuguauuuuacaugaaauuguacaguauuaguccuaaauaaauugugaaaaguaacaacguaaauguaaucuucagggcaacuacuuaaaaugaaaaacaugcagagauccagaucuaacuaaaaaucaaauagcagaacuaaaauaaaauuuuacuucauuugggugggcuaauugaagaaaacuaauagcaaaaguggguuuuaugguuuaaaaaauauaucaaaacagucaugcuggauggaggguaaggaaaaggcugccuggaaagcggcauaagggcauuuuccgauaugauggaaauguucucuaucuugagaguuuugguuacacgaaugaaugccuugucaaaacucauucaaucguacaauaauaauuuauucuauccugaugcuguuuggagguaaaagaaaaauaaaguacacaaauacuggaacucuaacgaaaugcauacugaaggguuuacgggugaagcauauugaauuauuuuauuuuacaauuuauuuuauuauggaaugaauaagauggauggaggaugaauaaauggacauauuaauaauaugguaaggcaagugaugcaaaaaguuaguaacaacagaaucuuggugcugagugugugcucacuguauguuucuuuugccuuuucuauauaauuuuuagaauuuuauaauaaaauauuggaaauuuuauuugucguuaguccuccuuauaaacauccuauuuuuaaacaaaaggguaucuuauccuacuaugaacuuuauauuacuucucucuuuuuuuuaacuauucccauagcaccucccuaauuacagaaaaccuguuuauccuuuaagaucuacuuaaauuauaucuaucauuuuaguaaagaccuucaagauuaucccagcuagcaggagggaaucauaucuuugucuaaauugcuauucaagugaaaauuacacauauauuaugauucacauuucauuuuaagaaccuauucuuugggaauuguguacaaacaugauuauuauagcaauguuuauaaggaaaguauaaggacaagaaggaauccaaucugcuccauauuacaaauggaacauuucuaaacucagagaagcuaaguuuggugagaaugaaaagugguuauaaaaauacgaauauuaauuaaaaucaccauaaccaaccacaucuugagaaagaaaagugacaauuaggcaccaucagugcagauaggacaaaaaaaaaaaaaaaaaagaugucucugccaggugcaguggcugacgcuggcucacucccagcacuuugggaggcugagguggauggaucaccugaggucaggaguucaagaccagccugaccaauauggcgaaacauggugucuacuaaaaacauaaaaacuagcugggcaugguggcaugugccuauagccccagcuacucgggaggcugagguuggagaaucgcuugaacccgggaggcagagguugcaguuagccgagaucacgccacugcacuccgcccugggcaacacagagcgagacuccaucuccaaaaaaaaaaaaaaaaaaaaagaugucucugauauaucaagcacuucagguucuuccauugugacugauuuuugcccaaccacauugaagacaaagcccaguugcugaaaagcuccacucucauaagcagagcucuuaaucaguucuucaguacuaagauauuuacuaaaaacaaucaacucaugguuaaauagggauaauuauaguaccuaugccaaaacuuugcagacuaaaugcugagaacaauggcugcuaaauauuaagaguacaaagaauauucuauugaaguagagaauaucaacagagacagaaacuuuaaaaaggaaccaaguagaaauugaggugcugaaaaauacugugaagauucacuaacagauuucaacagcauaugcgaacacacagaagaaaaaggcaauaaacuugaaaauaggaagugaaacuguacagucugaggagcagaaaugagcagagucuaagagaucugugggacaccaucaaguugagcaaaauauacacaaugggaguccuagauaaagaagacagaaaagagcagaaagaauauuuaagaaaauaauggccacaaauuucccaaacuuaguaaaagacaugaaucuacacauccaaaaaguucaacaaacucuaaggauaaaugcaaauagauccacaaugagaaacacuauauucaaacuguuaaaaggcaaagacaaagagagaaucuugaaaguagcaagggagaagugacuuaugaccaugggauccucaauaagauuaugagcugauuuuucagcaaaaaccauagagggcagaaagcagugggaugacauauuuaaagugcuaaaagaaacaaaagcaaaaccccaaaaaaaaccugaagacugccaaccacgaauuauauaucagcaaaauuauacugcagaaaugaaagagaaauuaagauauucccagguaaauaaaagcuggaagaguuugacaguaguacacuuucccuaaaagaaaugcuaaagagaauccuuagaggaaauaaaagaacacuagacaauaacuugaagccauaaaaccaaaucaaaucucugguaaaguccaucacacaucuaaauauuaaaaccaguauuaauguauuuuugguuuauaauuccuuuuauuuccuacaugauuuaaaagacaaaugcauguaaaauaauuauuauaaaacuaugcuaauggguacacaauguauaaacauaaaauuugagacaaugaaaacauaaaaugggaaggaggagugaggcuguauaggaucagagauuuguaugcuguauuaaagcuaaguugguaucaauucaggguagacuguuggagguuuaugauguuaauugugauccucaagguaaccacugaaaaaauaucuaaauauauacacaaaaggaaaugagaaaggaaugaaaaugguauacuacaaaagaaaaauaaauacauuuaaaaagguaguaaugaaggagauaaggagcaaaaaacaguacaagacugucucuaggaaugugauauauuacggcugcgggcgguggcuuacgccuguaaucccagcacuuugggaggcugaggugggcaggaccacaaggucaggaguuugagaccagccugaccaacguggugaaacccugucucuacuaaaaauacaaaaauuagcugggcgugguggugaguaccuauaaucccagcuacucaggaggcugaggcaggagaaucgcuugaacccgggaggcggggguugcagugagcugagacugugccacugcacuccagucugggcaacagagcgaggcuccgucucaaaaaaaaaaaaaaaaaaaaaaaagguauaagacauacagaaaacaaacagcaaaauagcaaaucauucauuuugacuaauuaaauguaaauaaacucuccuaccaaaaacagagaugggcagaauggauuuuuuaaaaagaaagaaaaaaagccaacuauauacugucuacaagagacucauuauagauccaaggacagaaauagguugaaauucaaaggaugaaagaaaaaugauauucuaugcuaauaguaaauaaaagagggugagguagcaaaacuaauaucaggcaaaauaaguaaaaauacugaugcaagagauaaagaagagcaugauguauugauaaaagggccaauccauaaaaaauaacaauuauauacaucaaacaauaaagccaccaaauaaugaagcaaacauucacagaauuaaagggaggaaauuaguagacacuacaguaauaguuggagacuucaguauuccacuuucaauaacggauaaaacaucuagacaaaagaugaguaagaaaacagaagacuugaacaauauuauaaaccaccaaaagguaacagacauauuuagaacacacugcccaacaacaagugaauauauauucucaacuguacauggaacauuccuucaagaaaucuccaaagaaaagucuaggacuggauggcuucauugaugaguucuaccaaacauuuacaggagaauuaacacaaauccuacucuuccaaaaagcaaaaguggaggaaacacuuucuaaaucauucugugaggccaguauugcccugauacugaagauaccaaaagaaaacuauagacuaacaccguuauuaauguagauguaaaaacucucaacaaaauauuggcaagccaaacccaacugcauaguaaaaggauuauacacuauuuaucuaugaaaugcaagggugauucaacauaagaaaauuaaucaguauaauauaucacacuaauagaacgaagugguuucaugauuaucuaacuugaugcagaagagcauuugacaaaaucuaacaccuuuccaaaaaaaaaaaaaaaaaaaaaaaaacucaagaaacuaggauaggaauagcagagaacuuccucaacaugauaaagaacauuuaugaaaaacucacagcuaacauauacucaauggugaaagaccaaaagcuuucuccuuaaaaucaguaauaugacaaggauaaucaaugcuaaucauaauucaagcucuagccaaaacaguuagacaagaaaaagaaauaaaggcauucaaaucugaaagaacuaucuauucacauaugacuugauccaauauauaaaaaucccaaagaauggcuaggugugguggcacacaccuguaaucucagcacuuugggagccagaggcaagggagaucacuugaggccaggaauuugugacuaccauaagcaauauauugagacccuaucuuuaugaaaaauuuaaaaauuagccaggcauggugguacacaccuggagucccagcuacucaggaggcugaggugggaggauccuuuaagccuagaguucaagucuguagugagcuaugacugcaccacugcacuccagccucggugacagagugaaaccccaucuguuuaaaaaaaaaaaaaaaaaaaaaaaaccccaaagaaugaacacacacacagaugagcuaauacaagaauucaguaaaguuacaaaaguacaagacugacacacaaaaaucaguuguauuuauauauaccagcaauuaacaaucugaaaaggaaauuaagaaaacaauuucauuugcaauagcauauaaaggaucuaggaauaaauuuaaccaaggaugugaaagacuuguauaaugaaacuacaaaacauugcugaaagaaauuaaaaaagacauaaauaaauggacagacacccuguguucacggauuagaagacaauauaguuaaagauggugauacuauacaaaaugaucuacagauucaacacaauuucugucaaaauuccaacagccuuuucuuguagaaauggaaaucuaauccucaaauucacauggaauuucaagaagaccccaacugucaaaaacaauagugaaaaagaagaacaaaauuggagaagucacuucuaauuuucaaaauuuacaaaaauuacuauaguaaucagagcaaugcgguacuggcauaagaacagacauguaggccaaugaaauagaauugagaguccagaaauaaaccuauacauaugauuaaauaauuuuugagaagaguaccaagaccauucaauagguaaaagucucuucaacaaaugaugcugggauaacuggacaucaacauguaaaagaaugaaaucagacccuaccucacggcauacacaaaaguuaacuuaaaaauggaacaauaaccuaaauagaaaaguuaaauugauagaacucuuagaagaaaacuuagggauacaucuguaugcccuugguuauuuaugacaauggacucuuacaugacaccaaaagcccaaccaucaaaagacaaagcagauacauuggauuuuaucaaaauuuaaaacuuggcacaggcuugagcauccaaaucagaaaauccaagauccaaaaugcuccaauagaaaaucugaacuugagcaccaacaugacacacaacaaaaaugcucauuugaacauuuuggaguucagauuugggaggcuuaacugguaaguauaauucaaaguuccaauaucugaaaaaauucaaagcccuucuggucccaagcauuucggauaagagauacuauacucaaucuguacaucauagaacauuaucaaggagcaaaaaaggcaaccuauaggagaaaauaucugcauaucauggaucuggacaagggucuaauuucuaaaauauauaaagaacucuaauaaaucaacaaaaaaacaagcaauccaauaaaaaaugagcaaagaacuugaauaaacauuucuccaaagauacacaaauagccaauaagcauaugaaaagauguuccacauuauuaaucauuagggaaaugcaaauguaauccauaaugagguaucaugucacucccgguaggaugccuccucaaaaaguuaaacaaagauuuccacaugacucagcaauuccauuccuaguauacagccaaaagaaaugaaaacagguacucaaaaaaauacuucugcacaaauauucauagcagcaguacucauaauagccaaaagguggauacagcccaaauguucaucaauggauaaauaaacaaacugugauauuuccaugcaauggaauguuauucagucauaaaaggggaugaaguacugaugcgugcaaucacgaugauccucgaaaacaccaugcuaagugaaagacgccaaacacaaggauccauaacauacuuugagucuauuuauaggacauauccugauuagauaaauccauagagaugguaaaaaguugguaguugucaggagcugaggguugggagaaaugggaaauuguuccacgggcauagaguuugugacaugaaaagcauucuagaaauugcacagaaauguguuuguauuaacacuacugaacuauacacuuaaaaaugguuaagaugguaaauuuuguuauguuuuuuacaauaaaaaaaucccauccacgaauggcuggucccagagaucaggcaguccaaccacuuguuuuacauacacauggggaacugaagcccaaauaagguuagcuauuugcccaaaaucacaguuggucagaggcagcggugggagcagucacaacuucuacugcaagucuaaugcucuuucuacuuaauaaacccuccuguuggcauaagccucugaagcucagaaacugaaaauuucuuuuuaauuguaaaaagaaaaagaacuuagauaaugugcaauuaaagaaaaaauacgcugccuggcuggaggaagggaaaugcagaguaacugcuuaaugggcacagaguguucugaggugauuaaaauguugaguaacuugauagaugugguacuuacaaaacauugugaauguacuaagugccacugaauuguacuuucuaaaauguuaauuguaugauauuugaauuucaugucuauuuaaaaaaauacaucuaaauuuaucucaacuuuuaauccaaauuuuuuuucuuuuucuuuuuuugagauggagucucacucugucacccaggcuagagugcaguggcacaaucucggcucacugcaaccuccacuuccggggucaagcgauucucuugccucagccucccggguagcugggauuacaggcgcccgccaucaugcccagcuaauuuuucguauuuuuaguagagaugggguuucaccauguuggacaggcugguuucgaacugaccucaggugauccugaccucaggugauccauccgccucagccucucaaagugcugggauuacaggugugaacuaccacgccuggccuuaauccaaauuuucugacucauacauucccaucuuauuuuucagcuauggguguuuuaucuguuucaauguaaauauacauagagaacaaagguagaaacucgaaagguccaaaaagcacgcauuuuggaauuaauucccauuccuucccaaucugccucuccaaaugcugccaaugguccuaguuauccauucuuccagaaaugaauaugaauguuuucaaucuacuugcuuaggaaucuguauacauucucaaucagaauucuuaaauucugaaauuuuucuuuuucucauucucucuacuuuuucauuuuuauuuuugagauggagucucgcucugucacccaggcuggagugcagaggcacgaucucggcucauugcaaccuccaccuccugggcucaagugauucucugccucagccuccagaguagcuaggacuacagggaaaccccuuuuagauaauuaaaucuaucugggucuucucacuacuaugucauccucuuuaaauauuuucugucuuuuuuguguguucuguugcucauuucuucguaguuaauauuccugucaauucaauucagucugcuguuuaaccguuagaccauuuauguuugaauuuuaauguucuuauuucuagaaguucuucagaagcuuuuaaauuaugccugucuuuuuuuucuuuggugucuuuuuccuucaauuccuucuuuucucuuuauacacuucauauacacuuacaaauaucuuuacugacaucauuauguaaauaauuguuuguaaucacuuucagacuuguccaugauauccuuaauuguugcagugcuauuuucugguugugucuauucaccuucauuggugugauuuguaauuuaauugugaggucaucuucuuuggaaacaguuuugccucuggacacugaccaaggaacugugaaaauguccccgggaguuuucuuuccguuccugaucaauuaucauguauguucuucgguuugggauuccuguaccaaguagaugguacaaauuuauguuauagcgccaucuacauaugagauggaagaauaccaaacaggcugggcaccguggcucaugcuuguaaucccagcaguuugggaggucaaaucgggaugaggccaaaucaggaugagcucaggaguuugagagcagccugggcaacaaaauagacacugucucuacuaaaaaaaaaaaaauuguuuuuuuauuagacagguaugguggugagcaacuauagucccagguaguggggaggcugagguggaaggauucccugagcccaggaguuugaggcugcagugagcuaugauugugcugcugcacucuguccugggcaaccgagugagacccugucuccaaaaaaagaaaaagaaaagauuaguuuacagaauaauuaagaacacugguagcauuugaugugaauuucuauuuuucauaggucuccccucuuauccacagucuucugcacacagguaaaauuccuugcagcuuucacuggcuagagcacugaggucucucuuuucacggauaguucaguuuuuugacacaggcuaaguucuagcuccccucucuaccuaguucuaaggcuuucuguccuugcauggacauuaaaacuagcaucaacuccucaaccaauauguggucuaaaaucccagaguauaaguuccuguuuuggcuuugaguuaucucugcuuauuaucuggagguuaaccuuucuuuccuuaaagcuuagacacguauuggaaaaaacuuuuauuauauuccacauuucaguuuguuggugugggacagccauuccacaggggcuuauuaccccacuauguuacccaaagcuccucaauauaguuuuuaaaacaaguaaaccauuguauuuuagaguaaucuuaggcaugccagacaaacuguugacaaccaaguaaguauccaaaccaguggaaagaaucucaagauguacacauaauuauuaccacauaauucuccuuaauucauucaaacacuuauuauucaguauuagacacuuccaguagaaugugauaucuagcacuuguucauaguacuagguauauagugcuaguuagcacauucuaauggaagaaaagagaguaucaagaagccugacuaacuaggauaaagguauugccauaaacaagaguggaaguuggauaaagaaauuagaauuugcaggacagaaaugaucuguucauguuucaacaugcuaaccguaagcauuucagaaaacaugcaagugacuauauccaggugcuguaacacuguauuccaaugaucuggaauuaaucagcucagcaguauuaacuuuaacaauuaauaaagaauauaugccacagugauaauuuaaaaauauccaauuucaccaaauaaaaaauuuauacaagguaacuuacuacagguucuucucugaguaaaaacagauccucuaagauaccagggguccccaaccacugagccacagaucaauaucaguccauggccuuuuaggaaccuggccacacagcaggaggugaguggcaggcgagcaagcaaagcuucaucuguauuuacagccgcucccucacugcucgcauuaccaccugagcucuggcuccugucagcagcauuagauuucucacagggccaugaacccuacugugaacugugcaugcaagggaucuagguugagcguucguuaugagaaucuaaugccugaugaucugcccugucucccaucacccccagaugggacaguugaguugcaggaaaacaagcucagggcucccacugauucuacauuauggugaguuguauaacuauuucauuauauauuuuaauguaauaauaauagaaauagagugcacaauaaauguaaugugcuugaaucauuccaaacuuccccagccccacccccgcaccaguucauggaaaaacugucuuccaugaaaccaaucccugaugccaaaaagguuggggacugcugcucuaagaaaccugggauuacaaaggcauacuccaacacuuaccaaaagcucuuuacaauaaguaacgggaaauuucugcauuaaaccuauuucugugaaaggaaugauagaucuagcuauuuggggauuaauuucugauguuaugggaaauggaacuaaaaguauuuuuuaagugauaacugucacaauauaaucugcaucugauauaaaaguugcagggauauagcaaagcacaauacaaaugaaaaaaauagguaguuucucaauaaaccuuaaucucauuuuaaccacuagagggcuaccuugacauuugauuucugauuccuuagccacucuuuuuuuuuuuuuuuggagacagagucucaccuaggcuggaaugaagugaggugaucucagcucacugcaaccuccgccuccuagguucaagcgauucuccugccucagccucccaaguagcugggguuacaggugcacgccaccaugcccggcuaauuuuuguacuuuuaguagagacgggguuucaccacguuggccaggcuggucucgaacuccugaccucaggugauccaaccucaggugauccgccugccccggccucccaaagugcugggauuacaggcaugagccaccacacucggccauaacuucucauuucaauacuuaccaagaaauaauuaucaaaucacuuuauauacuagaggacuuugugggcaaggaaauaugcuaauacaguaacaguuggaaggacuguucccuucuuaggcugaacaaccaaagugaaacugguagaccugaaauuuaaaaaaucaaauucucucauacuucuuggucagcuuuuguaauacugaugaacuuacguuuuaaguguuccagacgucauaaguucagucaccaaaacaaugcacuucuuuccuuuuacuguggauucccaggaaucauaaaaucuaacaauauugggaugcugaagaccuuuuaacauuucagcuucuucuuuaaaucucugccucucagacuuuguuaauuuucgauccuaaaaucaaaaaccaaaacagaaugugguuuaaaaugauaaaacaccaaaucagacaguuaaucuuagacacuuaaacauuacuaaaucaugaucgaugguguuuaaaaaaugcaaaugcugaaguuauaaaugauagauuuggauuauauacauucaugcuugagaucauuuuaguaucuuuacuguuaauguguaacucagauauagucucauuuuuguaaggugcaguuaacuuuccauauccaacauaagucaucaauugcuagacaugcaauuuaaugucaggaaaugaacauaggcuuuggaggcaaagaccuaaauauaaauuccaguucuaucuuugccuugauuaaaaucaaucuaucuuuaaccaaaacauuguuuuuauuuuuguuuguuuguuuaaaagacaggaagucacucugugaccaaggcuggaaugcagcggugcuaucauagcucacugcagccucaaauccugggcucaagggauccucccaccucagccuccagaguagcuaggacuacaggcaugugccaccuugcccggcuaauuuuuuaauuuuuuguagagaugaggucuugcuaugaugcacuggcuggucuugaacuucuggugauccuccuacuuuggcaucccaaagccugggauuacaggugugagccacugcaugaagccuaauuuuuuuuuucuuuuaagcaauaacuuaaauacucaaguauuugucuucaagucaggaaaauucucaguaucucucuaaacacugucuccucucauucucuuuuuuuccccuuccaacucuucuuuucuuuuuaaacaauuuuuaaaugugugugaguauguguauaacuuuaguuuauccuuaauauccuuuaauuucucucucauuuuccauuuccuucuguaugcuacuuucugggcaauguuuucugaucuaccuuccuguucauuaauuuuucucuucaguuauuacaucaauuauuaauugaacuuuaagguucucacucugucgccaaaaguacccaauaaggaauguaauaaaaggaaaccaaguuacuacuccuguuucuacucugcccaauagcauuaaaaccaauggauacuauguacaugccucuuacauaacacuuaaucacaggcaacauuauauugacucuuaucccccauagaauaagcccucagaggcuuuuugucaugaaaaggcagugacaagauaccuuuuuguguucuaucuuuagcaccugacaaccuagcauagugacuuguucaacagccauuuguugaaugaauuccauaaaugucuuuuccccucaauaccccuuuaaaaguguguguguguguccuuaauaagcaguuagcauuuccccaaggauaaaaaauuccugugacuuaaaagaaaaaugagaauugaaauugggccucugagucucaguuaaguccaacacaacccauacagaaugaucaacuugcaaaggucccagcuuuugauuuuuaaaaaugguuuguaaaagcuuauuguaaaaaagcugccaacuacuuauuuauagcaaagcauagagggaaaaaaacgggggacuucuuugccaucaaaaauccguauuuaauuuuccuugagaauacacugaaugacaaucuaaaaauuccauagaaauauuuagaauauuuuaucucuaauuugcccagaagacaucuauacuauaaauacaggcuacuuuauauagcuaaguguuuuuauccuuucugaaaaguauuauuuauuuuaagggaucugagaaccccugcuuaauguuugaaguuagaaauacagaugcaugacaacagauuaucaucaacaaagcaggaaaugggggaaaccuaaacaaauaauuuggggcuucuuucaauaguuugucuacuuguuccaucuauaacugaauauuguuuuuuuuuuaaucuaggaacauuucauaaaauaucuuagagaaguacauaauuuuagcacccaaaagacuuuaagacaauaauaaaguagaucaaaacuaacauaagacacagaucagaaggaacaccugggguuuuaaaaauaauuuuugccaaguauuugccauuuacuaguuggcugcuucacuucauuuaauccucagaaaaauguugugagacgaacugacucacaaaauuuuauuaucucccucaaauucacaugaaaaacagaacuaagagacaaaugaagauuugguucaaagcucauguuucaaugacaacaaacaaacccuaaauauuuugcaaaacuucuaaaauaauuuucuucucagaagauccacguuuguuauuauauaauaauuauugaaaagaaauaggaacuuuauacuaaauuacagcugaagguaaaauaagaggaaccauauauuguuuaaauauuaccaacugucaaucaaauuaucaugaauacaaugauaaaauuuuaaaagaccguaucaaaaaguagcauuaaaacaucaagugagacuuagaauggauuagccacuguugcuuuuuagaaccuucucuucaccauuauggagcuggauauuccuggggccuuaauauacuauacuaucccaauugcagcauucauuaccuucaauauaaacuaaagcugauacagcuaacccauucuauucauuucguucauuucuuuccaucuacauuaaguuguuuugacaggauaaaugagcaaaaccaaggauccgugucacaugaccucuucauaacaugcacaguuccaggcugcuggggguggggugggggucaggcaacaacuaaaacaauugcucaucucaguacuacccaaauuacagugcucaguagauuauccacugauguaauuucuucuggagugagaagcacaaugcuaauguuuaguacaaugaccucauaaccauuugcacaucuuccgucccuugcuuuuaagaagcuguuucauuuuaaacauccucugacagacaucucucuuuacccucauauuuuaguauuuuuaaaguagcaaucccauccuuugcuauuguucacuuuauucgcccagaagcaaaccuuccaaaccaauugugcuaauggagcagugagacuaguuuucauucauuaaacuugaaauuuuuacuuuacagcuaacaacuguauccccaaaauuaucugguccucaagucuuauuaacauuuaaauuucucuaguauuauauaugugcaauauucaaaauuuuacugcuaaauuaagaccacacaugauaacucuacauaucaaaauauggguggagaaaagugucuggaauucuugauuaaaauauuuuaggucaauauuggaauacucccuccuuaucauuuucugcaccacacugacuuagcaagacaugggcaucuauuucaccuuuuuuuuuuuugagacggagucuugcucugucgcacaggcuggagugcagugacacaaucucugcucacugcaaccuccaccucccggguucaggcaauucugccucagccuccugaauagcugggauuacaggcgugugccaccacaccuggcuaauuuuuguauuuuuaguagagacaggguuucgccauguuggucaggcuggucugggacuccugaccuugugaucugcccaucucagccacccaaagugcugggauuacagacgugagccaccgugcccggccucuauuuuaucuuuuaaagugauacuaauuguuguuggguauuaggauaaagaaauaaaaacuugucuucaggcagaggguacagcaguuuguaacauugcuuuccagggcagcauggguuucaguuacaguuuacagagaaaacaauuuuuuaaagaauuauucuauguguuaaaagaaauuaagcauauaaauaauuauuuaagucuggcaacucucucauaggccuauaugguauaacagcaauucaaagaugacagaaguauuaacuguagguaacuaacucuucuuaaaaacuucagaauuagagauugaaggccugggaaagguuggaaaaacuacaacuagaaacaaaauaauaauucucaugcaaaaauucuuaacuguuaaagauagcaaaaagacuaacauggcuuucaagguguuuugaaguauaauauaaaaauuacaccugcauuuuauguggccaaaucuacagauuaaauuccuacugcagauuucuuuaugaccuuccagucugguacucuuacgagaugaaauuuggggucuaucgcauaaagaagagagucuaugugagcccaacuuuccucaaugggugaaaagauaucauaauuaugggggggaggggcagguaaacauggcaucacauccccugcuucuccauggagacuuuuaccuaucauucugaaauagcaccaguuucagaaagaccaaaaaaaaaaaaaauuuuuuuuuuuuuuuuuuccucaaaagaauaggaaaaaaaaaucugguuaccugguuguucuaacuccucuaucagccccuucuucccaauauggcucaccuuuauacacuuuauuuauuuacaaaaaguuucuguuucaaagaagcaagaagaaaagucuacuuauaagagagauaggaggccaggugcgguggcucacgccuguaaucccagcacuuugggaggccaaggugggcagaucaccugaggucaggaguucaagaccagacuggccaagauggugaaaccccauuucuacuaaaaauacaaaaauuagccgggcgugguggcaggcgccuguaauccgagguacuugggaggcugaggccagagaaucgcuugaaccugggaagcggagauugcagugagucgagaucucgccauugcauuccagccuaggcaacaagaguggaacuccuucucaaaaaaaaaaaaaaaaaaagagagagauacaguuuucucaagccagauguauacgaaugcauagguucuauucauuaggcacccuucacuuaauccccaaaucugggccaagaguauguaaaaguuggagucuaagagguucucuccaccucucuuuggagggcacaaaagccacaugggauuccaaaauaccugggacuuggcauauacaggaagcuuuagguuaaugcuaaaaguagcagauacauauaauagcugaaccacaaaaagaaaaaaaaaacacauuuaguucuauuagaaaauggcuuagaacauguggacaaaggcaacaaauaaaaauacauuaauaaauaaaacagaaaauggcaaacuagggcugggcauggcggcucacacuuugggaggcuagggcagaagaacugcuugaggccaggagcuugagaccagccuacaacauagcaaaaccccgucuccaaaagaaaaaagaaaaaaaaaggcaaacuacuuucacuaagugacuuacaguaucuauugcauagcaaaacuuagaaccauaccuagucauucacauaaauuuuuaaaguuuuuuauuaaaguagauuaaauugauuugaaugugaaagcagcuaacaggguuaaacucaaacuacuauaggugaggucuugcaggaggucuuccugaagaaagcaagaaggcugagaaggggagaaaaaggaaagauaaaugugaaugagaauaauaauagaagaauuauugcucccggccgggcgcgguggcucacgccuggaaucccagcacuuugggaggccgaggcgggcggaucacgaggucaggagaucgagaccauccuggcuaacacggugaaaccccgucucuacuaaaaauacaaaaaauuagccaggcguaguggcgcgcgccuguagucccagcuacucgggaggcugaggccggagaauggcgugaacccgggaggcggagcuugcagugagccgagauugcgccacugcacuccagccugggccacagagccagauuccgucucaaaaaaaaaaaaaaaaaaaaaaaaaagaauuauugcucccuacuggaaggaaaucuuacacuucagagacaaauguuacucugcagcaaauggggaagaaacaguucccaaaguuuuuugaauaggguaaugaggguuugccaaaggggaaaccaacaaaacagaacugaaaagcucaaauggaguuauuagcacugaaacuuagugggucauccuguaagaaucugccaccacaggaaagcaaaagugguugugcacaucacaaagacaagcaucucaaagaauuguuucauuuuguucaggaaagaaaucaagaaaaaaaauaagcccaguacauaaaaacaaagaguuagguuuucagugugccugauguggcuuucacuuaaagaaauaaaagcaaaagagggaggacucauuaaucuccggaaaaaaaaaaaaaaaaaacagagacagggucucacucuguugcccaggcuggucuagaauuccuggccucaagugauucucugccuuggccucccaaagugcugggauuacaggcauuaaccaccacacccagcucuuguuaacuuuaaauacuguguacuaccuucccacccacuccccacaccaaccccccaccccgccacaagggucuucuuaucagcucaaucuuaaccuuucuaucccucuuucccucuuuuccauacuuacuuggggaauaaggaauaacuauuucaaauuuauagggagaucuagcccagaagcccagcgagaagauuugaagagucaggaaaaacaaaaccugaaagcagaauuucuacaacaaaugcaaccugcaacugaguuuuauauugagaauauacgauauugagcauguacauaaaaauauacaauaucuuuaugccuggcaaggucugacuuaaguguaauguuuuacuaauucuggaauucaaauuagauuuccaaauaucuacgacauuuuaugagcaaagacucaauauauguccaagccuauaaagucucuccacaaaucacucauucccuauuucccuuugucuucccaggcaaucucuauaauuccaugauuccccauaucucauuuccauggucacaaacuaauaaaagccacaacuacgucauaucaaaauaaacauugccugaugacucucuuuacccuucaaccuacccuuuagauaaagauauucccccagacacuauuuuuaugacaccaagcuccuugcucaaaaauaguaaaugcauaauuaaccaacuuugcugaaguacaagaaucuucaggggcacuuguuacgaaaggauucuaggacccuggccccagucuccaaggaagggauuucuuaugaccagcaaguuuggaaaaugcuccauuacaucaaauccaaauuccaaagucccuuggauccagcuuauuucucaauacuuuccaaaaacaacccacuacagauaaggacucuuguuauucucacaugccaugcuuauuucuucuuuugcacuccuauuucuaaaguaacugccaugaguuuuaguuuccuugccuguaaaaugaaaacaccaucuuuccugaauagcuaagaauuauucugagggcucgacauauuguaagugugcuuugaaaacugaaaauaauuacacaaauuaagaacauuauuuuuauggcagcuaccccauucacauugauuuauucucccauauguauuccugaauauguuucacaggcugaaauaggcuguugaagaagucaucaggagaaguuagcauuuucuuaauuuuggacuaucgauauuaucagagguggcgaaaagaauuuuuuuuucuucuuuaaauuucagaaaaaagaauuuuggguucuaacuuagacaauuaauuaaaaauaaauauauguauauuguggcucauguaggugaccacaagauuucauuaggcaguuuguuuuuugaaucauauuaccaaccaaaugauaaccuaaaugacaauuuauaaguuugacacauuaaucauuaauuuuguuaauuaauuuugacuauagguaguuuggcacguccuaaugucagcaaacuuuccuaacuauauacucugaauucuuuuaccaguuaaaguuucugcaguuauaauuuguaacugaaauagauacucucacauaagacuaaguuauuuauaaaggaagacagccacaauuugguuugcacugucaaaaacauuaauuuuaguagguuuuaauuagcacuuacacuaaaaauugguuuugcuguuauagcuguguaagaucauuaagucacaaggaguguauauguauuuuuuccauuuacacauacaauguuuuaacaauuuaagucacauuaaagaacuguccuuuuuuccuuuaaaacaugucuagcaguaagauaccacuucacaccaaucaggauggcuauuacccgccccuccccaaaaaaagggccaguagggaagcaaaaaaguguuggcaaggauguggacaaagugaaauccucgugcacugcugugauuguaaaaugguauagacaauguggaaaagagcacgauaguuccucaaaaaguugaacacagaauuaccauacaauucagcaacuucacuucuaaguauaugccccaagaaacugaaagcaggcacuccaacagauacaugaacaccaauguuaacagcagcauuuuuuacaauagucaaaggguacaaugacccaaguguccaucaacaaaugaacagaaaacaaaauauauaaauauaaaggaauauuauuuaauauuaaaauauuaauuauauuuuauauuauauauauauaauauuuauaaaauauuaauuauauauauaaaauauaaaaauauguaccaaauuuugacacaugguacaacucaaaugaaccuugagaacauuaagcuagguaaaauaagccagacacaaaaggauaaauaaugucugagucuacuuacaugagguacaucuagcauaugcaaauucacagagacagaaaguagaaaaaagguugccagggaccagggaaaggggacaauggggacucaguuuuuaagagcuaagaguuucgguuuggggccaggcacgguggcucacgccuguaaucccaacacuuugggaggccaaggcagguggaucaccugagguaaggaguuugagaccagcauggucaacauggugaaaccccaccucuacuaaaaauacaaaaauuagcugggcguggcagcgggagccuguaaucucagcuacucgggagggugaggcaggagaaucgcuugaaccugggacgcauagguugcagugagcugagaucgcgccaaaaaaaaaaaaaacuuucaguuugggaugcugaaaaaguucuagauauggaugauaguaauugcacaacauuguaaaugugcuuaaugccacaaaacuguauacuucuaaguuacuuguaaaugguuacaaugguaaauuuauguuauguauauuucacuaccaaaaaggcugaacauuacuugauuuugacaaaccuugcccuuggcacuuaagacaauaaaaugaaauguaaaauucaggacaggggaggcagggagauguuacuagggagaaguacacugagagcuucgaagauacagauacuguucugcuucuuauacuugguaaggacuugagguacaugagaaaaagugucuauuggucaucuuaggucuuuaaauaagagaaaaguuuaaaauuuuacauuuucuuauuugcaaagcaaguaaauaauucaauacuaaucucuugauaaguguaacuagaaaauagaguugucugcauuaauauuguuguuauaauuuaauccaauugucauuucacucaauggauugguuuuagcauauuacuuuuaaaaagucacuguacacauuagaaaaauuuacauaaauguuuucaagcauacagaaauguggaauauauauaugucccucugauauuugucacuucuuaauguuuugccauauuucuuuuuuuauuauuuuuauuuuuugagauggagucucacucugucacacaggcuggagugcaguggcacaaucucggcucacugcaacaucugcuuccuggguucaagcgauucuccugccucagucuccugaguagcugggaguagacaggguuucacuauguuggccaggcuagucucgaacuccugaccucaggugauccacccgccucagccucccaaagugcugggauuacaggcgugagccacugugcccagccgccauauuucuuuuagauuauuuucuaugaaauaauaccacuauucuucucuccacauccccagagccacuaucuggaauaugguauuuaucacgcuauuguauauuuuuauaguuuuacaacauauuacuuauucaugaaugauauacuauacuguuuugcacuuugauuuuuauauaaauguuauuucuguacuuacauugcucaauucugcuauuuuguuuaugaucuuuaaaaaugaacuaauuuuguaccccaacaaagaaggccauccuuagaguacaacuaaacacauuuccuugucaaaucagcagcauuuacuguggauuuucaaaguaaccauuauuuaucuaacuacaguuuacaauacauaaaacuaaccuuugaauuagcauacuuuuagaagcugcuuaucaauccagggaaaaaagaauacacacauuaauuucuucaauuuuauucuuuuuucuuuuuugugugaugucccugagucauaagaauaugcacauauuuuuuggcuaaaucuuguucaucauguucaaaauaugaauacuauggaaaaugucucuuauuuauugaacauauccaucuaacuuuaugaaacuaguucugacuacauuuauuuguggccucaggcuggcugcagagucugacaaaaagaaaaucaguugcugcuucaaaaauaucuaucucauuuacuguccaucuucacacuguaguuucauuuauguaaaucauaacauuuucauuuagaaacaaauaaaauuccccagucuuaaccuuuaaacucugugacaagagaucaguuccaacccccuauacuuccaaacuuuguuauucaaagaagaaacugaaaauuaaguaaaggauuuuuuuuuuaauuguccuuuuuuacuucuagagggaaaaaaagauucaaacgaaaucagauuuguuuaguaucagggcuucaacaauaagucaaagucauuuccauaucaaucauaauagaacuucuauacugaacaaggauagauccuccaaaccuacuguuuaugaccccgcugucugacacacaaguggaagucaaacucccuucucauauuuacaacugugauacguguaaaaagcaguacuguugccaguuucuagcaagcuuuuuuaucuagaggaaauguuucucaaguuucugucauuaauguuaugccaaaacuaauaaccagcuauaauauuuacuugauauuuuuaacaucauaaaacagguacuuacuaccuauuuuagcauccucguaacuaauuaguauugcuguuaguuauuaaaagaaauuuuggggcuuuaaaacguucauucacguacaaccuaaaauaucuacuauuucuagaaguauauguaccauauuuuggauaauaaugcccaauuauacuacauguacauuaucaguuucccauuuccacagcccucuuccccaucacccuaauuuuacuaauauucuuacaugcagaaaaacugugaggggaaguugaugacugcucaauuuucugguuagcaggggcuccaggucugacuuuugaacaaacaauggggacagacaaggauuuuuccuccugguggucaucacucaaaaaacaaaguaaauacacauuguacaaauugaaauguauaaguauuucucugauucaaucugccucaucauuaguaccacuuacucccagaguucugucuuuauaucugucaauuuucauuuguaguaaugauuggagcuuucauucauuccugauuuuaugauaauuuuagugggaaaauaggaaugguuugcugggcacaaugguugacaccuauaaucccagcacuuugggaggccgaggcaggaggaccacuugaggccaggagaucaagaccagccugggcaacagagcaagaccuugucucuuaaaaaaaaaaaaaaauggucaggcaugguggcacauggcuguagucccagcuacuggguaggcugaggugggaggaucccuuaagcccaggagguugaggcugcaaugagugugaucgugccacuacacacacacacacacacacacacacacacacacacacacaaagaaaaaaagguuauauugggaguugcuagugagauacuauccugaaccaaauacauacauacaccucugccuccucaauuuucaacgcugcuaagcaaacaaccaaagagcgauacacgugacaccaaagaacaggcuugucccuccauauugaaaggugacucaacauucauuaauaucauucaagaagucugcaggggcuuacaauucagaaugacaguauaaacagcuuacuuuacuguuacccacuuucccuccagauuccauuaacauaacucaagaaaguuacagaaauaaaauauuaaaugcaaacaauaaagaggaugagagaggagccaucagcagauacaaauggcgaaauucuggcccaagaaguaacagccuaaaauauaguuggaggguaccugagaaaggaaccaauaccuuuccuccaaaaaccaaugagauccaguaaagcagaaaugagacaugagauuuuuaaaaacgaagaaucuguaggacagacaaaucaaugccucucaccuucugugcgcacagcaaaaugaucacccaaugcuuacccuuggguaggcaggaaauuaagguucuacucuaaagauaucaaaacaacuaguagggccauuagagugcaaauuaacaucccagaacaaaaccaguuaccaucuguuauuuuggggguucccugaccauucacuugagaaugaagucugaccauuaacaaguaaugaggcuuacuaugagcucuaaauacagacaaacucuaaauacagaguuugccuaaugguaagccucauucuuaaauaucagcaggcccacagaucaucacacuugagaacucacaaagauaaaacacucuucccaucaaaaaggggaaauugccucagagaaacaaaaaauucaggaaauagaauauacuuuuuaaaaugguaaauuuuaaguuauauauuuuaccaaaauaaaaaauaauuauagcaggcaauuaaaauaaaaauuauuaacacccauauagcaaaaaaaccugaaugcuagaggaaagcuauaugaucuuuuuauuuucuauauauaaaguauuauaaacucacugccaaauaaaaaggugaucaaagaagaugaagccaaaaaaugaaggaaaagcaaaaguaggaugugucugguacuuaauaaauguuuuuuucuggauuuugugauuuuuugauaugacuucuuuuaacuuuauaauuuguugucauuucuucuuucaguccaaauaaauauucaguuuaaaaaaaauuuuuuuuugacagagggucuuacucuguugcccagacuggagugcaguaguccaguccuagaccauugcagccuuaaccucccaggcucaagcaauccuaccgucucagccucccaaguagcugggacuaugggugcgcaccacugugccuaauuaacuuucuuuaaaaauuuuuguaggacaagcgcgguguaaucccagcacuuugggaggccgaggcagguggaucacuugaggucaggagcuugagaacagccuggccaacauggugaaaccccgucucuacuaaaaauacaaaaaguaggcacgugugguggcaugcaccuguaaucccagcuacuugggaggcuaaagcaggagaaucauuugaacccgggaggcagagguugcaacaagccgagauugugccacugcacuccagccugggcaacagcaagauuccgucucaaaaaauaaauaaauaaaaacuuuuuguaaugucagggucucacuauguugcccagguuggcccugaauucuuggucucaagcuauccuccuguuucagccuccuaaaaugcugcgauuacaagguguaagccacccugcccaaucuacuuuuauaauuuuaaaagaaaucuuuuacuuuagagaaggcauaaaaauacuguaauauaaagcaagaagagaaaaugauuaggggugagaaaaucagaagaaacucuuaaaaugacagacaugcaggccgggugcgguggcucaugccuguaaucccagcacuuugggaggccaaggcagccagauugcuugagcucaggaguucaugggcagccugggaaacaggguaaaaccccaucucuacaaaaaaaaaaaaaauacaaaaauuagacagacaugguggugcacgccugaggucucagcuacucaggaggugaggugggaggauugcuugagcccaggagguugaggcugcuguaagcugaaauugcgccacugcacuccagccugggcaacagagcaagacucugucucaaaaaagacaugcucaccaaaacagaaauucaaugaaagcuugcaaaauaaugucaaccuaaaauaucaggcaaguaguuggggacggggggaagguuguuacaagaauuccaacauauaaauauaugcccccccaaaaaagagaauagggaaaaaugaaggagugaaaauuauccaagaauuagaacacuucccaaaacagaaaaacauauuuacaagggucuauuuaacauccccguacaauagaugguagagaaaaaguaaaaauuaagagaaguuuccaaaaccaaaaaaauaucuaggagauggggagaaauaccacgagugucaaggaggaaaaugaaauaaacagaauccuaaacaaaaccagauuuuuuuaaaaaggaaaaguauguucauauguggaggcaaaguuuauuauacaugcauauuuucuuacuagcaagacacuuaaauauguauucauagauuuuuaaauaauuuauuaaaaagaggaacacaauuaaaggaaaaaaaagacaguugugcagcauacucagaaagcaguaaguucagaucagcaggauagaaaagucugaagaauucccuaggaaggcagaagacucgauauacuggaugggaaaaugaaaacuuugaaaaugcaauaguaaggcugggcuugguggcucacgccugucaucccagcacuuugggaggccgaggcgggcagaucacgaggucaggagaucgagaccauccuggcuaacacagugaaacuccgucucuacuaaaaaauauaaaaaauuagccgggcgugguggagggugccuguagucccagcuauucaggaggcugaggugggagaauggcgugaacccgggaggcggagguugcagugagccgagaucgggccacugcacuccagccugggcgacagagccagacuccgucucaaaaacaaaaaaaaaaagaaaaugcaauaagaaaaaaaccaaggcaauuugaaaugacaggaaaaccaggaagcagaacaaggaaguauaaaaaggagcucuauccauaacuaguuaccuuagagaaaugucagccagacacaauugauuuucacuuuuagacauuuuuaaaagacagaaggcagauauuaauauuacucaucuucacaauguaaaauacauagaauagagguuagacagugauuuuuuuuuuuuuuuuuugagacagagucucacucugucacccaggcuggagugcaguggugcgaucucggcucacugcaaccuccacuucccggguucaagcgauuauccugucucagccuccugaguagcugagauuacaggcgcccgccaccaugcccggcuaauuuuuuuguauuuucaguaaagauggggguuucacgguguuggccaggcucgucucgaacucuugaccuccagugauccaccugccucggccuccgaaagugcugggauuacaggugugagccacagccgccuggccagauagugauuuuaagagagugagaguauuauggucaucuuacaaaguagagaguagaaccugucugcauuugaugcaauaauaaauaaaaguauggcauagguagaauaccuaaaguugaaauugacaccaacugaacgccgauaauuugcauacuaucauuaggauugcugcuguauuauuacgaucauuugaaaaucuaacauucccccaaaaucuaccuuuuuauaaaacuuaaauuuauugguauaaagaaauuuuacauuacaauacugauucaaaaccacuaaucugauguuucucuuauauagaagguaaucauaaaaauguuacuaaacucuagcuaaauucugccaaucuuuauugaacacaauauccauccaacaauuauagcuacagccuuaaagaacacaguaaucacaguaagaaugacacaaucauuaugagaagagcguauaaguacaacaaggagacaaaaaagagauuaauuucugagaggauucuuuaaagaaacauuuauuuauuuucaugaauaugaauuuaauaggaaugcaaaaagaagaacguggguguggaaaugaaaaucagcauauguauaguaacuuaaaauaaagucugggaauuguuuauauaauuuuagaagagaugguaggagagaagauuggauaaacacuaaaaucuugagaacuucacauaacaauaaggagauuaaaauuuauacuguggagaauagggcaccaccgaaaauuuuaaaagaugugaucagauuugcaucuucauaagauugaucaugcuugcauugguguggaacagagagaaguguaauuagacuuaggaagaucauuuuugguugauauauugguacagaugagggagaaucaagaugacaagguggcugauuagaaauggaaaaugaagauauaaaggaggaagagaagucuaggaugauucucagaacuuucugguuuuguuuuuuaggggcaggaaaaaugguuagguagggagacuucuugaaauagaucugucuauagccacaaagaaauuuaaguuaucccaaauugaucauucaacuucaauuugagauuucagcugggcgcaguggcucaugccuguaaucccagcacuuugggaggccaagguggguggaucaccugagguuucaaauuucauuaagaauucugauuauauucuuucugaauuucucauauauucauuucccuuucccuuuccaauuaucaagcuccuuauugcguaauacaggaaaguauguguuuccuacuccucugccuuauaauuucucugguuccuauacuucagaaaaauacaugacaaguagcacaacagauggaauaaaggaauuaagaauauacuguuacaagguccuuauacuaaucuugaaggguagaauauuauuugaaggcagauuaauuuaaaauguauauuauaagcacaagagcaaccacuaaaaaaaauuaaaaauaagauacauggucaggagugguggcucacgucuguaaucccaacacuuugggaggccaggaagggcagaucaccugagcucaggaauucaagaccagccuggacaacauggugaaacccugucucuacaaacgcauacaaaaauuagcugggcaugguggagggcuacucaagaggcugcggugggaaggucacuugaacccgggaggcagagguugcagucagcugagauuugcaccagugcacucuggccugggugacagagugugacucugucucaaaaagaagaaggagaaaagaagauacuuguuaagccaauggauaaaaagagaaauguuaaaugacccccaaagcauaaaaauuuuuuucuuuaaaggaacaaagagaaaacaguaagcaacaguaucaauauuauaaugggcaaacuucaagaaacuguauagcaagagaguagaugaucuagauaaaauggaaagaaauuccuagaaagacacgaacuauagaaacuguauuagucaguuuucaugcugcugauaaagacauauccaagacuggguuuaacuguacucacaguucuauguggcuggggaggccucagaaucguggcagaaggcaaggaggagcaagucaugucuuacaucaaugguggcagacagagaaugagaaccaaccaagcaaaacaguuuccccuuaucaaaccaucagaucucugagacuuauucacuaucaugagaacaguauggaggaaacggcccccaugauucaauuaccuccagcuggccccgccacugacacaugaagauuauuacauuucaaagugagacuuggguggggggauacagagccaaaccauaucagaaacugacucaagaaaaaaaaaaaaaaaacaacggaaaaucugaauagaccuauaacaagaaaggagacugaauuaguaauuuaacaaacuuuccacaaugaaaagcccaggcccagaucacuucacugaugaguucuauaaaacacuuaaauaauugacaucaauuauucacaaauucuuccaaaaaauauaagaggaauucuaugaggccaguauuaaccuaacaccaaugccagauagaaacaucacaaggaaacuaaaggacaguaucuuggccaggcaugguagcucaugacuguaauccuagcucuucaggaggccaaggcaggaggaucacuugagguuagaacaagaccagcuugggcaacacagcaagaccacaucucuacacaauuuuuuaaaaaaauuagccaggcacgaugauacgcacccauagucuuagcuacuugggagacagaggugggagaacugcuugagcucaggaguuugagguuacagugagccaugauugugccucugcacuccagccaagaugacagagcaagacugucucuaauaaaugaauacauaaauauuuuaaaagaagaauauuccuuauuaauacaaacacaaaaauccucaccaaaauacaaacaaaccaaauccagcaacuaaaaaggauuauuucccauggccacaugggauuuaucccaggaauccaagguuuagcauccaaaaauuaguguaguacaccccauacaguacaaagcccauacgauuaucuccauagacacagaaaaagcaccgaaguccaacacccuuucauuuaaaaaaaaaaaaaaauucaaccaacuaggaaaaaggaacaucuucaguuggauaaagggcaucuaggaaaaccccacagcuaacauuaugcuuaaccuuauuagcgcagaugaagauguaaagaaauuggaacccucauucgcugcuguagagaauguaaaaugguagucaccuugaaaaacagguuugcaguuccuuaaaagguucaacagaauuaccauauaacccagcaauuucacucuuuacuaucugcucaagagaaauucaaguauauguuaauauaaaaccuuauaaaugaacguuuauagcagcauuauucauaauaacccaaaacgggaaacaacacaaaugucaaucaacugaugaauaaacacaaugguaucuccauacaaucaaauauuaauuacucaaccauaaaaaugaagugcugauccaugcuauaacauggaugaacauuaaaaacauuacacugagugaaaaaagccagucacaagagaucacauauuauaugguuccacuuauauaaaauguccagaauaggcaaaucuagagacauaguagguuagugguuauccacacaacuggaagaguugaggggaaauggaguuuucuuuuuuuuuggaggaagugauuaaaauguucuaaaacuuaguacugugaugguugcacaauucugaauauacuuuaaaaaccacugaauuguauauuuuaaccaagugaauuguauaguaugugaauuaucucaauaaagcuguuuauaaaaaugcaaaugguaaguuaacaauaaaauaaugcaaacuaucaucauauagauuuaagaacugccauauuuagucaaccuauagugcuucuaauccaguguucugucucagggccagacaagaauauacauauagugagaagaaauggcccacuucauuuaggaagaauagggaagacaguucuaaaaccauaccgucacccaauaugaaucucuauuauccugauccuuuugaaaacuguuaucaaccugucuuuucauuuggaauaauuauuuccaauguuuuacuaccaauugaaaaaagaaauacuaucauuauuuuugaccgaaauuuacuauuuagcucuugugggcagucuccuuguuuuaauuuacauuaauuaggagaaccaacacguuuucuccuuuuuaacuuuauaggcuuuucuagucacccaacuucaguaaacucuacuuuauaaaguucuuccauaaaacagcuaagaauuugguaucucaaugauucuaaaaacuacagagaaaacaucugacucauucauucaucauaaaaagccuauuauuugguaacagucauuuuuacuaggccacaugaagauguuauucucuaaaauuaaauggcuggcugauugugcucuauugcuauaaguuuauuucuuagguacaggaggaucauauagaagcauguuagccuuguuuauuaauaauagcagcuaccgugacuuaguuaccaggcuaagguguccacauguagucucauuuaaaccuuguaauaacacuaaaacauuacccucauuuuacacaugaagaaaacagaggcuuaaagguauuuauauccaaguugugucucuuguccugaguucacuagaccugauuaagaacucuaugaauuaaagaaaaaaaaagucauagaauaauauguuuauauauauuuuuuuuaaugugaguacauauuuguguaaaagcaugaagaauuggaaauacauacaaauauaugguugccucugggcaaaggaguaaaggagguuagggucaagaaagaacuuccagguucugcuguaaauuuuuuauauggcuuuaaucuuaagcaaaacaauauaaauguauuccucauuguaagcuuuuuuguuacaagaauaacaguaucagccgggcguggugacucauaccuguaaucccagcacuuugggaggcugaggugggcggaucacgaggucaggaguucuagaccaggcuggccaacauggugaaaccccacaucuacuaaaaguacaaaaaaauuagcugggcgugguggcgggugccuguagucccagcuacucaggaggcugaggcagggagaaucacuugaggcugggaagcggaggcugcagugagccgagauugcaccacugcgcuccagccugggugacacagugagacuccgccucaaaaaaaaaaaaaaaaaaaaaagaauaacaguaucauaaaaauugaaacauuuauuaaucagaacuaauacauauacuacuguaguucugugccaaucucucuaucaccuuuauaccuuugcucuuccuaagcucacaguauacauuauuucccucucucauuucauguggcuucuuccuucaaaaaacuuugccuugacaagcucucucacuuuugcggggcuagcguaggggaguagcaauguuuagguauaaccaagauaauuaaaaaguuucuguauuuaggucuacauggggaauaaaggcaggaaggcugaccaacaguuugguguacugggaaauccugcaauuccccucaucuguugugcacccucugauaggaccuggguagaauaaagcugcuauucccuauuggagucugggaaguggaggcagugacauuaugauguguucuaaaccuggguuaauacaugacucuuggacaaccauauguauaaaaauaaaaaggcuaaaaagaaacaucaucccccaauuuaagauuagagauaaaaaaaauuaucaagaaagggcaucauuuauauuaaugucauauauuuuaagcacaauguacuaugcuaaguaagcuguaaaugacaauuuuaucugcccucuucaauaucuuucacaaagugaaaccauuaauaaauaccugaugaacuaaaauggauuuccaucuuaggguggcaggcuagauauaaaauguaauaggaaauguaguuuuuuuuuuuuuaaaaaagaagcucucucaaagaaccucuugcgucaaguauaagcugaaaccuagaagagaauguuauuauagaaaagcaaagaucuacguuuuagauaaagaaccauacuguacaaaaaauaauuuucacauacaugauauaauuuauaaccgcacuuuacgaucauuauuuauaacagccacucuguuaucacugaaauguugugcauauacaugaaaauuuccagauaggccucucuauucauguauuaucuuuuucuuaguuauaaggaaguccuuuauuauguguucauaauuuuguguauguguguguguguguguguguguguguguguggugagagaaauaguaaaauucuguuacugacauuucuagauuucuauucuaaguauguuacuuaauuauuauauauugugguacuaugacauccacaauauuuacuacgaucugccaauccuuaaaaaaagguuuuauacccccuuuuucaaauaucaagcugucuuggguuuagaagauuuucuauucuagagaacugucucuagaauccaaacauagcacauuucccuuauuuuuucacuacagcuauaauucauuuccauagaagaccugguuaaaccuagcuuuucuagucaaaucaucaaguaaauccucuuuggacuucuacaucuucauuucuaaaauuaagaggaagagaucaggcagaaagaaccagaagauguacuuaaguucccuuccaaaagaaaagaaagaaaaggaaaggaaggaaggaaaaaagaaaggcaagacagaguaaacacuaaacaaaauaacaggcuauaaacucauaguaacacuaagauaugagacaucaaaagauugucuuuuuaaaacugugauuagcaguuucuugugagcccuuaaucucacagagcacguugcauucaacugaacugguuauuauauguucuuuuucaaaaaguccacaaugcagcuuuuacacacacauacacaggucaagacagauuccuugggaaauguuaaguauguuuacuauccuuaaaaaugaaaacaagcaacaguacccauagacaaccaagggcucagaaggauaaggaaaagucuuucucccuaauaaucuccauuuguccacaaaacuuaguuuacagaccacuuucuccagauguggcacggugacucaugccuguaaucccaccauuuugggaggccgagaugacaggauggcuugaggccaggaguuugagaucagcuuggucaacauagcaagaccccaucccuaaguaaaaaacaaaauguaauaaaaaauaaaaacaugaaaagauaaaaagaaaucacuuucuccaaaaagucauuuccuucuauucuacuauagccccaacccucaagacuaucuuacuuccccaucucgcaagagugaguuaaguagcaggcacuguuggcagucuacuacugggucauucccaaacccccuccuccuugcuaaccauaauccuuuauuugguuuaaguaucuaucuuguacuagaggaaaagcaagccccaucuccugucaagacagucauaacuggccuaacccaaucauggaaguuccauuuucaguauuugaucuagacaaagccaugugacccacaacucugaccaguaagauaugaagcauuguuaaagaaauugcugcuucugcugcugaaugcuauccaggaugcaugugauggcugaaaauagggccauaaggggcauuagccugaaauacaugcugagaauggcagagagacauuugaugacauaacugaaucaaucugacacugccuuaccaucuaugaaauauuauaaaaacauccugaaaacucuaugcuuucagaaguucuuuaaaaaacuuagccuggcguuugguggcauacaccuguagucucagcuacucagugggaggacugcuugagcccaggaguuugaggcugcagugaguauugaaucacugcauuccagucugagugacagagcgagacucugucucaaaaaaaaaaaaaaaaaaaaggaguauaaccacacaguuucuacuaggacacugaacagagaacaaaggacuaauaauacagguauacagguagaacuggggacaaaaucuaaauuuuaugacuagcaguguguaccauuuauuaguauacuaccauacuaugcuaaguaaaaguuauucuuucauuuuaacagcaaagaauucugucuuuuacuuuauucuuaucuaccuauacauaguacacuguuaagcuucucacugaagcacuagaauggaaaaucauugggguuuuguacuucagacuguaacuuuuaccaaauguaugauucuuuaucauaaaucaggagcccuguuuggugccaucaacaaacaacuacuuucucugaaaauuaugggcuaagaaucuuaccucuccacuucccaaucuguaucuguucuaguuucuacccuuuccucuacuccugauuucaccaacaaagauguaauguagccucaguauguccuuucauuauuaugccuuaauugaaggaagcauguggccuucacauuugagaaccaacuaauaaaccuucccacaaaaacuguuauaagcaaagguuaaagucuaaacuauuaauauuacuggcaccaaacagauguuugcucacuuaccuuucuuuuucccccccgagacagagucuugcucugucacccagacuggaguguaguggcacgaucucggcucacugcaaccuccgccuccuggguucaagcaauucuccucccucagccuccuggguagcugggauuacaggcaacugccaccacgcccggcuaauuuuuauauucuuaguagagacgggguuucaccauuuuggccaggcuugucucaaacaccugacuuugugauccacuugccucggccucccaaagugcuaggauuacaggcgugagccaccucacccgguccucucacuuucauuuuuaaauauauuuuucauauguaacauauuucagauauacugucuggguaucagcuuuugcugguuauucugggaacaaucauuuccgguacuggcauuacaggccuuucucacuuaagucaacaaacaacucacaaacuuuuagaaauaugguccauuagugcauaaguugaucucauguuagcagaguauaacuaugaauuauuauuuuacuaaaaauauggacaauguuuaauuuccauauaguauuacacacaguagcuuuuuuuuuaauuucaagaagcugauaugaaggacaaucuauugugaaauaauauacucaucugugaugguuaguuuuauguuacaauuuugccacaguauucaauuauucuaucaaauacuaacuagguguugcuauaaagguauuuuuguagauaugguuaaaccuacaaucagcugacuuuauguaaaggagacuacccucaauuaugugguugggucucaucuaaucacuuacaaggcaguaaacugggauuuccugagaaauccuggcuaaaggugcagcaucagcuccugugcuagaguucccaacccaauggccagcucaaccagaagacagauuucagacuugccagccccaacaaccaaguaaacuaauuccuugaaauuacauauaauaucuaucuguuauauacaaaaucuccuaaugguuuuguugccuuggagaaaccugauaccauuuuucacacuaaaauuacacacacacgcacacacacacaauguaaagcauccacauauccaugacaacaucuaaguuuuuaacauuuuuuuguugugccuguccugagauggucaaagaguggaaaugcacagagguccucagcccagcagaagacagauggucuuuacaacagagcagccuacauacauuaaaguguguaagaauaaggaaaaccgacuuacacaaaagauaaagauuuuuuuuaaacacacagaaagcuaauauagguuaagaaccaggcaagcauuaaacacaggaacccacaagaacuacgcuaauaauguaguuucaagcuuuuguuaauaacugacaccuaauaauagcuaacauuuauugacuuccagacccuguucuggugcuuuacauauauuaacauauuuaaacucaacaacaccucugugaaguagguaccuacgugggcuugguggcucacgccugaaauccuagcacuuugggaggcugaggcaggaggaucacuugagcccagaguuucagaucagcaacagugagaccccaucucuacuuuaaccaaaaaagaaauggaugcacaagaggauuacaauaaaaaaguggcaaagccaagccaagguguaaacagaagcugccuuguucuagagucugugcuuugccauuccacaauaccaccuauaaaaguagagaaauaauuuuauuuuuauaaaguagauuuauagucuaauauguagguguuuuaaaaauuaacaaugaaaaauacauaauuucauuuaagucacuuaaauaaugaaaauuacauaaaagauagacuacuagguguaaaaugcaaagaaaauaaaucuaucuaagaaaggcaaggcagaaauaaaacacauagaaggcaggaagaagaccaacuccaaacauaccaauuaaaacacauagaaggcaggaagaagaccaacuccaaacauaccaauuauuacuauaaauguacguuaaaguucucuauuacaaaaaaccuguggaacaggcuuuaaaaaaaagucuaaacacuguuuauuuauaagaaacacaucaaaauuaaaaugacauaaaaaagaagauaaagggccaggcacaguggcucacacugguaaucccagcacuuugggaggccaagguggguggaucaccugagguaaggaguucgacaccagccugaccaacaugaugaaacccugucgcuacuaaaaugcaaaaauuagccaggccugguggcaggagccuauaaucucaguuacucaggaaacugaggcaggagaaucacuuaaacccaugaggcagaaguugcagugagccaagauugugccacugcacuccagccugggcaacaagagugaaauucugucucaaaaaaaaaaaaaaagggaagauagaggaacaaauaaaacaaaugugaaaaaagaaugacaauauaaaaagggaauguguuaagcaaagagaauuauuugagaaaaugcugcauauuuuauauugauaaaaaguacaauuauuuacguauauaacauucaugcuuaacccagccuaaauauaaagcuaugaauauauaacauaaaaacuguuagaaauacaaacggaaauugacaaauccacaauuauuuuguagggcugacacguuuaucaaauaucagcuaaucaaguagucuaaggcaacaaaaauacauggaauuuaagcaauacaauuaacaaauacagauuuuuucccuuaauaaauacuauuuucaaauaaacauagaacuucaauuuuuacaacagcauacauuagacuauaaauaaaaaguuuuaauaaaaucucuaaaguggaaaucacauaaagcauaaguuauacuuuggcauauaaaacuagggaucugaguagcauaaaugaacagcucuaaagaucccaacaucugcauuucauaagaugccagaacaguacagucagauuauacuggggcccacaaucagcaaaccgcauuuauuuaucaguuuucagugcccaacucaaaugcgacaaccaaggcucaugggauuacuugaaaaaagucuuuaaagagcauccaaucuacaugggaagcaaaaaaauaaauaaauaaaauuaaagagcaacuaaaaucaguaacaaauaacaacaaccaaaaaaaggaaccuggaaaaggcagggucaugugguggcucacgcuuguaaucccagcacuuugggaggcugaggcggguggaucacgaggucaggagauccagaucacccuggcgaacacggugaaaccccgucucuacuaaaaauacaaaaaauuagcugggcgugguggcgggugccuguaaucccagcuacucgggaggcugaggcagaacugcuugaaccugggagguggaggcugcagugagccaagaucacaccauugcacuccagcucugggugacagagcaagacuccacuucgagggggugggggggggggagaaaaugauauggacguuagaccauuggucuaggagaaccaacauauauguaacaggaguucuggaaggggcaacauaaaaaacagagggcaagaaaugaaaugaguagaagguaaauuuucagaauugauggccagugaguuuccagacaaaaagccacaauggaaaaaagagacccauaccaaggcacauugcugaaauuucaaaacgcugaggacaagacaaaaaaccugaaaacuuccagaggaaaaaaacaauagguuacagggaacagagaauccuacuagccucagacuuuaacagcaauacuggaagcuagaagaaaauagaauaaaugucuuuaaaauucugaaauaaauuauuuccaaucuagaauuuguuauccgaacuaccuauuaaagaggaaagggaaaggaagaugaaggaaaauauuuucagacauguaaguucucaaaaauacauuuaucucccaaaugaccuuucucaaagaguuaugaaguuauucuuucacaaaugaggagaccaagaaagagaaagaaaugggauucuggaagcaggaucaaaaaccagcuagauauaagaagaaucuccaaaaugagaaugaaugaagauccccaaccuaagcaucaaccuagaaugcaaccaguacaaauggugaaguuuagaaguuuaagagagguuaucuccaaaaaagaagaauaucuaaaaguuuuaauguagugacaggagauuugcacagcuaggagggaagacuucaggaaaauaguaauaaauaucuugacuguggugaugguuucauggauguggacaacuuauuaaauuuguaccuuuuaaauauguacauuuuauuaugucaacuauacuucaauaaugcuauuuuuaaaaauaaaaaauaaaugucaacaaaaauauucauauuaaaugcuaacauauuauaaaauaagacaaucacaucaaaggcaaaaauuaaaaaacuguaauucauuauugauaauuuuuaucaccaacuucuugagaugguagggaaaggcuguugaacaguuuaacaagagguacuuggcauucagaaauugagcuguccaguaauaguagccauuagccaauuaaaaaaaaauuccuucaagauucacacaucuggguuguaaaaauaaaauaaauaaaauacaauuucuuuagagaugggagucuugcucugauacccagguuggagcacaggggcacaaucauggcucacuguggucucaaaacuccugggcucaagcaauccucccaccucagccucccagguagcugggacuacaggcacaugccacugugccuggauacuuuuuuuuuuuuuugguggagacagcaucuugguuuguugccuagccuggucucaaacuccugggcucaagcaauccucccaccucagccuccccaguagcugggacuacaggcacaugccgcugugccuggauaauuuuuuuuuuuuuuuuuuuuuuuuuuugguggagacagcaucuugguuuguugccuagccuggucucaaacuccugggcucaagcaauccucccaccucagccucccagguagcugggacuacaggcacaugccgcugugccuggauaauuuuuuuuuuuuuuuugguggagacagcaucuugguuuguugccuagccuggucucaaacuccugggcucaagcaauccucccaccucagccucccagguagcugggacuacaggcacaugccgcugugccuggauaauuuuuuuuuuuuuuugguggagacagcaucuugguuuguugccuagccuggucucaaacuccugggcucaagcaauccucccaccucagccuccgagguagcugggacuacaggcacaugccacugugccuggauaauuuuuguuuuguuuuuuuuuugguggagacagcaucuugguuuguugccuagccuggucucaaacuccugggcucaagcaauccucccaccucagccucccaaagugcugggauucaggcauguaugugucaccacgcccagccccaaguaugguuauugaguacuucacugaaauguugcuggugugaaccgagauauguuaaguguaaaacacacagcagauuuugaagauguaauagaaaagaauauauacuaucuuuauaauuuuuauacugauuauaugcugaaagauauuuaggccaggaugguggcucacacuuauaaucucagcacuuugggaggcugaggcaggagguucacuugaggccaggaguucgagaccaguguggguaacauagugagacccacccuacccccgucucuacaaaaaaauuuaaacauuagcagggugugguggcacgugcuuguagucccagcuacuuggaaagcuaaggcuggaggaucgcuuaagcccaggaguucgaagcugcagugagccauaaucgugcaccacucacugcacuccagccugggugacagggcaagacccugucucagaaaaaaaaaaagaaacuauguuuggauauauauuggguuauaugaaacauauucaugaaauuaauuccaccuguuuuuuuuuaaauguggcuacuagaaaauuuaaacuagguugggcgcaguggcucaugucuguaaucccagcacuuugggaggcugaggcagguggaucacuucaggucaggaguucgagaucagccuggccaacaugguaaaaccccgucucuauaaaaauauaaaaauuagcugggcgugguggugcaugccuguaauccuagcugcucggaaggccaaggcaggagaaucgcuuaaaccugggagguggagguugcagugagccgacaucgcucacuacaauuuuauuucuaucacuuucuccuuggauuucaauuagauuucaaaauucccauuaauucauagacuuaggaaccgcagaguaauauauccaauguuauucaacuaagccuucuaagauuagaucucugauuuuggaaacauuauucuaucaaauuguucccuugguuuucucaucuauaaaauaggacugacaacauacuauguaguuauugagagaacuaaauaagauguacuacaggacagcuuaauggcacuguuagggacuugcuagaucagucacccagcaauguaacuacuucuauacuauuuccucucaaagugcaacauucacauucagaccuaauaaaaugauaauuaggucauaaacuuucagggucacuucagaccaaaaaucucagaaguuacuuuccaaagucagucgaugacaaugauuuaaaauuauaugaaacuucaaacucaaauguuagucuaccacaguguuuguuacuuguuacuuaaaauaauccagccaaguauacaaaauugucauuuucagaugaagaaaaagccuuagaaguuaagugaggaggauauccagauucacacaaauauuaauauugccagaaaacuucauuuuaaucauuggauuuuaaaaauaagccacaaaucccauaagaacucaaccacugggagggggaacaaagaaaucugacagaacuagagaagacugggaauuuuaauuuaaguucucaaaaaaaaaaguuaucucaaucauuagaacacaaaguauaaaccccauuuauuuaaaauaagagcauauuuauacuuuaaaauuaaaucuguagucuccacaaaauaucuuucaaaaacucaaauccaaaaagguucugaagauuuuuagugccauugguuuguguuauagcuaaugccaguauugugccuauuaauaagagaccaaauaaaaagcaaaaauaaaacagaucauuuaauuauaauuuaauuuaucuaaugaagaccagcaauuauaaaacuucacacacaccuaacuucaguuguuauacaaaaucauaaucauuuguaccuuucuaagaagaaacacuguguucagagcuuauguuaugauuaaugaacagugacagcagcuaaaauucauauagccacuauauuuucauuuuguggcaaauagcuaucaacaacuuacuguaugauuuaauuaagugguuaaaaggaucuagcuucaaguuuaugcucuaaguaaaauguuuuucaaagaugggcaguaaacaguauuuucccccuguggaaaagcaguuuuucauucuuccaaaaauuguaccaagguaaagcaaagcucuagaugaugcaggcauguuauguaggcguuagcaguacugcccucacuaugugcucauuggacaguagugcaaccccaagaaaaagaugguuagcaguuuuuguuguuguuguuguuguuguuaacgaaauaaaacaaaaaacagcucauugcuaguaaggaaacuauuuugugaaacuuucuucuuuuuaugugugcauauacuaagucacaauguaaauguauuucuuagaaugagucucagaaagguuugauagccacugcaaaguagucugucuauagcaaacuacuauacauucaauaacuagagagguguugcaggaaucagacuguaccaagguaaaaauccuuuuugacugugagaggauaagaagcauauuuaaggcaugggccuaaagcugacaggauuauccaacucuaccacucaguuuacuaauuagacaacaaacuuacccaaggucauucuucuauaguuugcauuagaacuaagucucccacucuaacgcucaaaauaagcuccacaaagauacuucagcauguaaguauuaauucagaauuuccuauuugguuuucaauaaccaaaagaaacugcagcuuaacacaugcaacuguuuccucaaauacuauucuaccagauuaaugaccaugccagcucucccauuaaaagcuuuuucuagcuaguuacuugguacuuagguuuuuauagcacuuuucuuuucccauuaugcucaguagugcaugcaacacacuacacuuaggaaugcaacacacuuccuuugggaaugccuaacuguggccauaacuaugacugaaauuuuugugaauuucuaucaucugucuaaacuuagaagaaaaguaccacaaaauaaaguuaaaucagaccauauuuuugugaucaguguaucucacuauuaaaacauuguauguauuuuaacgguuaucauucaaaacuugaaguauauccaaaauacuccauucccaucuccugauaaauaaaucuucacugacaacugauuaagaagagaaacauguuaaggacagaaguuaaaacggaauuagacaaagauggggcagauuaucacagcuucauacuacaaacaaagguuuauuucuacauccucuuuccuaaauauccauaauaaacucauauuucuugccaagaaccccagaaaaggugccucaaauuauuuccauaaagaaaacaacauuacccauuaagcaacucuguuaaugauuauccacaaaauuccaaauuuuaaaaaauugcuuaacauugggaauggcagagguacugagccuuauuaugacuaaucaagccagugaaguaaacaaaaaaugcaggcaagagaaaaaggaagcugagucaaguacagaguucuucgcauccacagagaaaaugcuuuguucuuuauuucucaaacuugcaguauaaagaccaaaaaaauccauuauuuuaauuucacaguccagucaauucacacggcuguaugugaauuuuucuuucagaaaauuaagggaaaggagccaggcgcgguggcucacgccuguaaucccagcacuuugggagggugaggcagguggaucacuugaggucaagaauucaagaccagccuggccaacauggcgaaacccugucucuacuaaaaauacaaagauuagccaggugcggcgcgcaccuguaauuccagcuacucaggaggcugagacaggagaaucacuugaacucaggaggcagagguugcagugagcccagaucgugccacugcacuccagcccgggcuacaaagugaaacuaugucucaaaaaaaaaaaagaaaaaaaaaaaacagaaaagaaaagaaagaaaagaaaggcaaagaaaauuaagggaaagggaauuuauagugugucugugcauuuuaauauuauagucacagcaacauaaccauauuacuuucccaacagggaauucgaaaucugaaggcaaauaccacucacaugucaaauaaaauaacugccaaaaauuuacucacuaauuuuucuaaaauuuuaugaaaaugaguacauuauucaacuguuuuggagaaaagcagacaauaugauuuagaaaaaacacauaauuaguggcaauuuuaacagaagagaaugcucucccacugaacuucauaaaaacaaaagaaaauccagacuucaccuguuuuacuuuuacauuuuagagcaguaaaauucuuaauuucuuauuucucaaacaauacuccccauuauuguuugcucccccuguaauguuuauuccucccugaguucugagauucccagguauggaauuugaauuuccugguaguaccagcuuuugcucauauuuuuagaaccuuacugugacccuguggugguguucaccagaaacagcacgagagagaagucauaccuguauuaauaacuauuaccaguauuacuaagaauuuaaaauucguucuagaguuuacauguacuguccuuaucauuuuauauuuuaauaagucauucauaaucuuaaacucuaaugaauguuagcacgauagauauuuccuuccaauuucuacgaaugacuuuaaaaaaaaaaaaaaaaaagaucauuggccgggcacgguggcucacaccuguaaucccagcacuuuggcaggcugaggcagguggaucaguugaggucaggaguuugaggccagccuggccaacauggugaaagccugucucuacugaaaauauaaaaauuagccaggcgugauggcaugccuguaaucccagcuacucggaaggcugaggcaggagaacugcuugaacccgggagguggagguugcagugagccaagauggcgccacugcacucuagccugggugacagggugagacuccgucucagaaaaaaagaaagaaaaaggaaaagacgaaaaaaaaauuaauaauaaaaaauuuaaaaagagaauuuuacauaaauuucaagauuuucaaugccuuuuaaaacuaaaacaucaaaccacaaucacagguauuaaaauucuaaacauucaguaguauaagggaguagccuucuucugguuucccacaggucaaguaaacaguuuaagcacaauuuaacccuaauuauaagcaaaaaggugaaauugcuuagguugguaaaugagcccuuuuaggugagaauaucaucauuuaaaucauuuaaguaaccaggacucagcuacuacuuauagauuugauagcuagagcacuaaauacaaagugagguuuaaagucuuucuaaaguaacaaggcauccacugccaaaguuuuggauuauguuuuagagucacauuuaccgcaugaagcuuguguuuaauaugacgaaucuaccauaucugaacagcaaacaaacacagaugauaaauacuguaaacuguuggaagucaaacacuguaaaguuuccugagucugugguaaguuauuuuucuuaaauagcuaccauguagcuauugauguguuucacugagcaacuacagugaauuuuaauagauacuauuuaccacuugucauuucaugaaaaauaccaggagcuuugcuuucacuguuucucuucaaaugcuucccaguucauaauauacuaguacuuaagaaauuacauagcugaauuauguuccaugguagaucauaucuagcucuaucucaaaauucuagcagacuacguuugguccaaaguaacacaagugccuaacucuaugacaaaaucauaucuuucacauaaaaacaaaucuaauucuuuagcuacuuaaaaauuccaggcugggcgcgguggcucacaccuguaaucccagcacuuugggaggccgaggcaggcacaucacuaccucaggagaaugagaccauccuggccaacauggugaaacccugucucuacuaagaauacaaaaauuagcugggcgugguggcgugcaccuguagucccagcuacugaggaggcugaggcagaauuccuugaacccaggaggcggaggcugcagugggccaagaucgcaccacugcacuccagccuggugacagagcgagacuccaucucaaaaaaaaaaacaaaaaaaaaaacaaaaaaaaucccuccaaaugaaaaaaagcacagaugcugacuaauuuuauccaauaagaaaaguaacuaaaaaguuaacacugcacaucauggaaugaguuuaaauauacacauaauucucaauaaaucacagaauaguaacaauaaagggaccaagaggucauuuaguacagucuuuuuaucuucaacacuucugaaugaauagcuacucugugugaauaagucuuuguaaacacuagucaguuauuaugacucaaacauagcacuaugggucaauucucuauaguucacauucuaauuuauaauaaaucuuaauuuucuuuuacugucuucuuggaaguccuuggacaaccauacaaugcaacuucucucccaaagcaccagcccagguacaaacaccacgcagagcaagaacacauuaagaucugggccaggcgcgguagcucacaccuguaaucccagcgcuuugggaggccaaggcgggcagaucacgaggucaagagagcaagaccauccuggccaacauggugaaacccugucucuccuaaaaauacaaaaaauuagccaggcacgguggcacgcaccuguagucccagcuacucgggaggcugaagcagaagaaucgcuugaaccugggagguggagguugcagugagccaagauugcgccacugcacucagccuggggauaaagcgagacuccaucucaagaaacacacacacacacacacacacacacacacacaaacacacaaacacacacagagaucugacuuuaacuucacauuuuuaaaauguaacaacaaacagcagcuugaaaacugaaaaaggccacagugucucacaccuguaaucccagcacguugggaggcugaggcaaaggaucacuuguggccaagaguuggagaccagccugagcaacauagcuugaccccaucucuacaaaaacuuuuaaaaauuagccaggcauggugguacaugccuguagucccagcuacucgggaggcuaaaggggaaggacugcuugagcccaggaguucaaagcugcaguaagccaugauccugccacuucacuccagucugggccacagaaugagauccugucuuuauugucuuuggggucacagacaaccugagcuauuaguuuuaacgugcacuacaagguaaucauaaaguuugaagagaagcaugcucagcuuuuaaaacaaaaaugaaaaacaaacaaacaagaaugaucuaggcuccacugccacuucuacguuuguugaacacaagcuuggcaaauuacuucauuucagucucuucacccuguaaaaugggacugauaccucauucaggugacauaagaauauaugacacaagaauaaaagagaauauauauaaaacacagugucugguucauaaauaguaucaaaucgccacccuuuucucaccaauuugagaacacaagcccuucaaacauacauagcucaaacuuuuuuuugagacaagguguugcucuauugcccaggcuagaguagaguggcacgaccauagcucacugcagccuugaacuauagcuaggacuccaggcauguaccaccucacucagcuaauauguuaauuuuuuuuugcagagaugaggucuugcuauguugcucaggcuggucucaaauucuuggccuuaagugauccucucuggcuuuggccucccaaagugcugggauuacacgucaaacuucugaucaaacuuuacguuaggcccuaaaaaaaguugccacugaaaacacaacuugccauaacaagacaaauuuaaagacaacugaucuaagaacucauuuguguuacaagaaagacuauuacuugauaagccauuuaucucauuguauucaguaaugucuuaauuuacucucuacuaguaaauacagaaauaagggaauaaccauuauuguaacugcaaaagcaaaauuuuaaacauugauaaggagcuaguauaaacauuuuaaaaaucuauuuuuuguauacuaaguucaauuucagauuuuaauacuauaacauaaauauauccaugaagauaaauccauuuuaaacaccaauaucaagaagauaaaaaaccagaaauucaccuaucaaguucaaagauucacuauacuuaaaugaaaaaaagaaaaacagaauuaagaugacuaaccaauuugaugguauaaacagugauauacuauugacauuaaauucucggcauugaaaaauauuugcagaaaauauaaaaggauucauucugauauaaggaacuuaugaaaacugguuaggggagaaaagcaccugaaggcaaaaauauaacaaaagacaaaagaggaaauacaauuaguuauuauuaucaaagcauaugggggaaguucugcagacauaaacuauaguuuaugaaauauuuaacaguauugauaaaugggguuaauaaaauaagaacucucacuugggacacugaaaaucuauauaacucuucuggaaaacaaucuuacaaugaauagaaaguauuuaaauguucaugcccuuaucaugcccuuagaaccaguaauuccauuucugaaauuuaauccuaagaaaauaguucuaaacagugaaaucugagguacugaucaguguuuuguucacaaggcuaaguaggcaaauucccuucuccuauuccaagcccuugugggccucuagccucaagacuguuauuuuagaaccagcaauuagaagacagucuccucagcuggcuucugucugagaaaguccaggcccaaaggaaggagucugguuggauuauacucaagagggaggggaugagaauggaguuugagagguagaugcuggaggaaaggaagggauuagaggauucauccagaaaagaucaauacacucacccuccuugggagcugcagggagaagggagagacaauaaugguaaaaacuuuccuucggaaaauugugcaaagauccuauuacccaauauucucuguaacgaggccuuaaagaaaccuuccagacuuacauaaaugggcaugucaaugacaagcgguguaggugaaagacuggaggaaagcccuuuccugauaaaguucuggaauguaagaagcucaccaaggauuagagggagggggauuugugcagggaaauaauggccaucucaauuagguaaggauacaacacagauuaaauuugguuuucauaaaacagaaauauuauuucaugguuacaaccuuguggaguaagacccucgcccacuauauuuacaauagcaaaaauaacauacuuaacacuguggggaaaugaaggaaauuauggcauaugcacauaaggaacugucaagcagcuauuaaaaauauuuauacuaauucuuauguuauacugaauuauaaaauuuucaggauauaaaauugcaaacauacaccuaugaucccacugaaacauaaguuucacaagggcagaauuuuuuucucuauuugcuaccugagacagccucaagcacauaggaguacaauaaacauuuggugaauaaauauuaaaauccaucaugagagggaggaacaggcaaacauucuaaaugcuauaucgacauugucuuuuagugaugaaacuucagugggguuauuuugguuuuuauuuuuccuuguuuuuuaagauaucucugaguauacauuacuucuaugaugggaaaaaaacugauugggaaguaguuccuuuuaaaugcauuaagaauuuccuauauuuucaaaauaucuuugguaugcucuagaguagauuuaacacuuuaaauaaaggaagccaacuuagguuaucuugaguggguaggaaguggaaaaggcacaguaaggcuuuucccccuauagcuuagucaauauacgaaacuaaacuucuuuaaagaacuuuuuuuuuuuugagauggaguuuugcucuuauugcccaggcuggaaugcaauggcgcaaucucagcucaccgcaaccuccgccucccggguucaagcgauucuccugccucagccucccaaguagcugggauaacaggcaugcgucaccacacccggcuaauuuuguauuuuuaguagagaugggguuucuccauguuggucaggcuggucucgaacuccugaccucaggugaucugcccgccuuggccucccaaagugcuggauuacaggugugagccaccgugcccagcuccucaaagaacuuacaauguacuguuauuaaacacccuaacacuuggcuuuuacaaauuucugaaccacacaguaccacuguucuaaaaacaaacuacugauaauaccccaaauuauaugcgaagcagugaauggacuuucuugcaaaucucugaacaaagacuggaagugaaaaaaauaauuuagcuuuguaauauaucaaccaugacuucuaaacuucuguucagagcaaucaaauguaucaaugaucaauuuacuagauuuaguucuaacuaaauguuugcaucugugggacaaacauucuaauuuucucuuacugagaauuaaaaaaauaauauauacucaagaauucaaguguuuuuuauauauaacuucaaaauuuuaaugugggaaaugguuuuucuauaagguaaaucaggcaaaugaugccaccauacagcaacauaaccgugugugcauacguauguauacacauaauuacgcugcuguaugguggcauacauacauacauacacauacacacaccccuauacauacacacacacacauacauacacacacacacacacacaccccaauuaugauuacuguguacaaauauuuugcugcuuuuuaaucuaaaaaccucaagaucuuaaaugggaaaaugcuuuugcuaugugguaaaacaggcaaacuguacaaccauacaauauaacgauaacuauaaaaacagaguucaaacacacagaaaccagugugucauacacaguaacaaugcuuaucucuggauaaagauacugacugcaggugauuuuuuauuuccuuuuuccuccucuaauuuccuaauuuuuauaacgagaguguuuuacuaauuuuuuaaagcaucuuuuuuguguaugaauuaaggaugguuacaauaacuaagguggaaauaaaugaaguuuauaacucagauaauuuagucaaaaucaaauuaguuuguagccauaaacaaugacuaucaaaggcccuuaugcaaaaaaaaaaaguaagcuucugcaguccuuaaauuaagaggguuucucaagccuguaaucccaauacuuugggaggcugaaacaggaggauugcuugaagcuagaaguucaagaccagccuaggugacagugugcaacccagucuaaaaauaaaaaauaauuuuaaaaaauuaccauuaacagucugaagagaauggucuugccaucucaaauauauuacaacuuuauuaaaauaaagcaguuaaggcugggugcagaggcucaugccuguaaucccaacacuuugggaggccgaggcgggcagaucaccugaggucaggaguucgagaucaaccgggccaauauggugaaaccgugucucuacuaaaaauacaaaaauuagcuggacgugguggcauaccccuguaaucccagcuacucaggaggcugggucaggagaaucgcuugaacccagggggcagaauaagacccugucucaaaaacaaacaaaaaaauuuaacuauucuagaaaaacucaaugcuaauaaauagcugaacuacaguuuaucuuucauaagcaagagacagacaccaaaaaccaauuuaaccaauuucucaguaucauuaagauaugaauauggacacuaaauuaauuaacaagcuuaaggagccacaauggccagaaauuacuaaagaauauaaagcgccgggcauaguagcucacaccugucaucccagcacuuugggaggcagaggcgggcggaucacgaggucaggagauggagaccauccuggcuaacacggugaaaccccaucucuacuaaaaauacaaaaaauuagccgggcgugguggcaugcaccuguagucccagcuaaucaggaggcagaggcaggagagucgcuugaacccaggaggcagagguugcagugagcugagaucacaccacugcacuccagccugggcgagacaaagcgaagacuccgucuccaaaaaaaaagaaaauauaaagcaguaaguuuaugcauuuaacguauuccaaacauacacuagcaguuuaucugaaauaaaccaaaauauuucccaaauauuucaagauauuuauaguaaacacuucuaauauucucuuaacaacaauuaaaguucucaaagaacaaagccauaaagaaaugccauuucugauuaccggacaugcuggcaaauaacaaaagauaauauuuuaaaggaugaggauuccaauuuucuuaacaaucugguaugaaaagcaucacaaaccacuaagaguuuaaaaccccaaauuucuguguucagcaacagcaaagaauuauggccuguagaggaugcuaaugcaagaaaccacaaaaaggaagguauuaagauauuuuuuaaaaggaaguaguaaauuugcuguagcaucaacuuucacagcauuuuaauagaauagucuaaauuagcgaugguuaacagaaacauaaugugagcuaaaugaaauuuaauuuucuaguagucacauuaaaaauguaaaaagaaacagauuaauauauuuaacaaauauaucuaaacaucaucauuucaauauguaauccaauuuuuugaaaacaaaugcuuuucuuuuucauacuaaauuuucaaaauccaaaacacacaugcuuacuuauaaauauuuccuaacugcuauggucuaaaugcuuccuccccaccaaauucauguaucagaaacuuaauuccuggccgggcgcaguggcucacgccuauaaucccagcacuuugggaggccgaggcagguggaucaccugaggucaggaguuugagaccagccugaccaacauagagaaaccaugucucuacuaaaaauaaaaaauuagccagacaugguggcgcaugccuguaaucccagcuacucagggaggcugaggcaggagaaucgcuugaaccugggaggcggagguuguggugggcugagaucacgccauugcacuccagccugggcaacaagagugaaacuccgucucaaaaaaaaaaaaaagaaacuuaugcaauguaacaguguuuugggaaguggggcucugccuccaugaaugaauuaaugcagcuauaaaaaaggcuuuugagaguggguucacacucucuugcccugaagcccucugccaugugagcacguggcaagaaagaccucaacagaugccucugucuugccuggacuucuaggccuacagaacugcgaggaaauaaacuucuguucuuuauauauuauguuauaguagcgcaaaugaacuaagacacuaauucuucaccgaaaacaggcccaguagccgagcacaccuggcacccagauuuuucugaauaccuuucuacaauaaaaagaaccagggcuccaggagaaauugcugcugcaggacugggguggggaaauaauaaaaugaacugagaacaucuucuacagaaaguaaggaugucauaaaaaaaugauagggacauguuaauaacaaggaugcagaaggggcuaggcauuguggcccacaccuguaaucccagcacuuugggaggcugagacgggaagaucacuugaggucagucaggaguuugagaccagccuggccaacauggcaaaaccugucucuacuaaaaauacaaaaacuagccggucgugguggcaugcgccuguaaucccagcaauuugggaggcugaggcaugagaaucacuugaacccaggaggcggagguugcagugagcagagauggugccacugcacuccagccuggguaacagagugagaaucugucaaaaaaaaaaggaaacggaagguagcuucuagccaaaucugggacaacuguuauguuugaaaguauuucacaguaaagaguuuuuuguuuuuucuuuaaauacuacauccaggcugggcacaguggcucacgccuacaaucccagcaguuugggaggcugaggcggguggaucaugaggucaggaguuugagaccagccuggucaacauggugaaaccccaucucuacuaaaauacaaaaaauuagccgggugugguggugcgugccuguaaucccagcuacucgggaggcugaggcagaagaaucgcuugaaccugggaagcggagguugcagugagcugagauugcaccacugcacuccaguuuggugacagagcaagacuccgucucaaaaaaaaaacaaaaaaacuucauccauuacaugaagaaagggaaaaauuauauuguguaauauuuagcuaaguacugguuguugaagaaguuaacuuuacucauuaagagaauaagaauggcagauguuuaaaacauuaaugagguauucacaccaaguacacacucaguaaauacagauuugugaaagccuauaauagugguauuuauggguaauauggcaguuucacuucugcccuucuaagagggauagaauauggucaagauucuuaucacagaaaucaaacuaugcuuuagccagaggaugaucacuagcaaaauaucucuaugcuccccacuuauguccaugaaaacaaaaaaaucuguggagacauaaagaaaccgauacaagcaggccgggcaugguagcucacgccuguaaucccagcacuuugggaggccgaggcgggcagaucacuugaagucaggaguucuaggccagccuggccaacaugaugaaaucccgucucuacuaaaaauauaaaaauuagcuggucaugguugcaagcgccuguaaccccagcuacuugggagguugaggaacgauaauugccugaacccgggagauggagguugcagugagccaauauaucucucuacugcacuacagccugggccuggacagagagagacucugccucaaaaacaaacgaacaaaaaaaaccugauacaaugcaacacaaacaauuugucaccaaacuaaaaccuaaacuagccccucuauguaguagggugccuggguaggcagaacaaauauuuaaguugauaguuuaccauuuauuaauggcugguggcuuuuuuugucuagguagaaaagagcaugucuagguagaaaggagccaucuagagugguccuucucaguuacgucguugaagcaaacagaccugaauucaaagggaguagcagauuccaugugugaccugauaaaaaucugucucuaucaauuaggaagggagguaagagguguguagaaguaugcagaaaaagccaaaaacucuucugguaaacaacuacaacuccaaggccuuccauuuuaaguuuacuauuauuagaaauucccugauaaacuucaauguacuucaaugacauaaacuggcugaaaaguuucccucacccugaacccacacagaguaaggcaacuccccuugaaagacaggagaauuaaagucuaaauuuggggauuacagagggaaaggagauuugcauguguagguaaggcugaaaaccccuaucaacccggccaggcguggugggucaugccuguuaucccagcacuuugggaggccaaggaggguggaucacggggucaggaguuugagaccagcccgaccaauauggugaaaccccgucucuacuaaaaauacaaaaauuagccaggcaugguggcgcgcgccuguaaucccagcuacucagcaggcugaggcaggagaauugcuugaauccgggaggcguagguugcagugagccaagacugcaccacugcgcuccagcgugagcgacagagcaagacucugucuccaaaaaaaaaaaaaaaaaaaaaaaaaaaaaaaaaaaccuaucaacccagaaagucugccacaacaggaauauuuuaagaaaucugccauauuuugacauaagcucuuguguguccaaguauggauuaccccugguguaagagagcaugaaccuguuugaccacaaugaacuauuuuaaucuaaagaacaucuagggccgggcacgguggcucacgccuguaaucccaacacuuugggaggcccaggugggcagaccgcuugaggucaggaguucaagaucagccuggccaacauguugaaacccugucucuacuaaaaacacaaaaauuagccaggugggguggcagacaccuguaaucccagcugcuugggaggcugaggcaggagaaucacuugaaccugggaggcggaggcugcagugaacugagaucaugccacugcacuccagccugggcgacagagcaagacuccaucucaaaaauaauaauaaaauaagccgggugugguggcucacaccugucaucccagcacuuugggaggccaaggcaggcggaucaugaggucaggaguucaauaccagcccaaccaacauggugaaaccucgucucuacuaaaaaaacaaaaauuagcugggcaugguggugcgcgccuguagucccagcuacucgggaggcuaaggcagaagaaucacuugaacccaggaggcggagguugcagugagccaagaucaugccacugcacuccagccugggugacagagcgagacugucucaaaaaaaaaaagaauaaucaaagcuaaagcaguaauuggcuuggaacagacuuaugauagauaccaaagcagacaaaacaugacaguucaauguuucaacuuuuaaagaccuuuuccagcucaucuauccaucucauccuuguacccaaccuucccugaacuuauucauuuaaaauuaccagaauaaacagccuacacuuauuuuguucaugguuuuauuuuuuaauuuuuauuuacauacauauauuuuauuauggauucagggguacaugugcaaguuuguuacauggauauacugcauaauggugagguuaggguuucuaguuaccuaaccuuaucgccuuaucacccaaauagugaacauuguauccaauauguaauuuuucaacccucaccccagccuacacuuauugucucuacuuucuaaacuuccucucauccacucauuaaacccacugcaaauuuucccuucuucugaaacuguaaggucaccaaauauuuugaguaacuaugacauauuguuaaccuuuauuaauucugcauguaugugauaacauccuuuguacaguuucccaaaaaauaacuauuuuuucuuuauuaauagaguauacauauuuaaauguguaacuucaguucuaaaaacaacacucuauauacuuuaaaaggaugaacuuuaugguuaaaguugaacuuuuuggauaaaguuauuauuuuuauuuuuaaaauuuuuuggagacccagaucuugcuacauugcccagccuagucuuaaacuccuggccucaagcaaugcucucaccucggccucccagaagugcugagauuagaaguaugagccaccaugcacaguccucauaucguuauauuuuuuaaaagcacaacuugacccaagaucuggauauagcacauuccaaaagaauuuucugcaaugauuaaaaaaaaauuguuuuugagacagggucauagcucugucaccuaggcugaagugcaaguggcaugaucaagccucacugcagcccugaccuccccagcucaagcaauccacccaguucagucucuuaaaguagcugggguuacagaugcacaccaccaggcccagcuaauuuuuuaauuuuuuguagacagggucuugcuauguugcccaggcuggucuugaacuccugggcccaagcaauccuccugccucagccuuccaaaguauugagauuacagguauaagccaccaugcccagccugaaaauguucuuuaucugugcaauccaauaucguagccacauguugucacugagcacuugaaauguggcuaguacaagacaaugaaguucuaaaaauuucauuuuaauuuauuuaaauuuaaauagccacauaaaggcuggacgcaguggcucacaccuguacucccagcacuuuggaagacugagauggguggaucaccugaggaguuccagaccagccuggccaacauggcaaaacccugucucuacuaaaaauacaaaauuagcugggugugguggcacgugccuguaaucccagcuacucaggaggcugaggcagaauugcuugaaccuggcaggcagagguuacagugagccaagaucacgccacugcacuccagccuggguggcaagagcgaaauagccacgugaggcugguggauauuguauuagauagugaacagugcagaaaucuagggcauuaccagugacuuacauguauuuaugugcuucucucuuauucaaccucccccuuacugaggcaaccuuaaauuuaauuguuacugacuuuuuuuuuaauuucuuuuugucagggcuguuucucagugggaauguuaaugauuuuucuuucuuuuuuuuuuuuuuuuuuuugagacggaguuucgcucguugcccaggcuggagugcaaugcugugaucucggcucaccacaaccuccaccuccccgguucaagcgauucuucugccucagccugccgaguaguugggaauauaggcaugugccaccaggcccagcuaauuuuuguauuuuuaguagagacgggguuucuccauguuggucaggcuggucucuaacuccugaccucaggugauccgcccacuucagccucccaaagugcugggauuacaggcgugagccaccgugcuguguuaaugauuuguuaauagccaagugcaacaauuucaacagccuaacuacuacauuucuuuacuacuuguuaaauucauucuccacaauuacuacuaugaaaauagaacuucucugauguauuauuuucuugaaauuuuauucccuugguaauuguuacuauuuugccugaggaccauuacucuucccucucccucucucuaauuuuucuaucucuucauauccucucccuagcguaucucauuuacuuccauuauuucagcuacaacuaauauagacauuuuugggaaucaucagcuuuuaucuucaucucagaccuagucuucaaguuuuaguaauauauccaacugccuauugaacuucuuacuggagauuacauaagaaucucaaacucaacauguccaauugaauacaucuccauaccuccucccaucuaaaaaacaaaaaaccuuaaaacuuaaaaaaaaccuuugauuuuucucucucaguugacagcacuaucauccccuaaccucuuauccaugcuucauuuuuccuccaaacaccaauuaaucacuaaauuauccacuaaacccuaaauauuuuaucuccuaaauaucuaaauguucuauuccuucuauuaucucccuaguuuagguccuaaaaaucucacacucauauccuaacuagaguagcccucccuuacuugaggcuucacuucccacuguccaaaaauauuaaauggaaaauuccagaaauaaacaauucauaacuuuuucuuuuuuuuuugagacagaguuucccucuugucgcccaggcuggagugcaauggcgcaaucuuggcucacugcaaccuccaccucccggguucaagugauucuccugccucaaccucccaaguagcugggauuacaggcaugcaccaccacacccggcuaguuuuuuuuuuguauuuuuaguagagacaggguuucaccauguugacuaggcuggucuccaacuucugaccucagguuauccacuaaccucggccucccaaaguguugggauuacaagcgugagccaccacgccuagccaacaauucacgacuuuuaaauugugugccauucugacuagugugaugaaaucucgaaugggacaugucaucccuuuguucagcauauucacacuguuaaugccacccacccaucucguccuuuagucacuuagucuaauggguuaugggauggaaaaagcaaaguaugcauaggguucaguagugucuguagcuucagguauccacgggaggucuugcaaaccucaaaguaaacagaaccaaaagauaaaaauacggaccaggagugguggcucacaccuguaauuccagcacuuugggaggccgaggcuggcggaucgccugaggucgggaguuggagaccagccugaccaacauggagaaaccccaccucuacuaaaaauacaaaauuagcugggcaugguggcgccuuccuguaaucccagcuacucgggaggcugaggcaggagaaucccuugaacucaggaggcaaauguuguggugagccgagaucgcgccauugcacuccagcugggcaacaagagugaaacucugucucaaaaaaaaaaugaaaagcaggagaaaaaaauaaccauuauccccuaagaagaagaguggggacuacuggaaucucuacacuucccccuguaugccuuuaaucuauuuuugggcaauuacugcuaugcaaaucuaaccaauuaacuucucuguuuaaaacucaacucuucaguuacucucuacuuucuacacauaagaacaguccgcccuccacauccucagguuccauauccacauguucugcauccauggauucaacuaacugcagaugaaaauauugggggaaaaaacaauaacaaaacacaauaauaaaaaacaacaugaauuuuaaaacacuacaguauaaaaacuauuuacauagcacuuacauuguauuagguauuauaaguaauuuagugaugacuuaaacuauacgugaggagccacaccuguaaucccagcguuuugggaggcagaggcagauggaucacuugaggucaggaguucgagaccagccuggccaacgugaugaaaccccaucucuacuaaaaauacaaaaauuaguugggcaugguagcaugugccuguaaucccagcuacucgggaggcugaggcaugacaaucgcuugaacccaggaggcagagguagcagugagcugagauugugccacuguacuccagccugggcaacagagcaagacucagccucaaaaaaaaaaaaaaauuaaauuaaaaaauaaacuauacaggaggauguacuacuguagguuauaugaaaauacaccauuuuauuuaagagacuugugcauuugugaauuuugguacccuggggugggggcugucuggaaccaaucuccuguguauacugacggaugacugugugugagaggggcaauauggagaguucaaagaacauuuuaauaugacaaugauaucuaguaacucuuuagcauguuaaagagauaaaucuguugcauuucccgauuuaccuuaauccacaauaaucuaccaguccauggaaggagaugauccacauaaagauagauauaucagguuauguagcucaaaacucuuagccaugaaaaugaucuuaucccaagaaaucuguuaaucucuaucuaguaacagagaaugugcacauuaaucauuugauucacuaauuaauuucaucucucacuguuugguuuauacauuaguguguguuugguuaacuagaccaucuaccacguaucuacugacaaaaauaauauugucucugagaagcugaaccucagcugcacaaaagguaucugcaggaaugacugugguuuuucuuaacuaaccugaguaugaugauuacaacaagcaaauuuccaaacacucuuaaauucaaacuguuaaaauucuuaagaauucuuacauuccugagaaaauuauuugcuuguuaugacuaacagcuuaucugaggacucuucuaaaaaaucauuccaacauauucauuuagcauaauguauuuaauaugguaauuuggcaaagccaagauucaagucacaacacuaaaaaguaaauuauuuaugaaaccccaccugaaaaaucuaaauuaauguaagugaagguggagauauuauaugaucaauuaaguuggccacaaaaccacagcuuacugaugcuuuuccucuuauguaaaaaucacaaauaaccaaucuuuuaaaaacuacauauagaccaggaacggcggcucaugccuguaaucccagcacuuuaagaggccaaggcagguggaucaccugaggucaggaguuugagaccagccuguccaacacggugaaacucugucucuauuaaaaauacaaaaaaaaaaaaaaaauuagccgggugugguugugggugccuguaaucccagcuacucuggaggcugaggcaggagaaucgcuugaacacaggagguggagguuucagugagccaagaucccaagaucacgccacugcacuccagccugggcgacagagcaagaccccaucaaaaacaacaacaauaaaaaaaaaacuacauauaaaauuaagccugcuaccugucaaaggcauaaucaucuuccaaauaaaauauuaagagcuucugacaauguuucuucaaacugaaaagcuccccuguuaagauuugagaaauuaaguugacaaagcaaaaagcuccuaaaauccaacuaaguuuaauauauuccauuuguaauaggugacaauuuauagccuucuaaaugaauauuuaaguauucuguuauauuuuauauaacacuuaacauuuuucaaaguacauucacauaguauuucaguggaucuucaacaauccuaaaucaguaagacauauugcuaauaaaugagcauuauagauuaaguuccuuacucaaagcucagaaaauuggguaaucuagaacucaaggguucugccuuggugcuccuuuucauuguauaguauucuauuacaccauagugaacuuuccaaagacuaauggauuagacaaaauauauaaacaauuucaauaugauaaauaaauacuauaagaauuauauaugagauccaccaaaagaaaauaugcuuucuagauacaugcaaagaugagacaaggaucuuagcagauucugaaaauaagcaguucagaaagauuggcauuugggugaugggucacaaaauuaaaauguuaggcaaaggccagguagagcuaaggaauuuaaaagcaccaguaacauaaagaucaauaccugcuuuccuccuccuccaagaacaguaguuaaguuuugcuauaugauuuuucaagcauaaauauaaacaaacaaaaucuucacagauucccucaaaaggacaaccuaaaaaagaugcugcaucaucacaguuaauauuuauguggcaggcccuauccuacauguuuuauauauguucauucauuuaaucagcacaacucuauaaaauggguacucuuuuuuacacccauuuuacagacaggaaacuguagcacaaaacuugcucaaggugacacaauuauguagcugagccuugauuugagcccaggcaaucuaguucuuaacuacuauguuacaaggcagaaaaauggccucuucaaacauaaacugaggucaugcuaagucucaccuauuccugcagaccagguuuuaaaacaaaacaaaacggcugagcaugguggcucaagccuguaaucccaggacuuugggaggccaaggcgggcagaucacgaggucagguguucaagaccagccuggccaacauggugaaaccccaucucuacuaaaaauacaaaaauuagccgggcgugguggcgcucgccuguaaucccagcuacucagggggcugaggcaggagcauugcuggaacccgggagguggagguugcagugagccgagaucgcgccacuguacuccagccugggcgacagagugagacucugucucaaaaacaaaaaaacaaaaaacucaaacaaaaugcaaguuacuaaauauauaauuuaaauuaucaauauaauuuaaagaacugguauagcaaagguguacuaacgguaauuaugaauuauuucauaguaugcuaaauauuuucagaaaugauaauugaguacagcuacucuugcugcuuuuacagcuuuaucuaaaaaaauguaaaaacuaccagaaaacccaaauaacagguuuaggaugauuucugaaaaugagagcccaguuuuaguugaauguuuccauagggaugaacuaagaugaauuuuauuuauauuuauauacauauauuuuuuauuuuuugaaauucuuugauaagcugcugguggaauaagauaaauuuuaaaugacuaggcucuugcaucagaauuugaaugucaagaaaugaauugucacaaagcaacaauagauuccugguuuguuuuacacaaaaacaaccucuuuccagguuuuuagauuacuucucagacuguguuacuacgggucagaaaaaagguaagagaaaaaaauuugccaauacuccuaaucggugacuuugaggauuuaagaacaaacuccaaaaacuauucccugagacggaaaguuacgcugauucucauccuaaaaaauaaggaauguggcacaaauuuaaaagauaagagggaaaaaaucaccaacauucaaauagagagauucaguucaauuagauauuuuaagaacuauagcagaccauccuggcuaacaaggugaaaccccgucucuacuaaaaauacaaaaaauuagccgggcacgguggcgggcgccuguagucccagcuacucgggaggcugaggcaggagaauggcgugaacccaggaaguggagcuugcagugagccgagauugcgccacugcaguccgcaguccggccugggcgacagagcgagacuccgucucaaaaaaaaaaaaaaaaaaaaaaaaagaacuauagcaaagaaauaaaugaugguuucuuaaucacagaaccacaucccauuucuguaacacugcuauacuauucacaaaauauuaaugucauguacucaugacacacagucuuaauaaaagacagagaaaaauaagcaguuaaguauauuggagcuucaacaaaaauaugauuuaaccucucuuuucagguagauguggaaacaaucucaucaacauauaacgcaucaugugaacucuucagaggcaacuugggaaggugcuuaaaauaaaucauucuuaaaucugugcaucaauguuuucuuuuucuuucuuucuuuuuuuuuuuuuuuuuuuagagacagagucucacccugucacccaggcuggagugcaguggugcgaucucgacucacugcaaccucugccucccggguucaaacaauucuccugccucagccucucgaguagcugggauuacaggcgugcggaccacgcccagcuaauuuuuguauuuuuaguagagaugggguuucgccauguuggccaggcuguucucgaacuccugaccgcgugauccacccgccucggccucccaaagugcugggauuacaggcgugagccaccgcacccggcuccaucaauguuuucuuaaaggaaauuaugcuaucuuuuuugaaaaaccagaucccuuucuagaaaagcaauguaaacucugcagauagagcccaacaguaauauuuucugaccaagacaaccaaauauuaaaauuaaggugcacuacuugucuaauaaaaccaguuaaagaaaucugcaucuuaaacaucucgguaauuacugaagguccugugguaucaaaauauuaccuaggcauuauuuacuaagaauugaugcuuguaauuagcugggugugguggggugcgccuguacucccagcuacuugggaggcugaggcaggagaaucgcuugaacccaggaggcggagguugcagugagcucagauugcgccacugcacucuagccuggagauagagcaagacuccgucucuuuuuuuuuuuaaaaaaaaaaaaaaaaaaaaaaaagaauugaugcuuguuuuacuaaagagcaaugcauagcaugacucuaaaaaaauuagcaugacagaaaauagcuugauuuguauaccauauugacccauccacaaaagccuauuuauaucucaauuugaagugauaaaaaucaacacccaaaacagaagccugaaauuugccauggguauaaggaccggguuucuccagaaauccaacagccacuuccacaccaacacaauauugcuucauuugaaaugacuuauuagccaucuacuggacuacaaaugcuuugucaucucccaaauuauuagauccuaacuagcuuuuguucuucaucuaccuaaucaaguuauuuaccugcucuaugauuucagguuccuuauuugucaaauaaauagcugggcagaauaaccuaagauuucucccaguuucaauacacuaagauuuuuaacucaacaacuuaacucaauauucuccugucuugcuucagaaauauauguauauuaaaaggauagauuuagcgaaaaaguuucuaucuuuccagugcuuuaguaaucccuuggcuuguccuuuaauuuggcuccaaagauaaaaguucaaacacugacccacugaauauuuuauuaggcauguagugcaaguguccuggucaaaaaaccaaaaauacugccuaacuacugcuauaaaggauuuuucagguaagauaaucuuuucaaaaucaaaacaaaaaauuacagaagcacagacaaauaacauggaaguuucuaaaccagguaccacuuaauaagcuaggauucaucuaguucugcagccaaauccugaaaugacucaaaaauaauaugcgauguaagauuuucuuuaguuugguaaugcccaugccuagauagagaauuaaaaauccaaaaaguuacgaguucuaagaaaaccugagaagcuuggacaaaguuuuuaucgugacauuagacaaauuaaguuuuuuucacuguauuaucaguuccaagauaauaaaguaucagaaaauuccaggugauaaaaggaaaacacacaucacaugcuaagaagucucagaagugaaauaauuaaaacuaacaaaauuaauucauaaagugcucaacaaguaauuggguccagucuuaaaaaaguaagguaaccgguuaaggaaaacaaaauuguuaaaaagcaccuauucaaauauaaaacuauaauggaagaauaaaauuccagcaucaguaucaauaagcaucgauaguacaagaaagaaaugugucuaccuguaaauuucugccuguaaaccaaaaggaaucggacauaaguuuuuuuguuguuguuguuuuuguuuguuuuugagacggagucucgcucugucaccacgcugcagugcgauggugcgaucuccgcucacugcaaccuccaccugcuggguucaagauauucuccugccucagccucccgaguaguuggaauuacaggcgcgcgccaccauacccggcuaauuuuuguauuuuuaguagagucgggguuuccccauguuggucaggcuggucucgaacuccuaaccccgugauccacccgccuuggccucccaaagugcugggauuacaggcgugagccaccgugccuggcccagacuaaguuuuuugaauaugacugaccaaaaugaacaguuuucguuugacgagguuuuuuuuuuuuaaagaucugucaccuuuucaauucuaaaauacuauaaaauuaaugaguaguuuuaauuucacacuaccuuagaaguucuacaucauuaacuguaaaaguuaagaaaugauuauguuuguaaagaacuucuuaguuuuuaaguuuacuuccacaugcuguguuaauuucacauuugauauggccuuaguuauuuggaaccugacauucaaaggguuacguguuaacauauuaguucauggauaaaauaaguuccaagaucauucaguuauuuucauauccuguaucaggcuggucuauauucuuggcaagauuacuauaucaauaauggcaauuuuuaugcaugcauaauguggcugacuuccuucagcauaaaccugcuccuacuaauaaccuauguucaccuaugcccaaucagggcaauauuuaagcaagcugcuucaguaagucaagcaacaaguagcccaaacucagcuguuuaaaccuagaauguacuagucaaccggaaugacacaccauuauuuacaccacuagagguuaaaaaaggaagugcugcgacuccuucggacucuugggaaaguucagcuuaaagauauuuuauaagauuaaaacaaugaugaugacauuacgacucucaaagcacuuacacaauuuugcaugggcuccuauacuauucgcuguauagugaaugggcugaaagacauuaguuuaaugaacgucagagcaaugcugcuacuguaaggcuuaagcaucauuagguagaacaacaucaaacauccaaaaggggcagagaagagucuuuuuuuaauaauuauuuuauacuaaaugccugugcaaccaucaagcaaaauacauccaaagguacaagguuguucucauuuaaaaagaacagccugaucucaggaaugaaaacacgcuucuacacccagacgcagcucaucacugcagagccuuugaugagauugaaaugcacagaagaagaagcaucuguacuuucaacuuccccacucauuccaaguuuccugccagacucuaaaccaggagacaauucguuuguacuaagaugaccuucaccaccgcugcccgguagcaaaucccucuggcuaccaauaauucuuauccuaucccaacaccuaggcacaugcuccacauucuccuaauuucagccccuuucaaaaguuggccuccccgucccacucggaguccaacagagaaugccaagugaagggugaacucgaucaacuggcuucgccgagccaaauuugggauccaaaggaccgucaaauaaaguagguggggcuuuaccugcaguucacaccaggcgacuuccacggugguuucaguguccagaccuuuguagaccgucuuaaaggagccucugccgauuucgaugucaaacuugagaaagcggccaucguuagacauucccacggccuuggucuccagcucuucgauaucauccugcugcuggcuccguuccuccuguggcuccuuggcgcugccgccgccgcugccacuucucgccggcggcggcuccucuuugcuccccacaaggcuaggcugggacacugggcggucuuugcugguacugcuggggacagucgagggggcagggcccgcgacggccuguuccccaggggcggcagcggcuggaggcugcugggcuaccugggaaguggcgguggcggucacggucucuucccgguggggcuccgguggagcacucugcgggacagccgcggggaugcugggcuggggcagggaaagaggaaggccgggaagcuccagugcaguggcauuggagucacagaugacgcuccggcggaagaagcggugcucaguggugguaguggucgcggccgccccacggcuguccuuguccauaguguggcggcggcgccuguacuccucgguccugccggucacagcgucggcggccgcggcucccaguuucucccccacggaggaaucggagcuggagccauucuugggggcaggagccggcggcgagaggaacagggaaccgggagugcugcucugcuucucugcggcgccgccagacauggucgguucgcuggagagaggcgagcgggcucggauucgugaacgaaaagggcgugaagggccgagccgcccgcgcagaggucugcagggaaccgcggccgggcggguucgcgccgacccggacgacgccucacucagcaccgacaagccgcaacgagggacaggcggaccgcugggcccagcugcggcgggggcuggcaccgaggcugcugcggcucacgaggagggcucgaaggcgggcgauucgggagcugagccacggggguuagcgccgcacgguccgcauccauccugcggcgagcggcggccgggcgggcgguggcagcagaggcgccgcagucaugaggggagggccaggggccggcaccgagucgaggcggaugcggcggacgcggcucccacugccgccgcucgccgagcugggcgggcuaggcccagagggcggcggcaccgcgagcacgggaccagguccgacgcccgggcgguggcggccccggggcagaggagugggaggggccgaggcgggcgagggaaggccgcggcccggcucccggucacucgggcggccgccuccucccacacgcgcccccagcgauggggaccggccucacaggucgcccaucgcccagaggcgaagggccgg

SEQ ID NO: 191684 - RNA, 158530 nt, Homo sapiens
ccggcccuucgccucugggcgaugggcgaccugugaggccgguccccaucgcugggggcgcgugugggaggaggcggccgcccgagugaccgggagccgggccgcggccuucccucgcccgccucggccccucccacuccucugccccggggccgccaccgcccgggcgucggaccuggucccgugcucgcggugccgccgcccucugggccuagcccgcccagcucggcgagcggcggcagugggagccgcguccgccgcauccgccucgacucggugccggccccuggcccuccccucaugacugcggcgccucugcugccaccgcccgcccggccgccgcucgccgcaggauggaugcggaccgugcggcgcuaacccccguggcucagcucccgaaucgcccgccuucgagcccuccucgugagccgcagcagccucggugccagcccccgccgcagcugggcccagcgguccgccugucccucguugcggcuugucggugcugagugaggcgucguccgggucggcgcgaacccgcccggccgcgguucccugcagaccucugcgcgggcggcucggcccuucacgcccuuuucguucacgaauccgagcccgcucgccucucuccagcgaaccgaccaugucuggcggcgccgcagagaagcagagcagcacucccgguucccuguuccucucgccgccggcuccugcccccaagaauggcuccagcuccgauuccuccgugggggagaaacugggagccgcggccgccgacgcugugaccggcaggaccgaggaguacaggcgccgccgccacacuauggacaaggacagccguggggcggccgcgaccacuaccaccacugagcaccgcuucuuccgccggagcgucaucugugacuccaaugccacugcacuggagcuucccggccuuccucuuucccugccccagcccagcauccccgcggcugucccgcagagugcuccaccggagccccaccgggaagagaccgugaccgccaccgccacuucccagguagcccagcagccuccagccgcugccgccccuggggaacaggccgucgcgggcccugcccccucgacuguccccagcaguaccagcaaagaccgcccagugucccagccuagccuuguggggagcaaagaggagccgccgccggcgagaaguggcagcggcggcggcagcgccaaggagccacaggaggaacggagccagcagcaggaugauaucgaagagcuggagaccaaggccgugggaaugucuaacgauggccgcuuucucaaguuugacaucgaaaucggcagaggcuccuuuaagacggucuacaaaggucuggacacugaaaccaccguggaagucgccuggugugaacugcagguaaagccccaccuacuuuauuugacgguccuuuggaucccaaauuuggcucggcgaagccaguugaucgaguucacccuucacuuggcauucucuguuggacuccgagugggacggggaggccaacuuuugaaaggggcugaaauuaggagaauguggagcaugugccuagguguugggauaggauaagaauuauugguagccagagggauuugcuaccgggcagcgguggugaaggucaucuuaguacaaacgaauugucuccugguuuagagucuggcaggaaacuuggaaugaguggggaaguugaaaguacagaugcuucuucuucugugcauuucaaucucaucaaaggcucugcagugaugagcugcgucuggguguagaagcguguuuucauuccugagaucaggcuguucuuuuuaaaugagaacaaccuuguaccuuuggauguauuuugcuugaugguugcacaggcauuuaguauaaaauaauuauuaaaaaaagacucuucucugccccuuuuggauguuugauguuguucuaccuaaugaugcuuaagccuuacaguagcagcauugcucugacguucauuaaacuaaugucuuucagcccauucacuauacagcgaauaguauaggagcccaugcaaaauuguguaagugcuuugagagucguaaugucaucaucauuguuuuaaucuuauaaaauaucuuuaagcugaacuuucccaagaguccgaaggagucgcagcacuuccuuuuuuaaccucuagugguguaaauaauggugugucauuccgguugacuaguacauucuagguuuaaacagcugaguuugggcuacuuguugcuugacuuacugaagcagcuugcuuaaauauugcccugauugggcauaggugaacauagguuauuaguaggagcagguuuaugcugaaggaagucagccacauuaugcaugcauaaaaauugccauuauugauauaguaaucuugccaagaauauagaccagccugauacaggauaugaaaauaacugaaugaucuuggaacuuauuuuauccaugaacuaauauguuaacacguaacccuuugaaugucagguuccaaauaacuaaggccauaucaaaugugaaauuaacacagcauguggaaguaaacuuaaaaacuaagaaguucuuuacaaacauaaucauuucuuaacuuuuacaguuaaugauguagaacuucuaagguagugugaaauuaaaacuacucauuaauuuuauaguauuuuagaauugaaaaggugacagaucuuuaaaaaaaaaaaaccucgucaaacgaaaacuguucauuuuggucagucauauucaaaaaacuuagucugggccaggcacgguggcucacgccuguaaucccagcacuuugggaggccaaggcggguggaucacgggguuaggaguucgagaccagccugaccaacauggggaaaccccgacucuacuaaaaauacaaaaauuagccggguaugguggcgcgcgccuguaauuccaacuacucgggaggcugaggcaggagaauaucuugaacccagcagguggagguugcagugagcggagaucgcaccaucgcacugcagcguggugacagagcgagacuccgucucaaaaacaaacaaaaacaacaacaacaaaaaaacuuauguccgauuccuuuugguuuacaggcagaaauuuacagguagacacauuucuuucuuguacuaucgaugcuuauugauacugaugcuggaauuuuauucuuccauuauaguuuuauauuugaauaggugcuuuuuaacaauuuuguuuuccuuaaccgguuaccuuacuuuuuuaagacuggacccaauuacuuguugagcacuuuaugaauuaauuuuguuaguuuuaauuauuucacuucugagacuucuuagcaugugauguguguuuuccuuuuaucaccuggaauuuucugauacuuuauuaucuuggaacugauaauacagugaaaaaaacuuaauuugucuaaugucacgauaaaaacuuuguccaagcuucucagguuuucuuagaacucguaacuuuuuggauuuuuaauucucuaucuaggcaugggcauuaccaaacuaaagaaaaucuuacaucgcauauuauuuuugagucauuucaggauuuggcugcagaacuagaugaauccuagcuuauuaagugguaccugguuuagaaacuuccauguuauuugucugugcuucuguaauuuuuuguuuugauuuugaaaagauuaucuuaccugaaaaauccuuuauagcaguaguuaggcaguauuuuugguuuuuugaccaggacacuugcacuacaugccuaauaaaauauucagugggucaguguuugaacuuuuaucuuuggagccaaauuaaaggacaagccaagggauuacuaaagcacuggaaagauagaaacuuuuucgcuaaaucuauccuuuuaauauacauauauuucugaagcaagacaggagaauauugaguuaaguuguugaguuaaaaaucuuaguguauugaaacugggagaaaucuuagguuauucugcccagcuauuuauuugacaaauaaggaaccugaaaucauagagcagguaaauaacuugauuagguagaugaagaacaaaagcuaguuaggaucuaauaauuugggagaugacaaagcauuuguaguccaguagauggcuaauaagucauuucaaaugaagcaauauuguguugguguggaaguggcuguuggauuucuggagaaacccgguccuuauacccauggcaaauuucaggcuucuguuuuggguguugauuuuuaucacuucaaauugagauauaaauaggcuuuuguggaugggucaauaugguauacaaaucaagcuauuuucugucaugcuaauuuuuuuagagucaugcuaugcauugcucuuuaguaaaacaagcaucaauucuuuuuuuuuuuuuuuuuuuuuuuuaaaaaaaaaaagagacggagucuugcucuaucuccaggcuagagugcaguggcgcaaucugagcucacugcaaccuccgccuccuggguucaagcgauucuccugccucagccucccaaguagcugggaguacaggcgcaccccaccacacccagcuaauuacaagcaucaauucuuaguaaauaaugccuagguaauauuuugauaccacaggaccuucaguaauuaccgagauguuuaagaugcagauuucuuuaacugguuuuauuagacaaguagugcaccuuaauuuuaauauuugguugucuuggucagaaaauauuacuguugggcucuaucugcagaguuuacauugcuuuucuagaaagggaucugguuuuucaaaaaagauagcauaauuuccuuuaagaaaacauugauggagccgggugcgguggcucacgccuguaaucccagcacuuugggaggccgaggcggguggaucacgcggucaggaguucgagaacagccuggccaacauggcgaaaccccaucucuacuaaaaauacaaaaauuagcugggcgugguccgcacgccuguaaucccagcuacucgagaggcugaggcaggagaauuguuugaacccgggaggcagagguugcagugagucgagaucgcaccacugcacuccagccugggugacagggugagacucugucucuaaaaaaaaaaaaaaaaaaagaaagaaagaaaaagaaaacauugaugcacagauuuaagaaugauuuauuuuaagcaccuucccaaguugccucugaagaguucacaugaugcguuauauguugaugagauuguuuccacaucuaccugaaaagagagguuaaaucauauuuuuguugaagcuccaauauacuuaacugcuuauuuuucucugucuuuuauuaagacugugugucaugaguacaugacauuaauauuuugugaauaguauagcaguguuacagaaaugggaugugguucugugauuaagaaaccaucauuuauuucuuugcuauaguucuuuuuuuuuuuuuuuuuuuuuuuuugagacggagucucgcucugucgcccaggccggacugcggacugcaguggcgcaaucucggcucacugcaagcuccacuuccuggguucacgccauucuccugccucagccucccgaguagcugggacuacaggcgcccgccaccgugcccggcuaauuuuuuguauuuuuaguagagacgggguuucaccuuguuagccaggauggucugcuauaguucuuaaaauaucuaauugaacugaaucucucuauuugaauguuggugauuuuuucccucuuaucuuuuaaauuugugccacauuccuuauuuuuuaggaugagaaucagcguaacuuuccgucucagggaauaguuuuuggaguuuguucuuaaauccucaaagucaccgauuaggaguauuggcaaauuuuuuucucuuaccuuuuuucugacccguaguaacacagucugagaaguaaucuaaaaaccuggaaagagguuguuuuuguguaaaacaaaccaggaaucuauuguugcuuugugacaauucauuucuugacauucaaauucugaugcaagagccuagucauuuaaaauuuaucuuauuccaccagcagcuuaucaaagaauuucaaaaaauaaaaaauauauguauauaaauauaaauaaaauucaucuuaguucaucccuauggaaacauucaacuaaaacugggcucucauuuucagaaaucauccuaaaccuguuauuuggguuuucugguaguuuuuacauuuuuuuagauaaagcuguaaaagcagcaagaguagcuguacucaauuaucauuucugaaaauauuuagcauacuaugaaauaauucauaauuaccguuaguacaccuuugcuauaccaguucuuuaaauuauauugauaauuuaaauuauauauuuaguaacuugcauuuuguuugaguuuuuuguuuuuuuguuuuugagacagagucucacucugucgcccaggcuggaguacaguggcgcgaucucggcucacugcaaccuccaccucccggguuccagcaaugcuccugccucagcccccugaguagcugggauuacaggcgagcgccaccacgcccggcuaauuuuuguauuuuuaguagagaugggguuucaccauguuggccaggcuggucuugaacaccugaccucgugaucugcccgccuuggccucccaaaguccugggauuacaggcuugagccaccaugcucagccguuuuguuuuguuuuaaaaccuggucugcaggaauaggugagacuuagcaugaccucaguuuauguuugaagaggccauuuuucugccuuguaacauaguaguuaagaacuagauugccugggcucaaaucaaggcucagcuacauaauugugucaccuugagcaaguuuugugcuacaguuuccugucuguaaaauggguguaaaaaagaguacccauuuuauagaguugugcugauuaaaugaaugaacauauauaaaacauguaggauagggccugccacauaaauauuaacugugaugaugcagcaucuuuuuuagguuguccuuuugagggaaucugugaagauuuuguuuguuuauauuuaugcuugaaaaaucauauagcaaaacuuaacuacuguucuuggaggaggaggaaagcagguauugaucuuuauguuacuggugcuuuuaaauuccuuagcucuaccuggccuuugccuaacauuuuaauuuugugacccaucacccaaaugccaaucuuucugaacugcuuauuuucagaaucugcuaagauccuugucucaucuuugcauguaucuagaaagcauauuuucuuuugguggaucucauauauaauucuuauaguauuuauuuaucauauugaaauuguuuauauauuuugucuaauccauuagucuuuggaaaguucacuaugguguaauagaauacuauacaaugaaaaggagcaccaaggcagaacccuugaguucuagauuacccaauuuucugagcuuugaguaaggaacuuaaucuauaaugcucauuuauuagcaauaugucuuacugauuuaggauuguugaagauccacugaaauacuaugugaauguacuuugaaaaauguuaaguguuauauaaaauauaacagaauacuuaaauauucauuuagaaggcuauaaauugucaccuauuacaaauggaauauauuaaacuuaguuggauuuuaggagcuuuuugcuuugucaacuuaauuucucaaaucuuaacaggggagcuuuucaguuugaagaaacauugucagaagcucuuaauauuuuauuuggaagaugauuaugccuuugacagguagcaggcuuaauuuuauauguaguuuuuuuuuuauuguuguuguuuuugauggggucuugcucugucgcccaggcuggagugcaguggcgugaucuugggaucuuggcucacugaaaccuccaccuccuguguucaagcgauucuccugccucagccuccagaguagcugggauuacaggcacccacaaccacacccggcuaauuuuuuuuuuuuuuuuguauuuuuaauagagacagaguuucaccguguuggacaggcuggucucaaacuccugaccucaggugauccaccugccuuggccucuuaaagugcugggauuacaggcaugagccgccguuccuggucuauauguaguuuuuaaaagauugguuauuugugauuuuuacauaagaggaaaagcaucaguaagcugugguuuuguggccaacuuaauugaucauauaauaucuccaccuucacuuacauuaauuuagauuuuucaggugggguuucauaaauaauuuacuuuuuaguguugugacuugaaucuuggcuuugccaaauuaccauauuaaauacauuaugcuaaaugaauauguuggaaugauuuuuuagaagaguccucagauaagcuguuagucauaacaagcaaauaauuuucucaggaauguaagaauucuuaagaauuuuaacaguuugaauuuaagaguguuuggaaauuugcuuguuguaaucaucauacucagguuaguuaagaaaaaccacagucauuccugcagauaccuuuugugcagcugagguucagcuucucagagacaauauuauuuuugucaguagauacgugguagauggucuaguuaaccaaacacacacuaauguauaaaccaaacagugagagaugaaauuaauuagugaaucaaaugauuaaugugcacauucucuguuacuagauagagauuaacagauuucuugggauaagaucauuuucauggcuaagaguuuugagcuacauaaccugauauaucuaucuuuauguggaucaucuccuuccauggacugguagauuauuguggauuaagguaaaucgggaaaugcaacagauuuaucucuuuaacaugcuaaagaguuacuagauaucauugucauauuaaaauguucuuugaacucuccauauugccccucucacacacagucauccgucaguauacacaggagauugguuccagacagcccccaccccaggguaccaaaauucacaaaugcacaagucucuuaaauaaaaugguguauuuucauauaaccuacaguaguacauccuccuguauaguuuauuuuuuaauuuaauuuuuuuuuuuuuuugaggcugagucuugcucuguugcccaggcuggaguacaguggcacaaucucagcucacugcuaccucugccuccuggguucaagcgauugucaugccucagccucccgaguagcugggauuacaggcacaugcuaccaugcccaacuaauuuuuguauuuuuaguagagaugggguuucaucacguuggccaggcuggucucgaacuccugaccucaagugauccaucugccucugccucccaaaacgcugggauuacagguguggcuccucacguauaguuuaagucaucacuaaauuacuuauaauaccuaauacaauguaagugcuauguaaauaguuuuuauacuguaguguuuuaaaauucauguuguuuuuuauuauuguguuuuguuauuguuuuuucccccaauauuuucaucugcaguuaguugaauccauggaugcagaacauguggauauggaaccugaggauguggagggcggacuguucuuauguguagaaaguagagaguaacugaagaguugaguuuuaaacagagaaguuaauugguuagauuugcauagcaguaauugcccaaaaauagauuaaaggcauacagggggaaguguagagauuccaguaguccccacucuucuucuuaggggauaaugguuauuuuuuucuccugcuuuucauuuuuuuuuugagacagaguuucacucuuguugcccagcuggagugcaauggcgcgaucucggcucaccacaacauuugccuccugaguucaagggauucuccugccucagccucccgaguagcugggauuacaggaaggcgccaccaugcccagcuaauuuuguauuuuuaguagaggugggguuucuccauguuggucaggcuggucuccaacucccgaccucaggcgauccgccagccucggccucccaaagugcuggaauuacaggugugagccaccacuccugguccguauuuuuaucuuuugguucuguuuacuuugagguuugcaagaccucccguggauaccugaagcuacagacacuacugaacccuaugcauacuuugcuuuuuccaucccauaacccauuagacuaagugacuaaaggacgagauggguggguggcauuaacagugugaauaugcugaacaaagggaugacaugucccauucgagauuucaucacacuagucagaauggcacacaauuuaaaagucgugaauuguuggcuaggcgugguggcucacgcuuguaaucccaacacuuugggaggccgagguuaguggauaaccugaggucagaaguuggagaccagccuagucaacauggugaaacccugucucuacuaaaaauacaaaaaaaaaacuagccgggugugguggugcaugccuguaaucccagcuacuugggagguugaggcaggagaaucacuugaacccgggagguggagguugcagugagccaagauugcgccauugcacuccagccugggcgacaagagggaaacucugucucaaaaaaaaaagaaaaaguuaugaauuguuuauuucuggaauuuuccauuuaauauuuuuggacagugggaagugaagccucaaguaagggagggcuacucuaguuaggauaugagugugagauuuuuaggaccuaaacuagggagauaauagaaggaauagaacauuuagauauuuaggagauaaaauauuuaggguuuaguggauaauuuagugauuaauugguguuuggaggaaaaaugaagcauggauaagagguuaggggaugauagugcugucaacugagagagaaaaaucaaagguuuuuuuuaaguuuuaagguuuuuuguuuuuuagaugggaggagguauggagauguauucaauuggacauguugaguuugagauucuuauguaaucuccaguaagaaguucaauaggcaguuggauauauuacuaaaacuugaagacuaggucugagaugaagauaaaagcugaugauucccaaaaaugucuauauuaguuguagcugaaauaauggaaguaaaugagauacgcuagggagaggauaugaagagauagaaaaauuagagagagggagagggaagaguaaugguccucaggcaaaauaguaacaauuaccaagggaauaaaauuucaagaaaauaauacaucagagaaguucuauuuucauaguaguaauuguggagaaugaauuuaacaaguaguaaagaaauguaguaguuaggcuguugaaauuguugcacuuggcuauuaacaaaucauuaacacagcacgguggcucacgccuguaaucccagcacuuugggaggcugaagugggcggaucaccugaggucaggaguuagagaccagccugaccaacauggagaaaccccgucucuacuaaaaauacaaaaauuagcugggccugguggcacaugccuauauucccaacuacucggcaggcugaggcagaagaaucgcuugaaccggggagguggagguuguggugagccgagaucacagcauugcacuccagccugggcaacgagcgaaacuccgucucaaaaaaaaaaaaaaaaaaaagaaagaaaaaucauuaacauucccacugagaaacagcccugacaaaaagaaauuaaaaaaaaagucaguaacaauuaaauuuaagguugccucaguaagggggagguugaauaagagagaagcacauaaauacauguaagucacugguaaugcccuagauuucugcacuguucacuaucuaauacaauauccaccagccucacguggcuauuucgcucuugccacccaggcuggagugcaguggcgugaucuuggcucacuguaaccucugccugccagguucaagcaauucugccucagccuccugaguagcugggauuacaggcacgugccaccacacccagcuaauuuuguauuuuuaguagagacaggguuuugccauguuggccaggcuggucuggaacuccucaggugauccacccaucucagucuuccaaagugcugggaguacaggugugagccacugcguccagccuuuauguggcuauuuaaauuuaaauaaauuaaaaugaaauuuuuagaacuucauugucuuguacuagccacauuucaagugcucagugacaacauguggcuacgauauuggauugcacagauaaagaacauuuucaggcugggcaugguggcuuauaccuguaaucucaauacuuuggaaggcugaggcaggaggauugcuugggcccaggaguucaagaccagccugggcaacauagcaagacccugucuacaaaaaauuaaaaaauuagcugggccugguggugugcaucuguaaccccagcuacuuuaagagacugaacuggguggauugcuugagcuggggaggucagggcugcagugaggcuugaucaugccacuugcacuucagccuaggugacagagcuaugacccugucucaaaaacaauuuuuuuuuaaucauugcagaaaauucuuuuggaaugugcuauauccagaucuugggucaaguugugcuuuuaaaaaauauaacgauaugaggacugugcaugguggcucauacuucuaaucucagcacuucugggaggccgaggugagagcauugcuugaggccaggaguuuaagacuaggcugggcaauguagcaagaucugggucuccaaaaaauuuuaaaaauaaaaauaauaacuuuauccaaaaaguucaacuuuaaccauaaaguucauccuuuuaaaguauauagaguguuguuuuuagaacugaaguuacacauuuaaauauguauacucuauuaauaaagaaaaaauaguuauuuuuugggaaacuguacaaaggauguuaucacauacaugcagaauuaauaaagguuaacaauaugucauaguuacucaaaauauuuggugaccuuacaguuucagaagaagggaaaauuugcaguggguuuaaugaguggaugagaggaaguuuagaaaguagagacaauaaguguaggcuggggugaggguugaaaaauuacauauuggauacaauguucacuauuugggugauaaggcgauaagguuagguaacuagaaacccuaaccucaccauuaugcaguauauccauguaacaaacuugcacauguaccccugaauccauaauaaaauauauguauguaaauaaaaauuaaaaaauaaaaccaugaacaaaauaaguguaggcuguuuauucugguaauuuuaaaugaauaaguucagggaagguuggguacaaggaugagauggauagaugagcuggaaaaggucuuuaaaaguugaaacauugaacugucauguuuugucugcuuugguaucuaucauaagucuguuccaagccaauuacugcuuuagcuuugauuauucuuuuuuuuuuugagacagucucgcucugucacccaggcuggagugcaguggcaugaucuuggcucacugcaaccuccgccuccuggguucaagugauucuucugccuuagccucccgaguagcugggacuacaggcgcgcaccaccaugcccagcuaauuuuuguuuuuuuaguagagacgagguuucaccauguugguugggcugguauugaacuccugaccucaugauccgccugccuuggccucccaaagugcugggaugacaggugugagccaccacacccggcuuauuuuauuauuauuuuugagauggagucuugcucugucgcccaggcuggagugcaguggcaugaucucaguucacugcagccuccgccucccagguucaagugauucuccugccucagccucccaagcagcugggauuacaggugucugccaccccaccuggcuaauuuuuguguuuuuaguagagacaggguuucaacauguuggccaggcugaucuugaacuccugaccucaagcggucugcccaccugggccucccaaaguguugggauuacaggcgugagccaccgugcccggcccuagauguucuuuagauuaaaauaguucauuguggucaaacagguucaugcucucuuacaccagggguaauccauacuuggacacacaagagcuuaugucaaaauauggcagauuucuuaaaauauuccuguuguggcagacuuucuggguugauagguuuuuuuuuuuuuuuuuuuuuuuuuuuuuuuuuuuggagacagagucuugcucugucgcucacgcuggagcgcaguggugcagucuuggcucacugcaaccuacgccucccggauucaagcaauucuccugccucagccugcugaguagcugggauuacaggcgcgcgccaccaugccuggcuaauuuuuguauuuuuaguagagacgggguuucaccauauuggucgggcuggucucaaacuccugaccccgugauccacccuccuuggccucccaaagugcugggauaacaggcaugacccaccacgccuggccggguugauagggguuuucagccuuaccuacacaugcaaaucuccuuucccucuguaauccccaaauuuagacuuuaauucuccugucuuucaaggggaguugccuuacucuguguggguucagggugagggaaacuuuucagccaguuuaugucauugaaguacauugaaguuuaucagggaauuucuaauaauaguaaacuuaaaauggaaggccuuggaguuguaguuguuuaccagaagaguuuuuggcuuuuucugcauacuucuacacaccucuuaccucccuuccuaauugauagagacagauuuuuaucaggucacacauggaaucugcuacucccuuugaauucaggucuguuugcuucaacgacguaacugagaaggaccacucuagauggcuccuuucuaccuagacaugcucuuuucuaccuagacaaaaaaagccaccagccauuaauaaaugguaaacuaucaacuuaaauauuuguucugccuacccaggcacccuacuacauagaggggcuaguuuagguuuuaguuuggugacaaauuguuuguguugcauuguaucagguuuuuuuuguucguuuguuuuugaggcagagucucucucuguccaggcccaggcuguagugcaguagagagauauauuggcucacugcaaccuccaucucccggguucaggcaauuaucguuccucaaccucccaaguagcugggguuacaggcgcuugcaaccaugaccagcuaauuuuuauauuuuuaguagagacgggauuucaucauguuggccaggcuggccuagaacuccugacuucaagugaucugcccgccucggccucccaaagugcugggauuacaggcgugagcuaccaugcccggccugcuuguaucgguuucuuuaugucuccacagauuuuuuuguuuucauggacauaaguggggagcauagagauauuuugcuagugaucauccucuggcuaaagcauaguuugauuucugugauaagaaucuugaccauauucuaucccucuuagaagggcagaagugaaacugccauauuacccauaaauaccacuauuauaggcuuucacaaaucuguauuuacugaguguguacuuggugugaauaccucauuaauguuuuaaacaucugccauucuuauucucuuaaugaguaaaguuaacuucuucaacaaccaguacuuagcuaaauauuacacaauauaauuuuucccuuucuucauguaauggaugaaguuuuuuuguuuuuuuuuugagacggagucuugcucugucaccaaacuggagugcaguggugcaaucucagcucacugcaaccuccgcuucccagguucaagcgauucuucugccucagccucccgaguagcugggauuacaggcacgcaccaccacacccggcuaauuuuuuguauuuuaguagagaugggguuucaccauguugaccaggcuggucucaaacuccugaccucaugauccacccgccucagccucccaaacugcugggauuguaggcgugagccacugugcccagccuggauguaguauuuaaagaaaaaacaaaaaacucuuuacugugaaauacuuucaaacauaacaguugucccagauuuggcuagaagcuaccuuccguuuccuuuuuuuuuugacagauucucacucuguuacccaggcuggagugcaguggcaccaucucugcucacugcaaccuccgccuccuggguucaagugauucucaugccucagccucccaaauugcugggauuacaggcgcaugccaccacgaccggcuaguuuuuguauuuuuaguagagacagguuuugccauguuggccaggcuggucucaaacuccugacugaccucaagugaucuucccgucucagccucccaaagugcugggauuacaggugugggccacaaugccuagccccuucugcauccuuguuauuaacaugucccuaucauuuuuuuaugacauccuuacuuucuguagaagauguucucaguucauuuuauuauuuccccaccccaguccugcagcagcaauuucuccuggagcccugguucuuuuuauuguagaaagguauucagaaaaaucugggugccaggugugcucggcuacugggccuguuuucggugaagaauuagugucuuaguucauuugcgcuacuauaacauaauauauaaagaacagaaguuuauuuccucgcaguucuguaggccuagaaguccaggcaagacagaggcaucuguugaggucuuucuugccacgugcucacauggcagagggcuucagggcaagagagugugaacccacucucaaaagccuuuuuuauagcugcauuaauucauucauggaggcagagccccacuucccaaaacacuguuacauugcauaaguuucuuuuuuuuuuuuuugagacggaguuucacucuuguugcccaggcuggagugcaauggcgugaucucagcccaccacaaccuccgccucccagguucaagcgauucuccugccucagccucccugaguagcugggauuacaggcaugcgccaccaugucuggcuaauuuuuuauuuuuaguagagacaugguuucucuauguuggucaggcuggucucaaacuccugaccucaggugauccaccugccucggccucccaaagugcugggauuauaggcgugagccacugcgcccggccaggaauuaaguuucugauacaugaauuugguggggaggaagcauuuagaccauagcaguuaggaaauauuuauaaguaagcauguguguuuuggauuuugaaaauuuaguaugaaaaagaaaagcauuuguuuucaaaaaauuggauuacauauugaaaugaugauguuuagauauauuuguuaaauauauuaaucuguuucuuuuuacauuuuuaaugugacuacuagaaaauuaaauuucauuuagcucacauuauguuucuguuaaccaucgcuaauuuagacuauucuauuaaaaugcugugaaaguugaugcuacagcaaauuuacuacuuccuuuuaaaaaauaucuuaauaccuuccuuuuugugguuucuugcauuagcauccucuacaggccauaauucuuugcuguugcugaacacagaaauuugggguuuuaaacucuuagugguuugugaugcuuuucauaccagauuguuaagaaaauuggaauccucauccuuuaaaauauuaucuuuuguuauuugccagcauguccgguaaucagaaauggcauuucuuuauggcuuuguucuuugagaacuuuaauuguuguuaagagaauauuagaaguguuuacuauaaauaucuugaaauauuugggaaauauuuugguuuauuucagauaaacugcuaguguauguuuggaauacguuaaaugcauaaacuuacugcuuuauauuuucuuuuuuuuuggagacggagucuucgcuuugucucgcccaggcuggagugcaguggugugaucucagcucacugcaaccucugccuccuggguucaagcgacucuccugccucugccuccugauuagcugggacuacaggugcaugccaccacgcccggcuaauuuuuuguauuuuuaguagagaugggguuucaccguguuagccaggauggucuccaucuccugaccucgugauccgcccgccucugccucccaaagugcugggaugacaggugugagcuacuaugcccggcgcuuuauauucuuuaguaauuucuggccauuguggcuccuuaagcuuguuaauuaauuuaguguccauauucauaucuuaaugauacugagaaauugguuaaauugguuuuuggugucugucucuugcuuaugaaagauaaacuguaguucagcuauuuauuagcauugaguuuuucuagaauaguuaaauuuuuuuguuuguuuuugagacagggucuuauucugcccccuggguucaagcgauucuccugacccagccuccugaguagcugggauuacagggguaugccaccacguccagcuaauuuuuguauuuuuaguagagacacgguuucaccauauuggcccgguugaucucgaacuccugaccucaggugaucugcccgccucggccucccaaaguguugggauuacaggcaugagccucugcacccagccuuaacugcuuuauuuuaauaaaguuguaauauauuugagauggcaagaccauucucuucagacuguuaaugguaauuuuuuaaaauuauuuuuuauuuuuagacuggguugcacacugucaccuaggcuggucuugaacuucuagcuucaagcaauccuccuguuucagccucccaaaguauugggauuacaggcuugagaaacccucuuaauuuaaggacugcagaagcuuacuuuuuuuuuuugcauaagggccuuugauagucauuguuuauggcuacaaacuaauuugauuuugacuaaauuaucugaguuauaaacuucauuuauuuccaccuuaguuauuguaaccauccuuaauucauacacaaaaaagaugcuuuaaaaaauuaguaaaacacucucguuauaaaaauuaggaaauuagaggaggaaaaaggaaauaaaaaaucaccugcagucaguaucuuuauccagagauaagcauuguuacuguguaugacacacugguuucuguguguuugaacucuguuuuuauaguuaucguuauauuguaugguuguacaguuugccuguuuuaccacauagcaaaagcauuuucccauuuaagaucuugagguuuuuagauuaaaaagcagcaaaauauuuguacacaguaaucauaauugggguguguguguguguguguguauguauguguguguguguauguauagggguguguguauguguauguauguauguaugccaccauacagcagcguaauuauguguauacauacguaugcacacacgguuauguugcuguaugguggcaucauuugccugauuuaccuuauagaaaaaccauuucccacauuaaaauuuugaaguuauauauaaaaaacacuugaauucuugaguauauauuauuuuuuuaauucucaguaagagaaaauuagaauguuugucccacagaugcaaacauuuaguuagaacuaaaucuaguaaauugaucauugauacauuugauugcucugaacagaaguuuagaagucaugguugauauauuacaaagcuaaauuauuuuuuucacuuccagucuuuguucagagauuugcaagaaaguccauucacugcuucgcauauaauuugggguauuaucaguaguuuguuuuuagaacagugguacugugugguucagaaauuuguaaaagccaaguguuaggguguuuaauaacaguacauuguaaguucuuugaggagcugggcacgguggcucacaccuguaauccagcacuuugggaggccaaggcgggcagaucaccugaggucaggaguucgagaccagccugaccaacauggagaaaccccaucucuacuaaaaauacaaaauuagccggguguggugacgcaugccuguuaucccagcuacuugggaggcugaggcaggagaaucgcuugaacccgggaggcggagguugcggugagcugagauugcgccauugcauuccagccugggcaauaagagcaaaacuccaucucaaaaaaaaaaaaguucuuuaaagaaguuuaguuucguauauugacuaagcuauagggggaaaagccuuacugugccuuuuccacuuccuacccacucaagauaaccuaaguuggcuuccuuuauuuaaaguguuaaaucuacucuagagcauaccaaagauauuuugaaaauauaggaaauucuuaaugcauuuaaaaggaacuacuucccaaucaguuuuuuucccaucauagaaguaauguauacucagagauaucuuaaaaaacaaggaaaaauaaaaaccaaaauaaccccacugaaguuucaucacuaaaagacaaugucgauauagcauuuagaauguuugccuguuccucccucucaugauggauuuuaauauuuauucaccaaauguuuauuguacuccuaugugcuugaggcugucucagguagcaaauagagaaaaaaauucugcccuugugaaacuuauguuucagugggaucauagguguauguuugcaauuuuauauccugaaaauuuuauaauucaguauaacauaagaauuaguauaaauauuuuuaauagcugcuugacaguuccuuaugugcauaugccauaauuuccuucauuuccccacaguguuaaguauguuauuuuugcuauuguaaauauagugggcgagggucuuacuccacaagguuguaaccaugaaauaauauuucuguuuuaugaaaaccaaauuuaaucuguguuguauccuuaccuaauugagauggccauuauuucccugcacaaaucccccucccucuaauccuuggugagcuucuuacauuccagaacuuuaucaggaaagggcuuuccuccagucuuucaccuacaccgcuugucauugacaugcccauuuauguaagucuggaagguuucuuuaaggccucguuacagagaauauuggguaauaggaucuuugcacaauuuuccgaaggaaaguuuuuaccauuauugucucucccuucucccugcagcucccaaggagggugaguguauugaucuuuucuggaugaauccucuaaucccuuccuuuccuccagcaucuaccucucaaacuccauucucauccccucccucuugaguauaauccaaccagacuccuuccuuugggccuggacuuucucagacagaagccagcugaggagacugucuucuaauugcugguucuaaaauaacagucuugaggcuagaggcccacaagggcuuggaauaggagaagggaauuugccuacuuagccuugugaacaaaacacugaucaguaccucagauuucacuguuuagaacuauuuucuuaggauuaaauuucagaaauggaauuacugguucuaagggcaugauaagggcaugaacauuuaaauacuuucuauucauuguaagauuguuuuccagaagaguuauauagauuuucagugucccaagugagaguucuuauuuuauuaaccccauuuaucaauacuguuaaauauuucauaaacuauaguuuaugucugcagaacuucccccauaugcuuugauaauaauaacuaauuguauuuccucuuuugucuuuuguuauauuuuugccuucaggugcuuuucuccccuaaccaguuuucauaaguuccuuauaucagaaugaauccuuuuauauuuucugcaaauauuuuucaaugccgagaauuuaaugucaauaguauaucacuguuuauaccaucaaauugguuagucaucuuaauucuguuuuucuuuuuuucauuuaaguauagugaaucuuugaacuugauaggugaauuucugguuuuuuaucuucuugauauugguguuuaaaauggauuuaucuucauggauauauuuauguuauaguauuaaaaucugaaauugaacuuaguauacaaaaaauagauuuuuaaaauguuuauacuagcuccuuaucaauguuuaaaauuuugcuuuugcaguuacaauaaugguuauucccuuauuucuguauuuacuaguagagaguaaauuaagacauuacugaauacaaugagauaaauggcuuaucaaguaauagucuuucuuguaacacaaaugaguucuuagaucaguugucuuuaaauuugucuuguuauggcaaguuguguuuucaguggcaacuuuuuuuagggccuaacguaaaguuugaucagaaguuugacguguaaucccagcacuuugggaggccaaagccagagaggaucacuuaaggccaagaauuugagaccagccugagcaacauagcaagaccucaucucugcaaaaaaaaauuaacauauuagcugagugaggugguacaugccuggaguccuagcuauaguucaaggcugcagugagcuauggucgugccacucuacucuagccugggcaauagagcaacaccuugucucaaaaaaaaguuugagcuauguauguuugaagggcuuguguucucaaauuggugagaaaaggguggcgauuugauacuauuuaugaaccagacacuguguuuuauauauauucucuuuuauucuugugucauauauucuuaugucaccugaaugagguaucagucccauuuuacagggugaagagacugaaaugaaguaauuugccaagcuuguguucaacaaacguagaaguggcaguggagccuagaucauucuuguuuguuuguuuuucauuuuuguuuuaaaagcugagcaugcuucucuucaaacuuuaugauuaccuuguagugcacguuaaaacuaauagcucagguugucugugaccccaaagacaauaaagacaggaucucauucuguggcccagacuggagugaaguggcaggaucauggcuuacugcagcuuugaacuccugggcucaagcaguccuuccccuuuagccucccgaguagcugggacuacaggcauguaccaccaugccuggcuaauuuuuaaaaguuuuuguagagauggggucaagcuauguugcucaggcuggucuccaacucuuggccacaagugauccuuugccucagccucccaacgugcugggauuacaggugugagacacuguggccuuuuucaguuuucaagcugcuguuuguuguuacauuuuaaaaaugugaaguuaaagucagaucucuguguguguuuguguguuuguguguguguguguguguguguguguguguguuucuugagauggagucucgcuuuauccccaggcugagugcaguggcgcaaucuuggcucacugcaaccuccaccucccagguucaagcgauucuucugcuucagccucccgaguagcugggacuacaggugcgugccaccgugccuggcuaauuuuuuguauuuuuaggagagacaggguuucaccauguuggccaggauggucuugcucucuugaccucgugaucugcccgccuuggccucccaaagcgcugggauuacaggugugagcuaccgcgccuggcccagaucuuaauguguucuugcucugcgugguguuuguaccugggcuggugcuuugggagagaaguugcauuguaugguuguccaaggacuuccaagaagacaguaaaagaaaauuaagauuuauuauaaauuagaaugugaacuauagagaauugacccauagugcuauguuugagucauaauaacugacuaguguuuacaaagacuuauucacacagaguagcuauucauucagaaguguugaagauaaaaagacuguacuaaaugaccucuuggucccuuuauuguuacuauucugugauuuauugagaauuauguguauauuuaaacucauuccaugaugugcaguguuaacuuuuuaguuacuuuucuuauuggauaaaauuagucagcaucugugcuuuuuuucauuuggagggauuuuuuuuguuuuuuuuuuuguuuuuuuuuuugagauggagucucgcucugucaccaggcuggagugcaguggugcgaucuuggcccacugcagccuccgccuccuggguucaaggaauucugccucagccuccucaguagcugggacuacaggugcacgccaccacgcccagcuaauuuuuguauucuuaguagagacaggguuucaccauguuggccaggauggucucauucuccugagguagugaugugccugccucggccucccaaagugcugggauuacaggugugagccaccgcgcccagccuggaauuuuuaaguagcuaaagaauuagauuuguuuuuaugugaaagauaugauuuugucauagaguuaggcacuuguguuacuuuggaccaaacguagucugcuagaauuuugagauagagcuagauaugaucuaccauggaacauaauucagcuauguaauuucuuaaguacuaguauauuaugaacugggaagcauuugaagagaaacagugaaagcaaagcuccugguauuuuucaugaaaugacaagugguaaauaguaucuauuaaaauucacuguaguugcucagugaaacacaucaauagcuacaugguagcuauuuaagaaaaauaacuuaccacagacucaggaaacuuuacaguguuugacuuccaacaguuuacaguauuuaucaucuguguuuguuugcuguucagauaugguagauucgucauauuaaacacaagcuucaugcgguaaaugugacucuaaaacauaauccaaaacuuuggcaguggaugccuuguuacuuuagaaagacuuuaaaccucacuuuguauuuagugcucuagcuaucaaaucuauaaguaguagcugaguccugguuacuuaaaugauuuaaaugaugauauucucaccuaaaagggcucauuuaccaaccuaagcaauuucaccuuuuugcuuauaauuaggguuaaauugugcuuaaacuguuuacuugaccugugggaaaccagaagaaggcuacucccuuauacuacugaauguuuagaauuuuaauaccugugauugugguuugauguuuuaguuuuaaaaggcauugaaaaucuugaaauuuauguaaaauucucuuuuuaaauuuuuuauuauuaauuuuuuuuucgucuuuuccuuuuucuuucuuuuuuucugagacggagucucacccugucacccaggcuagagugcaguggcgccaucuuggcucacugcaaccuccaccucccggguucaagcaguucuccugccucagccuuccgaguagcugggauuacaggcaugccaucacgccuggcuaauuuuuauauuuucaguagagacaggcuuucaccauguuggccaggcuggccucaaacuccugaccucaacugauccaccugccucagccugccaaagugcugggauuacaggugugagccaccgugcccggccaaugaucuuuuuuuuuuuuuuuuuuaaagucauucguagaaauuggaaggaaauaucuaucgugcuaacauucauuagaguuuaagauuaugaaugacuuauuaaaauauaaaaugauaaggacaguacauguaaacucuagaacgaauuuuaaauucuuaguaauacugguaauaguuauuaauacagguaugacuucucucucgugcuguuucuggugaacaccaccacagggucacaguaagguucuaaaaauaugagcaaaagcugguacuaccaggaaauucaaauuccauaccugggaaucucagaacucagggaggaauaaacauuacagggggagcaaacaauaauggggaguauuguuugagaaauaagaaauuaagaauuuuacugcucuaaaauguaaaaguaaaacaggugaagucuggauuuucuuuuguuuuuaugaaguucagugggagagcauucucuucuguuaaaauugccacuaauuauguguuuuuucuaaaucauauugucugcuuuucuccaaaacaguugaauaauguacucauuuucauaaaauuuuagaaaaauuagugaguaaauuuuuggcaguuauuuuauuugacaugugagugguauuugccuucagauuucgaauucccuguugggaaaguaauaugguuauguugcugugacuauaauauuaaaaugcacagacacacuauaaauucccuuucccuuaauuuucuuugccuuucuuuucuuucuuuucuuuucuguuuuuuuuuuuucuuuuuuuuuuuugagacauaguuucacuuuguagcccgggcuggagugcaguggcacgaucugggcucacugcaaccucugccuccugaguucaagugauucuccugucucagccuccugaguagcuggaauuacaggugcgcgccgcaccuggcuaaucuuuguauuuuuaguagagacaggguuucgccauguuggccaggcuggucuugaauucuugaccucaagugauccaccugccucacccucccaaagugcugggauuacaggcgugagccaccgcgccuggcuccuuucccuuaauuuucugaaagaaaaauucacauacagccgugugaauugacuggacugugaaauuaaaauaauggauuuuuuuggucuuuauacugcaaguuugagaaauaaagaacaaagcauuuucucuguggaugcgaagaacucuguacuugacucagcuuccuuuuucucuugccugcauuuuuuguuuacuucacuggcuugauuagucauaauaaggcucaguaccucugccauucccaauguuaagcaauuuuuuaaaauuuggaauuuuguggauaaucauuaacagaguugcuuaauggguaauguuguuuucuuuauggaaauaauuugaggcaccuuuucugggguucuuggcaagaaauaugaguuuauuauggauauuuaggaaagaggauguagaaauaaaccuuuguuuguaguaugaagcugugauaaucugccccaucuuugucuaauuccguuuuaacuucuguccuuaacauguuucucuucuuaaucaguugucagugaagauuuauuuaucaggagaugggaauggaguauuuuggauauacuucaaguuuugaaugauaaccguuaaaauacauacaauguuuuaauagugagauacacugaucacaaaaauauggucugauuuaacuuuauuuugugguacuuuucuucuaaguuuagacagaugauagaaauucacaaaaauuucagucauaguuauggccacaguuaggcauucccaaaggaaguguguugcauuccuaaguguaguguguugcaugcacuacugagcauaaugggaaaagaaaagugcuauaaaaaccuaaguaccaaguaacuagcuagaaaaagcuuuuaaugggagagcuggcauggucauuaaucugguagaauaguauuugaggaaacaguugcauguguuaagcugcaguuucuuuugguuauugaaaaccaaauaggaaauucugaauuaauacuuacaugcugaaguaucuuuguggagcuuauuuugagcguuagagugggagacuuaguucuaaugcaaacuauagaagaaugaccuuggguaaguuuguugucuaauuaguaaacugagugguagaguuggauaauccugucagcuuuaggcccaugccuuaaauaugcuucuuauccucucacagucaaaaaggauuuuuaccuugguacagucugauuccugcaacaccucucuaguuauugaauguauaguaguuugcuauagacagacuacuuugcaguggcuaucaaaccuuucugagacucauucuaagaaauacauuuacauugugacuuaguauaugcacacauaaaaagaagaaaguuucacaaaauaguuuccuuacuagcaaugagcuguuuuuuguuuuauuucguuaacaacaacaacaacaacaacaaaaacugcuaaccaucuuuuucuugggguugcacuacuguccaaugagcacauagugagggcaguacugcuaacgccuacauaacaugccugcaucaucuagagcuuugcuuuaccuugguacaauuuuuggaagaaugaaaaacugcuuuuccacagggggaaaauacuguuuacugcccaucuuugaaaaacauuuuacuuagagcauaaacuugaagcuagauccuuuuaaccacuuaauuaaaucauacaguaaguuguugauagcuauuugccacaaaaugaaaauauaguggcuauaugaauuuuagcugcugucacuguucauuaaucauaacauaagcucugaacacaguguuucuucuuagaaagguacaaaugauuaugauuuuguauaacaacugaaguuaggugugugugaaguuuuauaauugcuggucuucauuagauaaauuaaauuauaauuaaaugaucuguuuuauuuuugcuuuuuauuuggucucuuauuaauaggcacaauacuggcauuagcuauaacacaaaccaauggcacuaaaaaucuucagaaccuuuuuggauuugaguuuuugaaagauauuuuguggagacuacagauuuaauuuuaaaguauaaauaugcucuuauuuuaaauaaaugggguuuauacuuuguguucuaaugauugagauaacuuuuuuuuuugagaacuuaaauuaaaauucccagucuucucuaguucugucagauuucuuuguucccccucccagugguugaguucuuaugggauuuguggcuuauuuuuaaaauccaaugauuaaaaugaaguuuucuggcaauauuaauauuugugugaaucuggauauccuccucacuuaacuucuaaggcuuuuucuucaucugaaaaugacaauuuuguauacuuggcuggauuauuuuaaguaacaaguaacaaacacugugguagacuaacauuugaguuugaaguuucauauaauuuuaaaucauugucaucgacugacuuuggaaaguaacuucugagauuuuuggucugaagugacccugaaaguuuaugaccuaauuaucauuuuauuaggucugaaugugaauguugcacuuugagaggaaauaguauagaaguaguuacauugcugggugacugaucuagcaagucccuaacagugccauuaagcuguccuguaguacaucuuauuuaguucucucaauaacuacauaguauguugucaguccuauuuuauagaugagaaaaccaagggaacaauuugauagaauaauguuuccaaaaucagagaucuaaucuuagaaggcuuaguugaauaacauuggauauauuacucugcgguuccuaagucuaugaauuaaugggaauuuugaaaucuaauugaaauccaaggagaaagugauagaaauaaaauuguagugagcgaugucggcucacugcaaccuccaccucccagguuuaagcgauucuccugccuuggccuuccgagcagcuaggauuacaggcaugcaccaccacgcccagcuaauuuuuauauuuuuauagagacgggguuuuaccauguuggccaggcugaucucgaacuccugaccugaagugauccaccugccucagccucccaaagugcugggauuacagacaugagccacugcgcccaaccuaguuuaaauuuucuaguagccacauuuaaaaaaaaacagguggaauuaauuucaugaauauguuucauauaacccaauauauauccaaacauaguuucuuuuuuuuuuucugagacagggucuugcccugucacccaggcuggagugcagugaguggugcacgauuauggcucacugcagcuucgaacuccugggcuuaagcgauccuccagccuuagcuuuccaaguagcugggacuacaagcacgugccaccacacccugcuaauguuuaaauuuuuuuguagagacggggguagggugggucucacuauguuacccacacuggucucgaacuccuggccucaagugaaccuccugccucagccucccaaagugcugagauuauaagugugagccaccauccuggccuaaauaucuuucagcauauaaucaguauaaaaauuauaaagauaguauauauucuuuucuauuacaucuucaaaaucugcuguguguuuuacacuuaacauaucucgguucacaccagcaacauuucagugaaguacucaauaaccauacuuggggcugggcguggugacacauacaugccugaaucccagcacuuugggaggcugaggugggaggauugcuugagcccaggaguuugagaccaggcuaggcaacaaaccaagaugcugucuccaccaaaaaaaaaacaaaacaaaaauuauccaggcacaguggcaugugccuguagucccagcuaccucggaggcugaggugggaggauugcuugagcccaggaguuugagaccaggcuaggcaacaaaccaagaugcugucuccaccaaaaaaaaaaaaaaauuauccaggcacagcggcaugugccuguagucccagcuaccugggaggcugaggugggaggauugcuugagcccaggaguuugagaccaggcuaggcaacaaaccaagaugcugucuccaccaaaaaaaaaaaaaaaauuauccaggcacagcggcaugugccuguagucccagcuaccugggaggcugaggugggaggauugcuugagcccaggaguuugagaccaggcuaggcaacaaaccaagaugcugucuccaccaaaaaaaaaaaaaaaaaaaaaaaaaaauuauccaggcacagcggcaugugccuguagucccagcuacuggggaggcugaggugggaggauugcuugagcccaggaguuugagaccaggcuaggcaacaaaccaagaugcugucuccaccaaaaaaaaaaaaaaguauccaggcacaguggcaugugccuguagucccagcuaccugggaggcugaggugggaggauugcuugagcccaggaguuuugagaccacagugagccaugauugugccccugugcuccaaccuggguaucagagcaagacucccaucucuaaagaaauuguauuuuauuuauuuuauuuuuacaacccagaugugugaaucuugaaggaauuuuuuuuuaauuggcuaauggcuacuauuacuggacagcucaauuucugaaugccaaguaccucuuguuaaacuguucaacagccuuucccuaccaucucaagaaguuggugauaaaaauuaucaauaaugaauuacaguuuuuuaauuuuugccuuugaugugauugucuuauuuuauaauauguuagcauuuaauaugaauauuuuuguugacauuuauuuuuuauuuuuaaaaauagcauuauugaaguauaguugacauaauaaaauguacauauuuaaaagguacaaauuuaauaaguuguccacauccaugaaaccaucaccacagucaagauauuuauuacuauuuuccugaagucuucccuccuagcugugcaaaucuccugucacuacauuaaaacuuuuagauauucuucuuuuuuggagauaaccucucuuaaacuucuaaacuucaccauuuguacugguugcauucuagguugaugcuuagguuggggaucuucauucauucucauuuuggagauucuucuuauaucuagcugguuuuugauccugcuuccagaaucccauuucuuucucuuucuuggucuccucauuugugaaagaauaacuucauaacucuuugagaaaggucauuugggagauaaauguauuuuugagaacuuacaugucugaaaauauuuuccuucaucuuccuuucccuuuccucuuuaauagguaguucggauaacaaauucuagauuggaaauaauuuauuucagaauuuuaaagacauuuauucuauuuucuucuagcuuccaguauugcuguuaaagucugaggcuaguaggauucucuguucccuguaaccuauuguuuuuuuccucuggaaguuuucagguuuuuugucuuguccucagcguuuugaaauuucagcaaugugccuugguaugggucucuuuuuuccauuguggcuuuuugucuggaaacucacuggccaucaauucugaaaauuuaccuucuacucauuucauuucuugcccucuguuuuuuauguugccccuuccagaacuccuguuacauauauguugguucuccuagaccaauggucuaacguccauaucauuuucucccccccccccacccccucgaaguggagucuugcucugucacccagagcuggagugcaauggugugaucuuggcucacugcagccuccaccucccagguucaagcaguucugccucagccucccgaguagcugggauuacaggcacccgccaccacgcccagcuaauuuuuuguauuuuuaguagagacgggguuucaccguguucgccagggugaucuggaucuccugaccucgugauccacccgccucagccucccaaagugcugggauuacaagcgugagccaccacaugacccugccuuuuccagguuccuuuuuuugguuguuguuauuuguuacugauuuuaguugcucuuuaauuuuauuuauuuauuuuuuugcuucccauguagauuggaugcucuuuaaagacuuuuuucaaguaaucccaugagccuugguugucgcauuugaguugggcacugaaaacugauaaauaaaugcgguuugcugauugugggccccaguauaaucugacuguacuguucuggcaucuuaugaaaugcagauguugggaucuuuagagcuguucauuuaugcuacucagaucccuaguuuuauaugccaaaguauaacuuaugcuuuaugugauuuccacuuuagagauuuuauuaaaacuuuuuauuuauagucuaauguaugcuguuguaaaaauugaaguucuauguuuauuugaaaauaguauuuauuaagggaaaaaaucuguauuuguuaauuguauugcuuaaauuccauguauuuuuguugccuuagacuacuugauuagcugauauuugauaaacgugucagcccuacaaaauaauuguggauuugucaauuuccguuuguauuucuaacaguuuuuauguuauauauucauagcuuuauauuuaggcuggguuaagcaugaauguuauauacguaaauaauuguacuuuuuaucaauauaaaauaugcagcauuuucucaaauaauucucuuugcuuaacacauucccuuuuuauauugucauucuuuuuucacauuuguuuuauuuguuccucuaucuucccuuuuuuuuuuuuuuugagacagaauuucacucuuguugcccaggcuggagugcaguggcacaaucuuggcucacugcaacuucugccucauggguuuaagugauucuccugccucaguuuccugaguaacugagauuauaggcuccugccaccaggccuggcuaauuuuugcauuuuaguagcgacaggguuucaucauguuggucaggcuggugucgaacuccuuaccucaggugauccacccaccuuggccucccaaagugcugggauuaccagugugagccacugugccuggcccuuuaucuucuuuuuuaugucauuuuaauuuugauguguuucuuauaaauaaacaguguuuagacuuuuuuuuaaagccuguuccacagguuuuuuguaauagagaacuuuaacguacauuuauaguaauaauugguauguuuggaguuggucuucuuccugccuucuauguguuuuaauugguauguuuggaguuggucuucuuccugccuucuauguguuuuauuucugccuugccuuucuuagauagauuuauuuucuuugcauuuuacaccuaguagucuaucuuuuauguaauuuucauuauuuaagugacuuaaaugaaauuauguauuuuucauuguuaauuuuuaaaacaccuacauauuagacuauaaaucuacuuuauaaaaauaaaauuauuucucuacuuuuauaggugguauuguggaauggcaaagcacagacucuagaacaaggcagcuucuguuuacaccuuggcuuggcuuugccacuuuuuuauuguaauccucuugugcauccauuucuuuuuugguuaaaguagagauggggucucacuguugcugaucugaaacucugggcucaagugauccuccugccucagccucccaaagugcuaggauuucaggcgugagccaccaagcccacguagguaccuacuucacagagguguuguugaguuuaaauauguuaauauauguaaagcaccagaacagggucuggaagucaauaaauguuagcuauuauuaggugucaguuauuaacaaaagcuugaaacuacauuauuagcguaguucuuguggguuccuguguuuaaugcuugccugguucuuaaccuauauuagcuuucuguguguuuaaaaaaaaucuuuaucuuuuguguaagucgguuuuccuuauucuuacacacuuuaauguauguaggcugcucuguuguaaagaccaucugucuucugcugggcugaggaccucugugcauuuccacucuuugaccaucucaggacaggcacaacaaaaaaauguuaaaaacuuagauguugucauggauauguggaugcuuuacauugugugugugugcguguguguguaauuuuagugugaaaaaugguaucagguuucuccaaggcaacaaaaccauuaggagauuuuguauauaacagauagauauuauauguaauuucaaggaauuaguuuacuugguuguuggggcuggcaagucugaaaucugucuucugguugagcuggccauuggguugggaacucuagcacaggagcugaugcugcaccuuuagccaggauuucucaggaaaucccaguuuacugccuuguaagugauuagaugagacccaaccacauaauugaggguagucuccuuuacauaaagucagcugauuguagguuuaaccauaucuacaaaaauaccuuuauagcaacaccuaguuaguauuugauagaauaauugaauacuguggcaaaauuguaacauaaaacuaaccaucacagaugaguauauuauuucacaauagauuguccuucauaucagcuucuugaaauuaaaaaaaaagcuacuguguguaauacuauauggaaauuaaacauuguccauauuuuuaguaaaauaauaauucauaguuauacucugcuaacaugagaucaacuuaugcacuaauggaccauauuucuaaaaguuugugaguuguuuguugacuuaagugagaaaggccuguaaugccaguaccggaaaugauuguucccagaauaaccagcaaaagcugauacccagacaguauaucugaaauauguuacauaugaaaaauauauuuaaaaaugaaagugagaggaccgggugagguggcucacgccuguaauccuagcacuuugggaggccgaggcaaguggaucacaaagucagguguuugagacaagccuggccaaaauggugaaaccccgucucuacuaagaauauaaaaauuagccgggcgugguggcaguugccuguaaucccagcuacccaggaggcugagggaggagaauugcuugaacccaggaggcggagguugcagugagccgagaucgugccacuacacuccagucugggugacagagcaagacucugucucgggggggaaaaagaaagguaagugagcaaacaucuguuuggugccaguaauauuaauaguuuagacuuuaaccuuugcuuauaacaguuuuugugggaagguuuauuaguugguucucaaaugugaaggccacaugcuuccuucaauuaaggcauaauaaugaaaggacauacugaggcuacauuacaucuuuguuggugaaaucaggaguagaggaaaggguagaaacuagaacagauacagauugggaaguggagagguaagauucuuagcccauaauuuucagagaaaguaguuguuuguugauggcaccaaacagggcuccugauuuaugauaaagaaucauacauuugguaaaaguuacagucugaaguacaaaaccccaaugauuuuccauucuagugcuucagugagaagcuuaacaguguacuauguauagguagauaagaauaaaguaaaagacagaauucuuugcuguuaaaaugaaagaauaacuuuuacuuagcauaguaugguaguauacuaauaaaugguacacacugcuagucauaaaauuuagauuuuguccccaguucuaccuguauaccuguauuauuaguccuuuguucucuguucaguguccuaguagaaacugugugguuauacuccuuuuuuuuuuuuuuuuuuuugagacagagucucgcucugucacucagacuggaaugcagugauucaauacucacugcagccucaaacuccugggcucaagcaguccucccacugaguagcugagacuacagguguaugccaccaaacgccaggcuaaguuuuuuaaagaacuucugaaagcauagaguuuucaggauguuuuuauaauauuucauagaugguaaggcagugucagauugauucaguuaugucaucaaaugucucucugccauucucagcauguauuucaggcuaaugccccuuauggcccuauuuucagccaucacaugcauccuggauagcauucagcagcagaagcagcaauuucuuuaacaaugcuucauaucuuacuggucagaguugugggucacauggcuuugucuagaucaaauacugaaaauggaacuuccaugauuggguuaggccaguuaugacugucuugacaggagauggggcuugcuuuuccucuaguacaagauagauacuuaaaccaaauaaaggauuaugguuagcaaggaggaggggguuugggaaugacccaguaguagacugccaacagugccugcuacuuaacucacucuugcgagauggggaaguaagauagucuugaggguuggggcuauaguagaauagaaggaaaugacuuuuuggagaaagugauuucuuuuuaucuuuucauguuuuuauuuuuuauuacauuuuguuuuuuacuuagggauggggucuugcuauguugaccaagcugaucucaaacuccuggccucaagccauccugucaucucggccucccaaaauggugggauuacaggcaugagucaccgugccacaucuggagaaaguggucuguaaacuaaguuuuguggacaaauggagauuauuagggagaaagacuuuuccuuauccuucugagcccuugguugucuauggguacuguugcuuguuuucauuuuuaaggauaguaaacauacuuaacauuucccaaggaaucugucuugaccuguguauguguguguaaaagcugcauuguggacuuuuugaaaaagaacauauaauaaccaguucaguugaaugcaacgugcucugugagauuaagggcucacaagaaacugcuaaucacaguuuuaaaaagacaaucuuuugaugucucauaucuuaguguuacuaugaguuuauagccuguuauuuuguuuaguguuuacucugucuugccuuucuuuuuuccuuccuuccuuuccuuuucuuucuuuucuuuuggaagggaacuuaaguacaucuucugguucuuucugccugaucucuuccucuuaauuuuagaaaugaagauguagaaguccaaagaggauuuacuugaugauuugacuagaaaagcuagguuuaaccaggucuucuauggaaaugaauuauagcuguagugaaaaaauaagggaaaugugcuauguuuggauucuagagacaguucucuagaauagaaaaucuucuaaacccaagacagcuugauauuugaaaaaggggguauaaaaccuuuuuuuaaggauuggcagaucguaguaaauauuguggaugucauaguaccacaauauauaauaauuaaguaacauacuuagaauagaaaucuagaaaugucaguaacagaauuuuacuauuucucucaccacacacacacacacacacacacacacacacauacacaaaauuaugaacacauaauaaaggacuuccuuauaacuaagaaaaagauaauacaugaauagagaggccuaucuggaaauuuucauguauaugcacaacauuucagugauaacagaguggcuguuauaaauaaugaucguaaagugcgguuauaaauuauaucauguaugugaaaauuauuuuuuguacaguaugguucuuuaucuaaaacguagaucuuugcuuuucuauaauaacauucucuucuagguuucagcuuauacuugacgcaagagguucuuugagagagcuucuuuuuuaaaaaaaaaaaaacuacauuuccuauuacauuuuauaucuagccugccacccuaagauggaaauccauuuuaguucaucagguauuuauuaaugguuucacuuugugaaagauauugaagagggcagauaaaauugucauuuacagcuuacuuagcauaguacauugugcuuaaaauauaugacauuaauauaaaugaugcccuuucuugauaauuuuuuuuaucucuaaucuuaaauugggggaugauguuucuuuuuagccuuuuuauuuuuauacauaugguuguccaagagucauguauuaacccagguuuagaacacaucauaaugucacugccuccacuucccagacuccaauagggaauagcagcuuuauucuacccagguccuaucagagggugcacaacagaugaggggaauugcaggauuucccaguacaccaaacuguuggucagccuuccugccuuuauuccccauguagaccuaaauacagaaacuuuuuaauuaucuugguuauaccuaaacauugcuacuccccuacgcuagccccgcaaaagugagagagcuugucaaggcaaaguuuuuugaaggaagaagccacaugaaaugagagagggaaauaauguauacugugagcuuaggaagagcaaagguauaaaggugauagagagauuggcacagaacuacaguaguauauguauuaguucugauuaauaaauguuucaauuuuuaugauacuguuauucuuuuuuuuuuuuuuuuuuuuuugaggcggagucucacugugucacccaggcuggagcgcaguggugcaaucucggcucacugcagccuccgcuucccagccucaagugauucucccugccucagccuccugaguagcugggacuacaggcacccgccaccacgcccagcuaauuuuuuuguacuuuuaguagaugugggguuucaccauguuggccagccuggucuagaacuccugaccucgugauccgcccaccucagccucccaaagugcugggauuacagguaugagucaccacgcccggcugauacuguuauucuuguaacaaaaaagcuuacaaugaggaauacauuuauauuguuuugcuuaagauuaaagccauauaaaaaauuuacagcagaaccuggaaguucuuucuugacccuaaccuccuuuacuccuuugcccagaggcaaccauauauuuguauguauuuccaauucuucaugcuuuuacacaaauauguacucacauuaaaaaaaauauauauaaacauauuauucuaugacuuuuuuuuucuuuaauucauagaguucuuaaucaggucuagugaacucaggacaagagacacaacuuggauauaaauaccuuuaagccucuguuuucuucauguguaaaaugaggguaauguuuuaguguuauuacaagguuuaaaugagacuacauguggacaccuuagccugguaacuaagucacgguagcugcuauuauuaauaaacaaggcuaacaugcuucuauaugauccuccuguaccuaagaaauaaacuuauagcaauagagcacaaucagccagccauuuaauuuuagagaauaacaucuucauguggccuaguaaaaaugacuguuaccaaauaauaggcuuuuuaugaugaaugaaugagucagauguuuucucuguaguuuuuagaaucauugagauaccaaauucuuagcuguuuuauggaagaacuuuauaaaguagaguuuacugaaguugggugacuagaaaagccuauaaaguuaaaaaggagaaaacguguugguucuccuaauuaauguaaauuaaaacaaggagacugcccacaagagcuaaauaguaaauuucggucaaaaauaaugauaguauuucuuuuuucaauugguaguaaaacauuggaaauaauuauuccaaaugaaaagacagguugauaacaguuuucaaaaggaucaggauaauagagauucauauugggugacgguaugguuuuagaacugucuucccuauucuuccuaaaugaagugggccauuucuucucacuauauguauauucuugucuggcccugagacagaacacuggauuagaagcacuauagguugacuaaauauggcaguucuuaaaucuauaugaugauaguuugcauuauuuuauuguuaacuuaccauuugcauuuuuauaaacagcuuuauugagauaauucacauacuauacaauucacuugguuaaaauauacaauucagugguuuuuaaaguauauucagaauugugcaaccaucacaguacuaaguuuuagaacauuuuaaucacuuccuccaaaaaaaaagaaaacuccauuuccccucaacucuuccaguuguguggauaaccacuaaccuacuaugucucuagauuugccuauucuggacauuuuauauaaguggaaccauauaauaugugaucucuugugacuggcuuuuuucacucaguguaauguuuuuaauguucauccauguuauagcauggaucagcacuucauuuuuaugguugaguaauuaauauuugauuguauggagauaccauuguguuuauucaucaguugauugacauuuguguuguuucccguuuuggguuauuaugaauaaugcugcuauaaacguucauuuauaagguuuuauauuaacauauacuugaauuucucuugagcagauaguaaagagugaaauugcuggguuauaugguaauucuguugaaccuuuuaaggaacugcaaaccuguuuuucaaggugacuaccauuuuacauucucuacagcagcgaaugaggguuccaauuucuuuacaucuucaucugcgcuaauaagguuaagcauaauguuagcugugggguuuuccuagaugcccuuuauccaacugaagauguuccuuuuuccuaguugguugaauuuuuuuuuuuuuuuaaaugaaaggguguuggacuucggugcuuuuucugugucuauggagauaaucguaugggcuuuguacuguaugggguguacuacacuaauuuuuggaugcuaaaccuuggauuccugggauaaaucccauguggccaugggaaauaauccuuuuuaguugcuggauuugguuuguuuguauuuuggugaggauuuuuguguuuguauuaauaaggaauauucuucuuuuaaaauauuuauguauucauuuauuagagacagucuugcucugucaucuuggcuggagugcagaggcacaaucauggcucacuguaaccucaaacuccugagcucaagcaguucucccaccucugucucccaaguagcuaagacuaugggugcguaucaucgugccuggcuaauuuuuuuaaaaaauuguguagagauguggucuugcuguguugcccaagcuggucuuguucuaaccucaagugauccuccugccuuggccuccugaagagcuaggauuacagucaugagcuaccaugccuggccaagauacuguccuuuaguuuccuugugauguuucuaucuggcauugguguuagguuaauacuggccucauagaauuccucuuauauuuuuuggaagaauuugugaauaauugaugucaauuauuuaaguguuuuauagaacucaucagugaagugaucugggccugggcuuuucauuguggaaaguuuguuaaauuacuaauucagucuccuuucuuguuauaggucuauucagauuuuccguuguuuuuuuuuuuuuuuucuugagucaguuucugauaugguuuggcucuguauccccccacccaagucucacuuugaaauguaauaaucuucaugugucaguggcggggccagcuggagguaauugaaucaugggggccguuuccuccauacuguucucaugauagugaauaagucucagagaucugaugguuugauaaggggaaacuguuuugcuugguugguucucauucucugucugccaccauugauguaagacaugacuugcuccuccuugccuucugccacgauucugaggccuccccagccacauagaacugugaguacaguuaaacccagucuuggauaugucuuuaucagcagcaugaaaacugacuaauacaguuucuauaguucgugucuuucuaggaauuucuuuccauuuuaucuagaucaucuacucucuugcuauacaguuucuugaaguuugcccauuauaauauugauacuguugcuuacuguuuucucuuuguuccuuuaaagaaaaaaauuuuuaugcuuugggggucauuuaacauuucucuuuuuauccauuggcuuaacaaguaucuucuuuucuccuucuucuuuuugagacagagucacacucugucacccaggccagagugcacuggugcaaaucucagcugacugcaaccucugccucccggguucaagugaccuucccaccgcagccucuugaguagcccuccaccaugcccagcuaauuuuuguaugcguuuguagagacaggguuucaccauguuguccaggcuggucuugaauuccugagcucaggugaucugcccuuccuggccucccaaaguguugggauuacagacgugagccaccacuccugaccauguaucuuauuuuuaauuuuuuuuagugguugcucuugugcuuauaauauacauuuuaaauuaaucugccuucaaauaauauucuacccuucaagauuaguauaaggaccuuguaacaguauauucuuaauuccuuuauuccaucuguugugcuacuugucauguauuuuucugaaguauaggaaccagagaaauuauaaggcagaggaguaggaaacacauacuuuccuguauuacgcaauaaggagcuugauaauuggaaagggaaagggaaaugaauauaugagaaauucagaaagaauauaaucagaauucuuaaugaaauuugaaaccucaggugauccacccaccuuggccucccaaagugcugggauuacaggcaugagccacugcgcccagcugaaaucucaaauugaaguugaaugaucaauuugggauaacuuaaauuucuuuguggcuauagacagaucuauuucaagaagucucccuaccuaaccauuuuuccugccccuaaaaaacaaaaccagaaaguucugagaaucauccuagacuucucuuccuccuuuauaucuucauuuuccauuucuaaucagccaccuugucaucuugauucucccucaucuguaccaauauaucaaccaaaaaugaucuuccuaagucuaauuacacuucucucuguuccacaccaaugcaagcaugaucaaucuuaugaagaugcaaaucugaucacaucuuuuaaaauuuucgguggugcccuauucuccacaguauaaauuuuaaucuccuuauuguuaugugaaguucucaagauuuuaguguuuauccaaucuucucuccuaccaucucuucuaaaauuauauaaacaauucccagacuuuauuuuaaguuacuauacauaugcugauuuucauuuccacacccacguucuucuuuuugcauuccuauuaaauucauauucaugaaaauaaauaaauguuucuuuaaagaauccucucagaaauuaaucucuuuuuugucuccuuguuguacuuauacgcucuucucauaaugauugugucauucuuacugugauuacuguguucuuuaaggcuguagcuauaauuguuggauggauauuguguucaauaaagauuggcagaauuuagcuagaguuuaguaacauuuuuaugauuaccuucuauauaagagaaacaucagauuagugguuuugaaucaguauuguaauguaaaauuucuuuauaccaauaaauuuaaguuuuauaaaaagguagauuuugggggaauguuagauuuucaaaugaucguaauaauacagcagcaauccuaaugauaguaugcaaauuaucggcguucaguuggugucaauuucaacuuuagguauucuaccuaugccauacuuuuauuuauuauugcaucaaaugcagacagguucuacucucuacuuuguaagaugaccauaauacucucacucucuuaaaaucacuaucuggccaggcggcuguggcucacaccuguaaucccagcacuuucggaggccgaggcagguggaucacuggaggucaagaguucgagacgagccuggccaacaccgugaaacccccaucuuuacugaaaauacaaaaaaauuagccgggcaugguggcgggcgccuguaaucucagcuacucaggaggcugagacaggauaaucgcuugaacccgggaaguggagguugcagugagccgagaucgcaccacugcacuccagccugggugacagagugagacucugucucaaaaaaaaaaaaaaaaaaucacugucuaaccucuauucuauguauuuuacauugugaagaugaguaauauuaauaucugccuucugucuuuuaaaaaugucuaaaagugaaaaucaauugugucuggcugacauuucucuaagguaacuaguuauggauagagcuccuuuuuauacuuccuuguucugcuuccugguuuuccugucauuucaaauugccuugguuuuuuucuuauugcauuuucuuuuuuuuuuuguuuuugagacggagucuggcucugucgcccaggcuggagugcaguggcccgaucucggcucacugcaaccuccgccucccggguucacgccauucucccaccucagccuccugaauagcugggacuacaggcacccuccaccacgcccggcuaauuuuuuauauuuuuuaguagagacggaguuucacuguguuagccaggauggucucgaucuccugaccucgugaucugcccgccucggccucccaaagugcugggaugacaggcgugagccaccaagcccagccuuacuauugcauuuucaaaguuuucauuuucccauccaguauaucgagucuucugccuuccuagggaauucuucagacuuuucuauccugcugaucugaacuuacugcuuucugaguaugcugcacaacugucuuuuuuuuccuuuaauuguguuccucuuuuuaauaaauuauuuaaaaaucuaugaauacauauuuaagugucuugcuaguaagaaaauaugcauguauaauaaacuuugccuccacauaugaacauacuuuuccuuuuuaaaaaaaucugguuuuguuuaggauucuguuuauuucauuuuccuccuugacacucgugguauuucuccccaucuccuagauauuuuuuugguuuuggaaacuucucuuaauuuuuacuuuuucucuaccaucuauuguacggggauguuaaauagacccuuguaaauauguuuuucuguuuugggaaguguucuaauucuuggauaauuuucacuccuucauuuuucccuauucucuuuuuugggggggcauauauuuauauguuggaauucuuguaacaaccuuccccccguccccaacuacuugccugauauuuuagguugacauuauuuugcaagcuuucauugaauuucuguuuuggugagcaugucuuuuuugagacagagucuugcucuguugcccaggcuggagugcaguggcgcaauuucagcuuacagcagccucaaccuccugggcucaagcaauccucccaccucaccuccugaguagcugagaccucaggcgugcaccaccaugucugucuaauuuuuguauuuuuuuuuuuuuuguagagaugggguuuuacccuguuucccaggcugcccaugaacuccugagcucaagcaaucuggcugccuuggccucccaaagugcugggauuacaggcaugagccaccgcacccggccugcaugucugucauuuuaagaguuucuucugauuuucucaccccuaaucauuuucucuucuugcuuuauauuacaguauuuuuaugccuucucuaaaguaaaagauuucuuuuaaaauuauaaaaguagauugggcaggguggcuuacaccuuguaaucgcagcauuuuaggaggcugaaacaggaggauagcuugagaccaagaauucagggccaaccugggcaacauagugagacccugacauuacaaaaaguuuuuauuuauuuauuuuuugagacggaaucuugcuguugcccaggcuggagugcaguggcacaaucucggcuuguugcaaccucugccucccggguucaaaugauucuccugcuuuagccucccaaguagcugggauuacaggugcaugccaccacacgugccuacuuuuuguauuuuuaguagagacgggguuucaccauguuggccaggcuguucucaagcuccugaccucaagugauccaccugccucggccucccaaagugcugggauuacaccgcgcuuguccuacaaaaauuuuuaaagaaaguuaauuaggcacaguggugcgcacccauagucccagcuacuugggaggcugagacgguaggauugcuugagccugggagguuaaggcugcaauggucuaggacuggacuacugcacuccagucugggcaacagaguaagacccucugucaaaaaaaaauuuuuuuuaaacugaauauuuauuuggacugaaagaagaaaugacaacaaauuauaaaguuaaaagaagucauaucaaaaaaucacaaaauccagaaaaaaacauuuauuaaguaccagacacauccuacuuuugcuuuuccuucauuuuuuggcuucaucuucuuugaucaccuuuuuauuuggcagugaguuuauaauacuuuauauauagaaaauaaaaagaucauauagcuuuccucuagcauucagguuuuuuugcuauauggguguuaauaauuuuuauuuuaauugccugcuauaauuauuuuuuauuuugguaaaauauauaacuuaaaauuuaccauuuuaaaaaguauauucuauuuccugaauuuuuuguuucucugaggcaauuuccccuuuuugaugggaagaguguuuuaucuuugugaguucucaagugugaugaucugugggccugcugauauuuaagaaugaggcuuaccauuaggcaaacucuguauuuagaguuugucuguauuuagagcucauaguaagccucauuacuuguuaauggucagacuucauucucaagugaauggucagggaacccccaaaauaacagaugguaacugguuuuguucugggauguuaauuugcacucuaauggcccuacuaguuguuuugauaucuuuagaguagaaccuuaauuuccugccuacccaaggguaagcauugggugaucauuuugcugugcgcacagaaggugagaggcauugauuugucuguccuacagauucuucguuuuuaaaaaucucaugucucauuucugcuuuacuggaucucauugguuuuuggaggaaagguauugguuccuuucucagguacccuccaacuauauuuuaggcuguuacuucuugggccagaauuucgccauuuguaucugcugauggcuccucucucauccucuuuauuguuugcauuuaauauuuuauuucuguaacuuucuugaguuauguuaauggaaucuggagggaaaguggguaacaguaaaguaagcuguuuauacugucauucugaauuguaagccccugcagacuucuugaaugauauuaaugaauguugagucaccuuucaauauggagggacaagccuguucuuuggugucacguguaucgcucuuugguuguuugcuuagcagcguugaaaauugaggaggcagagguguauguauguauuugguucaggauaguaucucacuagcaacucccaauauaaccuuuuuuucuuuguguguguguguguguguguguguguguguguguguguguaguggcacgaucacacucauugcagccucaaccuccugggcuuaagggauccucccaccucagccuacccaguagcugggacuacagccaugugccaccaugccugaccauuuuuuuuuuuuuuuaagagacaaggucuugcucuguugcccaggcuggucuugaucuccuggccucaagugguccuccugccucggccucccaaagugcugggauuauaggugucaaccauugugcccagcaaaccauuccuauuuucccacuaaaauuaucauaaaaucaggaaugaaugaaagcuccaaucauuacuacaaaugaaaauugacagauauaaagacagaacucugggaguaagugguacuaaugaugaggcagauugaaucagagaaauacuuauacauuucaauuuguacaauguguauuuacuuuguuuuuugagugaugaccaccaggaggaaaaauccuugucuguccccauuguuuguucaaaagucagaccuggagccccugcuaaccagaaaauugagcagucaucaacuuccccucacaguuuuucugcauguaagaauauuaguaaaauuagggugauggggaagagggcuguggaaaugggaaacugauaauguacauguaguauaauugggcauuauuauccaaaauaugguacauauacuucuagaaauaguagauauuuuagguuguacgugaaugaacguuuuaaagccccaaaauuucuuuuaauaacuaacagcaauacuaauuaguuacgaggaugcuaaaauagguaguaaguaccuguuuuaugauguuaaaaauaucaaguaaauauuauagcugguuauuaguuuuggcauaacauuaaugacagaaacuugagaaacauuuccucuagauaaaaaagcuugcuagaaacuggcaacaguacugcuuuuuacacguaucacaguuguaaauaugagaagggaguuugacuuccacuugugugucagacagcggggucauaaacaguagguuuggaggaucuauccuuguucaguauagaaguucuauuaugauugauauggaaaugacuuugacuuauuguugaagcccugauacuaaacaaaucugauuucguuugaaucuuuuuuucccucuagaaguaaaaaaggacaauuaaaaaaaaaauccuuuacuuaauuuucaguuucuucuuugaauaacaaaguuuggaaguauaggggguuggaacugaucucuugucacagaguuuaaagguuaagacuggggaauuuuauuuguuucuaaaugaaaauguuaugauuuacauaaaugaaacuacagugugaagauggacaguaaaugagauagauauuuuugaagcagcaacugauuuucuuuuugucagacucugcagccagccugaggccacaaauaaauguagucagaacuaguuucauaaaguuagauggauauguucaauaaauaagagacauuuuccauaguauucauauuuugaacaugaugaacaagauuuagccaaaaaauaugugcauauucuuaugacucagggacaucacacaaaaaagaaaaaagaauaaaauugaagaaauuaauguguguauucuuuuuucccuggauugauaagcagcuucuaaaaguaugcuaauucaaagguuaguuuuauguauuguaaacuguaguuagauaaauaaugguuacuuugaaaauccacaguaaaugcugcugauuugacaaggaaauguguuuaguuguacucuaaggauggccuucuuuguugggguacaaaauuaguucauuuuuaaagaucauaaacaaaauagcagaauugagcaauguaaguacagaaauaacauuuauauaaaaaucaaagugcaaaacaguauaguauaucauucaugaauaaguaauauguuguaaaacuauaaaaauauacaauagcgugauaaauaccauauuccagauaguggcucuggggauguggagagaagaauagugguauuauuucauagaaaauaaucuaaaagaaauauggcggcugggcacaguggcucacgccuguaaucccagcacuuugggaggcugaggcggguggaucaccugaggucaggaguucgagacuagccuggccaacauagugaaacccugucuacucccagcuacucaggagacugaggcaggagaaucgcuugaacccaggaagcagauguugcagugagccgagauugugccacugcacuccagccugugugacagagugagacuccaucucaaaaaauaaaaauaauaaaaaaagaaauauggcaaaacauuaagaagugacaaauaucagagggacauauauauauuccacauuucuguaugcuugaaaacauuuauguaaauuuuucuaauguguacagugacuuuuuaaaaguaauaugcuaaaaccaauccauugagugaaaugacaauuggauuaaauuauaacaacaauauuaaugcagacaacucuauuuucuaguuacacuuaucaagagauuaguauugaauuauuuacuugcuuugcaaauaagaaaauguaaaauuuuaaacuuuucucuuauuuaaagaccuaagaugaccaauagacacuuuuucucauguaccucaaguccuuaccaaguauaagaagcagaacaguaucuguaucuucgaagcucucaguguacuucucccuaguaacaucucccugccuccccuguccugaauuuuacauuucauuuuauugucuuaagugccaagggcaagguuugucaaaaucaaguaauguucagccuuuuugguagugaaauauacauaacauaaauuuaccauuguaaccauuuacaaguaacuuagaaguauacaguuuuguggcauuaagcacauuuacaauguugugcaauuacuaucauccauaucuagaacuuuuucagcaucccaaacugaaaguuuuuuuuuuuuuuggcgcgaucucagcucacugcaaccuaugcgucccagguucaagcgauucuccugccucacccucccgaguagcugagauuacaggcucccgcugccacgcccagcuaauuuuuguauuuuuaguagaggugggguuucaccauguugaccaugcuggucucaaacuccuuaccucaggugauccaccugccuuggccucccaaaguguugggauuacaggcgugagccaccgugccuggccccaaaccgaaacucuuagcucuuaaaaacugaguccccauuguccccuuucccuggucccuggcaaccuuuuuucuacuuucugucucugugaauuugcauaugcuagauguaccucauguaaguagacucagacauuauuuauccuuuugugucuggcuuauuuuaccuagcuuaauguucucaagguucauuugaguuguaccaugugucaaaauuugguacauauuuuuauauuuuauauauauaauuaauauuuuauaaauauuauauauauauaauauaaaauauaauuaauauuuuaauauuaaauaauauuccuuuauauuuauauauuuuguuuucuguucauuuguugauggacacuugggucauuguacccuuugacuauuguaaaaaaugcugcuguuaacauugguguucauguaucuguuggagugccugcuuucaguuucuuggggcauauacuuagaagugaaguugcugaauuguaugguaauucuguguucaacuuuuugaggaacuaucgugcucuuuuccacauugucuauaccauuuuacaaucacagcagugcacgaggauuucacuuuguccacauccuugccaacacuuuuuugcuucccuacuggcccuuuuuuuggggaggggcggguaauagccauccugauuggugugaagugguaucuuacugcuagacauguuuuaaaggaaaaaaggacaguucuuuaaugugacuuaaauuguuaaaacauuguauguguaaauggaaaaaauacauauacacuccuugugacuuaaugaucuuacacagcuauaacagcaaaaccaauuuuuaguguaagugcuaauuaaaaccuacuaaaauuaauguuuuugacagugcaaaccaaauuguggcugucuuccuuuauaaauaacuuagucuuaugugagaguaucuauuucaguuacaaauuauaacugcagaaacuuuaacugguaaaagaauucagaguauauaguuaggaaaguuugcugacauuaggacgugccaaacuaccuauagucaaaauuaauuaacaaaauuaaugauuaaugugucaaacuuauaaauugucauuuagguuaucauuugguugguaauaugauucaaaaaacaaacugccuaaugaaaucuuguggucaccuacaugagccacaauauacauauauuuauuuuuaauuaauugucuaaguuagaacccaaaauucuuuuuucugaaauuuaaagaagaaaaaaaaauucuuuucgccaccucugauaauaucgauaguccaaaauuaagaaaaugcuaacuucuccugaugacuucuucaacagccuauuucagccugugaaacauauucaggaauacauaugggagaauaaaucaaugugaaugggguagcugccauaaaaauaauguucuuaauuuguguaauuauuuucaguuuucaaagcacacuuacaauaugucgagcccucagaauaauucuuagcuauucaggaaagaugguguuuucauuuuacaggcaaggaaacuaaaacucauggcaguuacuuuagaaauaggagugcaaaagaagaaauaagcauggcaugugagaauaacaagaguccuuaucuguaguggguuguuuuuggaaaguauugagaaauaagcuggauccaagggacuuuggaauuuggauuugauguaauggagcauuuuccaaacuugcuggucauaagaaaucccuuccuuggagacuggggccaggguccuagaauccuuucguaacaagugccccugaagauucuuguacuucagcaaaguugguuaauuaugcauuuacuauuuuugagcaaggagcuuggugucauaaaaauagugucugggggaauaucuuuaucuaaaggguagguugaaggguaaagagagucaucaggcaauguuuauuuugauaugacguaguuguggcuuuuauuaguuugugaccauggaaaugagauauggggaaucauggaauuauagagauugccugggaagacaaagggaaauagggaaugagugauuuguggagagacuuuauaggcuuggacauauauugagucuuugcucauaaaaugucguagauauuuggaaaucuaauuugaauuccagaauuaguaaaacauuacacuuaagucagaccuugccaggcauaaagauauuguauauuuuuauguacaugcucaauaucguauauucucaauauaaaacucaguugcagguugcauuuguuguagaaauucugcuuucagguuuuguuuuuccugacucuucaaaucuucucgcugggcuucugggcuagaucucccuauaaauuugaaauaguuauuccuuauuccccaaguaaguauggaaaagagggaaagagggauagaaagguuaagauugagcugauaagaagacccuuguggcggggugggggguugguguggggagugggugggaagguaguacacaguauuuaaaguuaacaagagcuggguguggugguuaaugccuguaaucccagcacuuugggaggccaaggcagagaaucacuugaggccaggaauucuagaccagccugggcaacagagugagacccugucucuguuuuuuuuuuuuuuuuuuccggagauuaaugaguccucccucuuuugcuuuuauuucuuuaagugaaagccacaucaggcacacugaaaaccuaacucuuuguuuuuauguacugggcuuauuuuuuuucuugauuucuuuccugaacaaaaugaaacaauucuuugagaugcuugucuuugugaugugcacaaccacuuuugcuuuccugugguggcagauucuuacaggaugacccacuaaguuucagugcuaauaacuccauuugagcuuuucaguucuguuuuguugguuuccccuuuggcaaacccucauuacccuauucaaaaaacuuugggaacuguuucuuccccauuugcugcagaguaacauuugucucugaaguguaagauuuccuuccaguagggagcaauaauucuuuuuuuuuuuuuuuuuuuuuuuuuugagacggaaucuggcucuguggcccaggcuggagugcaguggcgcaaucucggcucacugcaagcuccgccucccggguucacgccauucuccggccucagccucccgaguagcugggacuacaggcgcgcgccacuacgccuggcuaauuuuuuguauuuuuaguagagacgggguuucaccguguuagccaggauggucucgaucuccugaccucgugauccgcccgccucggccucccaaagugcugggauuccaggcgugagccaccgcgcccggccgggagcaauaauucuucuauuauuauucucauucacauuuaucuuuccuuuuucuccccuucucagccuucuugcuuucuucaggaagaccuccugcaagaccucaccuauaguaguuugaguuuaacccuguuagcugcuuucacauucaaaucaauuuaaucuacuuuaauaaaaaacuuuaaaaauuuaugugaaugacuagguaugguucuaaguuuugcuaugcaauagauacuguaagucacuuagugaaaguaguuugccuuuuuuuuucuuuuuucuuuuggagacgggguuuugcuauguuguaggcuggucucaagcuccuggccucaagcaguucuucugcccuagccucccaaagugugagccgccaugcccagcccuaguuugccauuuucuguuuuauuuauuaauguauuuuuauuuguugccuuuguccacauguucuaagccauuuucuaauagaacuaaauguguuuuuuuuuucuuuuugugguucagcuauuauauguaucugcuacuuuuagcauuaaccuaaagcuuccuguauaugccaagucccagguauuuuggaaucccauguggcuuuugugcccuccaaagagagguggagagaaccucuuagacuccaacuuuuacauacucuuggcccagauuuggggauuaagugaagggugccuaaugaauagaaccuaugcauucguauacaucuggcuugagaaaacuguaucucucucuuuuuuuuuuuuuuuuuuugagaaggaguuccacucuuguugccuaggcuggaaugcaauggcgagaucucgacucacugcaaucuccgcuucccagguucaagcgauucucuggccucagccucccaaguaccucggauuacaggcgccugccaccacgcccggcuaauuuuuguauuuuuaguagaaaugggguuucaccaucuuggccagucuggucuugaacuccugaccucaggugaucugcccaccuuggccucccaaagugcugggauuacaggcgugagccaccgcaccuggccuccuaucucucuuauaaguagacuuuucuucuugcuucuuugaaacagaaacuuuuuguaaauaaauaaaguguauaaaggugagccauauugggaagaaggggcugauagaggaguuagaacaaccagguaaccagauuuuuuuuuccuauucuuuugaggaaaaaaaaaaaaaaaaaauuuuuuuuuuuuuuggucuuucugaaacuggugcuauuucagaaugauagguaaaagucuccauggagaagcaggggaugugaugccauguuuaccugccccucccccccauaauuaugauaucuuuucacccauugaggaaaguugggcucacauagacucucuucuuuaugcgauagaccccaaauuucaucucguaagaguaccagacuggaaggucauaaagaaaucugcaguaggaauuuaaucuguagauuuggccacauaaaaugcagguguaauuuuuauauuauacuucaaaacaccuugaaagccauguuagucuuuuugcuaucuuuaacaguuaagaauuuuugcaugagaauuauuauuuuguuucuaguuguaguuuuuccaaccuuucccaggccuucaaucucuaauucugaaguuuuuaagaagaguuaguuaccuacaguuaauacuucugucaucuuugaauugcuguuauaccauauaggccuaugagagaguugccagacuuaaauaauuauuuauaugcuuaauuucuuuuaacacauagaauaauucuuuaaaaaauuguuuucucuguaaacuguaacugaaacccaugcugcccuggaaagcaauguuacaaacugcuguacccucugccugaagacaaguuuuuauuucuuuauccuaauacccaacaacaauuaguaucacuuuaaaagauaaaauagaggccgggcacgguggcucacgucuguaaucccagcacuuuggguggcugagaugggcagaucacaaggucaggagucccagaccagccugaccaacauggcgaaacccugucucuacuaaaaauacaaaaauuagccaggugugguggcacacgccuguaaucccagcuauucaggaggcugaggcagaauugccugaacccgggagguggagguugcagugagcagagauugugucacugcacuccagccugugcgacagagcaagacuccgucucaaaaaaaaaaaaggugaaauagaugcccaugucuugcuaagucaguguggugcagaaaaugauaaggagggaguauuccaauauugaccuaaaauauuuuaaucaagaauuccagacacuuuucuccacccauauuuugauauguagaguuaucauguguggucuuaauuuagcaguaaaauuuugaauauugcacauauauaauacuagagaaauuuaaauguuaauaagacuugaggaccagauaauuuuggggauacaguuguuagcuguaaaguaaaaauuucaaguuuaaugaaugaaaacuagucucacugcuccauuagcacaauugguuuggaagguuugcuucugggcgaauaaagugaacaauagcaaaggaugggauugcuacuuuaaaaauacuaaaauaugaggguaaagagagaugucugucagaggauguuuaaaaugaaacagcuucuuaaaagcaagggacggaagaugugcaaaugguuaugaggucauuguacuaaacauuagcauugugcuucucacuccagaagaaauuacaucaguggauaaucuacugagcacuguaauuuggguaguacugagaugagcaauuguuuuaguuguugccugacccccaccccacccccagcagccuggaacugugcauguuaugaagaggucaugugacacggauccuugguuuugcucauuuauccugucaaaacaacuuaauguagauggaaagaaaugaacgaaaugaauagaauggguuagcuguaucagcuuuaguuuauauugaagguaaugaaugcugcaauugggauaguauaguauauuaaggccccaggaauauccagcuccauaauggugaagagaagguucuaaaaagcaacaguggcuaauccauucuaagucucacuugauguuuuaaugcuacuuuuugauacggucuuuuaaaauuuuaucauuguauucaugauaauuugauugacaguugguaauauuuaaacaauauaugguuccucuuauuuuaccuucagcuguaauuuaguauaaaguuccuauuucuuuucaauaauuauuauauaauaacaaacguggaucuucugagaagaaaauuauuuuagaaguuuugcaaaauauuuaggguuuguuuguugucauugaaacaugagcuuugaaccaaaucuucauuugucucuuaguucuguuuuucaugugaauuugagggagauaauaaaauuuugugagucaguucgucucacaacauuuuucugaggauuaaaugaagugaagcagccaacuaguaaauggcaaauacuuggcaaaaauuauuuuuaaaaccccagguguuccuucugaucugugucuuauguuaguuuugaucuacuuuauuauugucuuaaagucuuuugggugcuaaaauuauguacuucucuaagauauuuuaugaaauguuccuagauuaaaaaaaaaacaauauucaguuauagauggaacaaguagacaaacuauugaaagaagccccaaauuauuuguuuagguuucccccauuuccugcuuuguugaugauaaucuguugucaugcaucuguauuucuaacuucaaacauuaagcagggguucucagaucccuuaaaauaaauaauacuuuucagaaaggauaaaaacacuuagcuauauaaaguagccuguauuuauaguauagaugucuucugggcaaauuagagauaaaauauucuaaauauuucuauggaauuuuuagauugucauucaguguauucucaaggaaaauuaaauacggauuuuugauggcaaagaagucccccguuuuuuucccucuaugcuuugcuauaaauaaguaguuggcagcuuuuuuacaauaagcuuuuacaaaccauuuuuaaaaaucaaaagcugggaccuuugcaaguugaucauucuguauggguuguguuggacuuaacugagacucagaggcccaauuucaauucucauuuuucuuuuaagucacaggaauuuuuuauccuuggggaaaugcuaacugcuuauuaaggacacacacacacacuuuuaaagggguauugaggggaaaagacauuuauggaauucauucaacaaauggcuguugaacaagucacuaugcuagguugucaggugcuaaagauagaacacaaaaagguaucuugucacugccuuuucaugacaaaaagccucugagggcuuauucuaugggggauaagagucaauauaauguugccugugauuaaguguuauguaagaggcauguacauaguauccauugguuuuaaugcuauugggcagaguagaaacaggaguaguaacuugguuuccuuuuauuacauuccuuauuggguacuuuuggcgacagagugagaaccuuaaaguucaauuaauaauugauguaauaacugaagagaaaaauuaaugaacaggaagguagaucagaaaacauugcccagaaaguagcauacagaaggaaauggaaaaugagagagaaauuaaaggauauuaaggauaaacuaaaguuauacacauacucacacacauuuaaaaauuguuuaaaaagaaaagaagaguuggaaggggaaaaaaagagaaugagaggagacaguguuuagagagauacugagaauuuuccugacuugaagacaaauacuugaguauuuaaguuauugcuuaaaagaaaaaaaaaauuaggcuucaugcaguggcucacaccuguaaucccaggcuuugggaugccaaaguaggaggaucaccagaaguucaagaccagccagugcaucauagcaagaccucaucucuacaaaaaauuaaaaaauuagccgggcaagguggcacaugccuguaguccuagcuacucuggaggcugaggugggaggaucccuugagcccaggauuugaggcugcagugagcuaugauagcaccgcugcauuccagccuuggucacagagugacuuccugucuuuuaaacaaacaaacaaaaauaaaaacaauguuuugguuaaagauagauugauuuuaaucaaggcaaagauagaacuggaauuuauauuuaggucuuugccuccaaagccuauguucauuuccugacauuaaauugcaugucuagcaauugaugacuuauguuggauauggaaaguuaacugcaccuuacaaaaaugagacuauaucugaguuacacauuaacaguaaagauacuaaaaugaucucaagcaugaauguauauaauccaaaucuaucauuuauaacuucagcauuugcauuuuuuaaacaccaucgaucaugauuuaguaauguuuaagugucuaagauuaacugucugauuugguguuuuaucauuuuaaaccacauucuguuuugguuuuugauuuuaggaucgaaaauuaacaaagucugagaggcagagauuuaaagaagaagcugaaauguuaaaaggucuucagcaucccaauauuguuagauuuuaugauuccugggaauccacaguaaaaggaaagaagugcauuguuuuggugacugaacuuaugacgucuggaacacuuaaaacguaaguucaucaguauuacaaaagcugaccaagaaguaugagagaauuugauuuuuuaaauuucaggucuaccaguuucacuuugguuguucagccuaagaagggaacaguccuuccaacuguuacuguauuagcauauuuccuugcccacaaaguccucuaguauauaaagugauuugauaauuauuucuugguaaguauugaaaugagaaguuauggccgagugugguggcucaugccuguaaucccagcacuuugggaggccggggcaggcggaucaccugagguuggaucaccugaggucaggaguucgagaccagccuggccaacguggugaaaccccgucucuacuaaaaguacaaaaauuagccgggcaugguggcgugcaccuguaaccccagcuacuugggaggcugaggcaggagaaucgcuugaaccuaggaggcggagguugcagugagcugagaucaccucacuucauuccagccuaggugagacucugucuccaaaaaaaaaaaaaaagaguggcuaaggaaucagaaaucaaaugucaagguagcccucuagugguuaaaaugagauuaagguuuauugagaaacuaccuauuuuuuucauuuguauugugcuuugcuauaucccugcaacuuuuauaucagaugcagauuauauugugacaguuaucacuuaaaaaauacuuuuaguuccauuucccauaacaucagaaauuaauccccaaauagcuagaucuaucauuccuuucacagaaauagguuuaaugcagaaauuucccguuacuuauuguaaagagcuuuugguaaguguuggaguaugccuuuguaaucccagguuucuuagagcagcaguccccaaccuuuuuggcaucagggauugguuucauggaagacaguuuuuccaugaacuggugcggggguggggcuggggaaguuuggaaugauucaagcacauuacauuuauugugcacucuauuucuauuauuauuacauuaaaauauauaaugaaauaguuauacaacucaccauaauguagaaucagugggagcccugagcuuguuuuccugcaacucaacugucccaucugggggugaugggagacagggcagaucaucaggcauuagauucucauaacgaacgcucaaccuagaucccuugcaugcacaguucacaguaggguucauggcccugugagaaaucuaaugcugcugacaggagccagagcucaggugguaaugcgagcagugagggagcggcuguaaauacagaugaagcuuugcuugcucgccugccacucaccuccugcuguguggccagguuccuaaaaggccauggacugauauugaucuguggcucagugguuggggaccccugguaucuuagaggaucuguuuuuacucagagaagaaccuguaguaaguuaccuuguauaaauuuuuuauuuggugaaauuggauauuuuuaaauuaucacuguggcauauauucuuuauuaauuguuaaaguuaauacugcugagcugauuaauuccagaucauuggaauacaguguuacagcaccuggauauagucacuugcauguuuucugaaaugcuuacgguuagcauguugaaacaugaacagaucauuucuguccugcaaauucuaauuucuuuauccaacuuccacucuuguuuauggcaauaccuuuauccuaguuagucaggcuucuugauacucucuuuucuuccauuagaaugugcuaacuagcacuauauaccuaguacuaugaacaagugcuagauaucacauucuacuggaagugucuaauacugaauaauaaguguuugaaugaauuaaggagaauuaugugguaauaauuauguguacaucuugagauucuuuccacugguuuggauacuuacuugguugucaacaguuugucuggcaugccuaagauuacucuaaaauacaaugguuuacuuguuuuaaaaacuauauugaggagcuuuggguaacauagugggguaauaagccccuguggaauggcugucccacaccaacaaacugaaauguggaauauaauaaaaguuuuuuccaauacgugucuaagcuuuaaggaaagaaagguuaaccuccagauaauaagcagagauaacucaaagccaaaacaggaacuuauacucugggauuuuagaccacauauugguugaggaguugaugcuaguuuuaauguccaugcaaggacagaaagccuuagaacuagguagagaggggagcuagaacuuagccugugucaaaaaacugaacuauccgugaaaagagagaccucagugcucuagccagugaaagcugcaaggaauuuuaccugugugcagaagacuguggauaagaggggagaccuaugaaaaauagaaauucacaucaaaugcuaccaguguucuuaauuauucuguaaacuaaucuuuucuuuuucuuuuuuuggagacagggucucacucgguugcccaggacagagugcagcagcacaaucauagcucacugcagccucaaacuccugggcucagggaauccuuccaccucagccuccccacuaccugggacuauaguugcucaccaccauaccugucuaauaaaaaaacaauuuuuuuuuuuuuaguagagacagugucuauuuuguugcccaggcugcucucaaacuccugagcucauccugauuuggccucaucccgauuugaccucccaaacugcugggauuacaagcaugagccacggugcccagccuguuugguauucuuccaucucauauguagauggcgcuauaacauaaauuuguaccaucuacuugguacaggaaucccaaaccgaagaacauacaugauaauugaucaggaacggaaagaaaacucccggggacauuuucacaguuccuuggucaguguccagaggcaaaacuguuuccaaagaagaugaccucacaauuaaauuacaaaucacaccaaugaaggugaauagacacaaccagaaaauagcacugcaacaauuaaggauaucauggacaagucugaaagugauuacaaacaauuauuuacauaaugaugucaguaaagauauuuguaaguguauaugaaguguauaaagagaaaagaaggaauugaaggaaaaagacaccaaagaaaaaaaagacaggcauaauuuaaaagcuucugaagaacuucuagaaauaagaacauuaaaauucaaacauaaauggucuaacgguuaaacagcagacugaauugaauugacaggaauauuaacuacgaagaaaugagcaacagaacacacaaaaaagacagaaaauauuuaaagaggaugacauaguagugagaagacccagauagauuuaauuaucuaaaagggguuucccuguaguccuagcuacucuggaggcugaggcagagaaucacuugagcccaggagguggagguugcaaugagccgagaucgugccucugcacuccagccugggugacagagcgagacuccaucucaaaaauaaaaaugaaaaaguagagagaaugagaaaaagaaaaauuucagaauuuaagaauucugauugagaauguauacagauuccuaagcaaguagauugaaaacauucauauucauuucuggaagaauggauaacuaggaccauuggcagcauuuggagaggcagauugggaaggaaugggaauuaauuccaaaaugcgugcuuuuuggaccuuucgaguuucuaccuuuguucucuauguauauuuacauugaaacagauaaaacacccauagcugaaaaauaagaugggaauguaugagucagaaaauuuggauuaaggccaggcgugguaguucacaccuguaaucccagcacuuugagaggcugaggcggauggaucaccugaggucaggaucaccugaggucaguucgaaaccagccuguccaacauggugaaaccccaucucuacuaaaaauacgaaaaauuagcugggcaugauggcgggcgccuguaaucccagcuacccgggaggcugaggcaagagaaucgcuugaccccggaaguggagguugcagugagccgagauugugccacugcacucuagccugggugacagagugagacuccaucucaaaaaaagaaaaagaaaaaaaauuuggauuaaaaguugagauaaauuuagauguauuuuuuuaaauagacaugaaauucaaauaucauacaauuaacauuuuagaaaguacaauucaguggcacuuaguacauucacaauguuuuguaaguaccacaucuaucaaguuacucaacauuuuaaucaccucagaacacucugugcccauuaagcaguuacucugcauuucccuuccuccagccaggcagcguauuuuuucuuuaauugcacauuaucuaaguucuuuuucuuuuuacaauuaaaaagaaauuuucaguuucugagcuucagaggcuuaugccaacaggaggguuuauuaaguagaaagagcauuagacuugcaguagaaguugugacugcucccaccgcugccucugaccaacugugauuuugggcaaauagcuaaccuuauuugggcuucaguuccccauguguauguaaaacaagugguuggacugccugaucucugggaccagccauucguggaugggauuuuuuuauuguaaaaaacauaacaaaauuuaccaucuuaaccauuuuuaaguguauaguucaguaguguuaauacaaacacauuucugugcaauuucuagaaugcuuuucaugucacaaacucuaugcccguggaacaauuucccauuucucccaacccucagcuccugacaacuaccaacuuuuuaccaucucuauggauuuaucuaaucaggauauguccuauaaauagacucaaaguauguuauggauccuuguguuuggcgucuuucacuuagcaugguguuuucgaggaucaucgugauugcacgcaucaguacuucauccccuuuuaugacugaauaacauuccauugcauggaaauaucacaguuuguuuauuuauccauugaugaacauuugggcuguauccaccuuuuggcuauuaugaguacugcugcuaugaauauuugugcagaaguauuuuuuugaguaccuguuuucauuucuuuuggcuguauacuaggaauggaauugcugagucauguggaaaucuuuguuuaacuuuuugaggaggcauccuaccgggagugacaugauaccucauuauggauuacauuugcauuucccuaaugauuaauaauguggaacaucuuuucauaugcuuauuggcuauuuguguaucuuuggagaaauguuuauucaaguucuuugcucauuuuuuauuggauugcuuguuuuuuuguugauuuauuagaguucuuuauauauuuuagaaauuagacccuuguccagauccaugauaugcagauauuuucuccuauagguugccuuuuuugcuccuugauaauguucuaugauguacagauugaguauaguaucucuuauccgaaaugcuugggaccagaagggcuuugaauuuuuucagauauuggaacuuugaauuauacuuaccaguuaagccucccaaaucugaacuccaaaauguucaaaugagcauuuuuguugugugucauguuggugcucaaguucagauuuucuauuggagcauuuuggaucuuggauuuucugauuuggaugcucaagccugugccaaguuuuaaauuuugauaaaauccaauguaucugcuuugucuuuugaugguugggcuuuuggugucauguaagaguccauugucauaaauaaccaagggcauacagauguaucccuaaguuuucuucuaagaguucuaucaauuuaacuuuucuauuuagguuauuguuccauuuuuaaguuaacuuuuguguaugccgugagguagggucugauuucauucuuuuacauguugauguccaguuaucccagcaucauuuguugaagagacuuuuaccuauugaauggucuugguacucuucucaaaaauuauuuaaucauauguauagguuuauuucuggacucucaauucuauuucauuggccuacaugucuguucuuaugccaguaccgcauugcucugauuacuauaguaauuuuuguaaauuuugaaaauuagaagugacuucuccaauuuuguucuucuuuuucacuauuguuuuugacaguuggggucuucuugaaauuccaugugaauuugaggauuagauuuccauuucuacaagaaaaggcuguuggaauuuugacagaaauuguguugaaucuguagaucauuuuguauaguaucaccaucuuuaacuauauugucuucuaauccgugaacacagggugucuguccauuuauuuaugucuuuuuuaauuucuuucagcaauguuuuguaguuucauuauacaagucuuucacauccuugguuaaauuuauuccuagauccuuuauaugcuauugcaaaugaaauuguuuucuuaauuuccuuuucagauuguuaauugcugguauauauaaauacaacugauuuuugugugucagucuuguacuuuuguaacuuuacugaauucuuguauuagcucaucuguguguguguucauucuuugggguuuuuuuuuuuuuuuuuuuuuuuuaaacagaugggguuucacucugucaccgaggcuggagugcaguggugcagucauagcucacuacagacuugaacucuaggcuuaaaggauccucccaccucagccuccugaguagcugggacuccagguguguaccaccaugccuggcuaauuuuuaaauuuuucauaaagauagggucucaauauauugcuuaugguagucacaaauuccuggccucaagugaucucccuugccucuggcucccaaagugcugagauuacaggugugugccaccacaccuagccauucuuugggauuuuuauauauuggaucaagucauaugugaauagauaguucuuucagauuugaaugccuuuauuucuuuuucuugucuaacuguuuuggcuagagcuugaauuaugauuagcauugauuauccuugucauauuacugauuuuaaggagaaagcuuuuggucuuucaccauugaguauauguuagcugugaguuuuucauaaauguucuuuaucauguugaggaaguucucugcuauuccuauccuaguuucuugaguuuuuuuuuuuuuuuuuuuuuuuuuggaaagguguuagauuuugucaaaugcucuucugcaucaaguuagauaaucaugaaaccacuucguucuauuagugugauauauuauacugauuaauuuucuuauguugaaucacccuugcauuucauagauaaauaguguauaauccuuuuacuaugcaguuggguuuggcuugccaauauuuuguugagaguuuuuacaucuacauuaauaacgguguuagucuauaguuuucuuuugguaucuucaguaucagggcaauacuggccucacagaaugauuuagaaaguguuuccuccacuuuugcuuuuuggaagaguaggauuuguguuaauucuccuguaaauguuugguagaacucaucaaugaagccauccaguccuagacuuuucuuuggagauuucuugaaggaauguuccauguacaguugagaauauauauucacuuguuguugggcaguguguucuaaauaugucuguuaccuuuuggugguuuauaauauuguucaagucuucuguuuucuuacucaucuuuugucuagauguuuuauccguuauugaaaguggaauacugaagucuccaacuauuacuguagugucuacuaauuuccucccuuuaauucugugaauguuugcuucauuauuugguggcuuuauuguuugauguauauaauuguuauuuuuuauggauuggcccuuuuaucaauacaucaugcucuucuuuaucucuugcaucaguauuuuuacuuauuuugccugauauuaguuuugcuaccucacccucuuuuauuuacuauuagcauagaauaucauuuuucuuucauccuuugaauuucaaccuauuucuguccuuggaucuauaaugagucucuuguagacaguauauaguuggcuuuuuuucuuucuuuuuaaaaaauccauucugcccaucucuguuuuugguaggagaguuuauuuacauuuaauuagucaaaaugaaugauuugcuauuuugcuguuuguuuucuguaugucuuauaccuuuuuuuuuuuuuuuuuuuuuuuugagacggagccucgcucuguugcccagacuggagugcaguggcacagucucagcucacugcaacccccgccucccggguucaagcgauucuccugccucagccuccugaguagcugggauuauagguacucaccaccacgcccagcuaauuuuuguauuuuuaguagagacaggguuucaccacguuggucaggcuggucucaaacuccugaccuugugguccugcccaccucagccucccaaagugcugggauuacaggcguaagccaccgcccgcagccguaauauaucacauuccuagagacagucuuguacuguuuuuugcuccuuaucuccuucauuacuaccuuuuuaaauguauuuauuuuucuuuuguaguauaccauuuucauuccuuucucauuuccuuuuguguauauauuuagauauuuuuucagugguuaccuugaggaucacaauuaacaucauaaaccuccaacagucuacccugaauugauaccaacuuagcuuuaauacagcauacaaaucucugauccuauacagccucacuccuccuucccauuuuauguuuucauugucucaaauuuuauguuuauacauuguguacccauuagcauaguuuuauaauaauuauuuuacaugcauuugucuuuuaaaucauguaggaaauaaaaggaauuauaaaccaaaaauacauuaauacugguuuuaauauuuagaugugugauggacuuuaccagagauuugauuugguuuuauggcuucaaguuauugucuaguguucuuuuauuuccucuaaggauucucuuuagcauuucuuuuagggaaaguguacuacugucaaacucuuccagcuuuuauuuaccugggaauaucuuaauuucucuuucauuucugcaguauaauuuugcugauauauaauucgugguuggcagucuucagguuuuuuuugggguuuugcuuuuguuucuuuuagcacuuuaaauaugucaucccacugcuuucugcccucuaugguuuuugcugaaaaaucagcucauaaucuuauugaggaucccauggucauaagucacuucucccuugcuacuuucaagauucucucuuugucuuugccuuuuaacaguuugaauauaguguuucucauuguggaucuauuugcauuuauccuuagaguuuguugaacuuuuuggauguguagauucaugucuuuuacuaaguuugggaaauuuguggccauuauuuucuuaaauauucuuucugcucuuuucugucuucuuuaucuaggacucccauuguguauauuuugcucaacuugauggugucccacagaucucuuagacucugcucauuucugcuccucagacuguacaguuucacuuccuauuuucaaguuuauugccuuuuucuucuguguguucgcauaugcuguugaaaucuguuagugaaucuucacaguauuuuucagcaccucaauuucuacuugguuccuuuuuaaaguuucugucucuguugauauucucuacuucaauagaauauucuuuguacucuuaauauuuagcagccauuguucucagcauuuagucugcaaaguuuuggcauagguacuauaauuaucccuauuuaaccaugaguugauuguuuuuaguaaauaucuuaguacugaagaacugauuaagagcucugcuuaugagaguggagcuuuucagcaacugggcuuugucuucaaugugguugggcaaaaaucagucacaauggaagaaccugaagugcuugauauaucagagacaucuuuuuuuuuuuuuuuuuuuuuggagauggagucucgcucuguguugcccagggcggagugcaguggcgugaucucggcuaacugcaaccucugccucccggguucaagcgauucuccaaccucagccucccgaguagcuggggcuauaggcacaugccaccaugcccagcuaguuuuuauguuuuuaguagacaccauguuucgccauauuggucaggcuggucuugaacuccugaccucaggugauccauccaccucagccucccaaagugcugggagugagccagcgucagccacugcaccuggcagagacaucuuuuuuuuuuuuuuuuuuguccuaucugcacugauggugccuaauugucacuuuucuuucucaagaugugguugguuauggugauuuuaauuaauauucguauuuuuauaaccacuuuucauucucaccaaacuuagcuucucugaguuuagaaauguuccauuuguaauauggagcagauuggauuccuucuuguccuuauacuuuccuuauaaacauugcuauaauaaucauguuuguacacaauucccaaagaauagguucuuaaaaugaaaugugaaucauaauauauguguaauuuucacuugaauagcaauuuagacaaagauaugauucccuccugcuagcugggauaaucuugaaggucuuuacuaaaaugauagauauaauuuaaguagaucuuaaaggauaaacagguuuucuguaauuagggaggugcuaugggaauaguuaaaaaaaagagagaaguaauauaaaguucauaguaggauaagauacccuuuuguuuaaaaauaggauguuuauaaggaggacuaacgacaaauaaaauuuccaauauuuuauuauaaaauucuaaaaauuauauagaaaaggcaaaagaaacauacagugagcacacacucagcaccaagauucuguuguuacuaacuuuuugcaucacuugccuuaccauauuauuaauauguccauuuauucauccuccauccaucuuauucauuccauaauaaaauaaauuguaaaauaaaauaauucaauaugcuucacccguaaacccuucaguaugcauuucguuagaguuccaguauuuguguacuuuauuuuucuuuuaccuccaaacagcaucaggauagaauaaauuauuauuguacgauugaaugaguuuugacaaggcauucauucguguaaccaaaacucucaagauagagaacauuuccaucauaucggaaaaugcccuuaugccgcuuuccaggcagccuuuuccuuacccuccauccagcaugacuguuuugauauauuuuuuaaaccauaaaacccacuuuugcuauuaguuuucuucaauuagcccacccaaaugaaguaaaauuuuauuuuaguucugcuauuugauuuuuaguuagaucuggaucucugcauguuuuucauuuuaaguaguugcccugaagauuacauuuacguuguuacuuuucacaauuuauuuaggacuaauacuguacaauuucauguaaaauacaagaccuuugcacaaauaagguuuucauauaaccccucuaccgcuuguucuguaugcuguaauuuucauaucuuauacaaguacaagauuacauaaguaauuucauaucuuauacaaguacauagauaagucauuauuaaaugggaguaauuauaguaccuauucaacaaaauuggaauacuaaaugcaggaaacagugacagccaaauguuaacaguauagaaaauuuuaccucaacaaauagagaauaucaguaaagacauagaaauuacaaaaauuaaacaaauucaggaacugaaaaacaauaauuaauagaauauguaagcauaucauauauaucacaguauuauagauuuuccuuuaaccaaucauguguguauuuuaaagauacugaaaggaaaauguagucuuuucuauuuaacauuuuuagugcucuuuuuuuccugaauauuuccagauaaaauaggcauuggaacucaauccccagauguaucuuuucuacaguggguagcaccagaggucucuguucaguucuuuuagcauacuugggcugcuuggaaucuuuccuacauucauguauuucagaggucaacuagagauuugggcagaguggauacacagaauuuagggcucuccuuuggugccugcuuucugagauuuccuccuuuccuuucuagaucugugcuguccaguagaacuuucugccauuauggaaauguuguauaacguacaccauccagaaugguagccauuugccucauguggcuguucagcacgugaaauguggcuagugcaacugagaaaugaaauuuuuuauuuuaguuaaucuacauuugaguagucacauuuggcuaguggcaacuuuauuggacagaccauccuugcagaaaggucuguuagacagcacuguucuugaugcuguggucauuccaaacucagucgccauuucugucugggguuuagcagaccugcagaaucagaacaggcccuuuccuuagguaaaaauguauuauaaagaaggaaacucaaguagugcuuucccuuuuucccuuccaacuaugacugauuuugauugcucuccagagccuucaaguaauaguuguuuuguauauuuuugacuagaguuuauaaauacaucugugucugauagaacuacuccacuauuuaacagaagcagaacucuaccucuuaaucauuuaaauggugaccuaauguuaaggaauucauauuuggugcuuuguuaccauaauucucuuaccaaucacuaauuaaauauuuuuggcucugaaauauuuagcugauauagccaacuugaucucccauuucuuuaagaaaaaacuaguuaccuaauacuaucauuguuuagaugaaaaagcauuuggaagacuuauuuuucugggucucuuaauagaauuuuuauuuuaaacuaucauagcccugcuuacuaaaaguauuauuaaccuuuaguguuacugaaucuuaguaugcuaaauuugauauucccaucuccagucauguuagaauuuaauggaauucuucaaagcaacaaacuccuaucauugauaacuuguuugguauacuuugcuuuuucuagguaucugaaaagguuuaaagugaugaagaucaaaguucuaagaagcuggugccgucagauccuuaaaggucuucaguuucuucauacucgaacuccaccuaucauucaccgcgaucuuaaaugugacaacaucuuuaucaccggcccuacuggcucagucaagauuggagaccucggucuggcaacccugaagcgggcuucuuuugccaagagugugauagguauguuucagguguaccuuggagccugacuggcuuucucacauuccuuuuauuuagaauccuggcucugucagaguuuuaagugauauaaaccuuaagaaauucauagcuugaacucaggaggugauccauuguacuuaugagauauaggauucucuauauuugugcuucuuggaaucaucuuagagacuauugguaacauuacguuacaagaaauaaagugaacuuuguugauaaaaccuaauguaauagccuuuuuuguuguuguuguuguuguuguuguugagauggagucucucucugucacccaggcuagagugcaguggcacaaucucagcucacugcaaccuccacccaccggguucaagcgauucuugugccucagccucccgaguagcugggauuacaggcaugcaucaccaugccuggcuaauuuuuguauuuuuaguagaaaugggguuucaccguguuggccaggcuggucucgaacuccuggccucaagugauccaccugccuuggccuccuaaaguguugggauuacaggcgugagccaccccgcccagccagccaucuuuucauuacacacuguugauacuuaacauuauacacuauuuauuuaauacauacaguaugucacuucaugaaagaaauggaauuuauauuuaguuuuacuuucuaaaauuaaaagauaaaaauuaaauuuuuaaacauauaaaaugucuguuggauauauauguauauucaagaauauuggccaagcacaauggcucaugccuguaaucccagcacuuugggaggcugaggugggagggucacuugaggucaggaguuugagaccagucuggcuaagauggagaaaccccaucucuauuaaaaauacaaaaaaaaaaaaauuagccgggugugguggcgggugccuguagucccagcuacucaggaggcugaggcaggagaaucacuugaacccgggagguggagguugcagugagcugagauugcgccacugcacucuagccugggcaacagagcaagacuccaucuccaaaauaaaaaaaauaaaaagaauaaccuccuaacauuuugugaaaauaaauaugacaauucauucugaaaaguugguuuuaucaacuuuuuucuuagucucacucuucagaauuuaugaucuaucuaaaagaguguuucucaaccucaauacuacugagauuugggguuggacaauucuuuguugcaaggggcugucuuguacguuguaagacucuggggcagcauucccagccucuacccacuagauaccaguagcacgcucccucuguaccugccuucuaguuguuauaaccaaaaguguguccagacauugcuauauauggccccuagaagacaaaauugcccccuguugagaaucacuuaucuaaagaacaaggcugucccuuucagacuuuauauguuagaaacucaaagcuggaaaaauaauuuaaugccuauuuugauaagcuuucacucuaugaagaggauaucacaauuuaaaaacuugaggucuucauaaacauucuauuuacucccuccaaaaggugacaauaacaaaagaaacccauuaauuuuuaagugaacuuggauacugaguauuacuaggaaaaacacagaacaccaguuauuuguacaucuuucaaaaacaguguucuccuuggaauauuauguaacuaggguuaggaaugcuuucacauuuucuuauaauacauucacaagaagaaugggaaaagugucauuuaaagcugaauuucuuuuuuugccuucuucacaggaaacauuucuuugauugucuuuggcauccugaaaucucuggcccaauagaguuuuuauuuucuuuguugauuaaaugauagugugcaugccuguuucuuggaaaugccuaauaauuugagguaugcagaccuaauuuucuggaagcauuacaaaaccuagucuugugggaucacacacugugcucauaaaucagucuguauuuggguucuauauuuguguguguguguuugucuuuuugccuguaggaugucccucacuacauuucuugugucuguaguaggcuuauuuguguacugcaggugggaugguaaguaugugaagaaaagggcucuggugaguggccuuuggagacaauuacguuuuauuucauuuuuuaaaaaauguauugaauaucggguuuuucacugcaaggccuucuuaaaaagugaaacuaauuagauugaguguuaaugccaagaguguagcuguaaauauuaacccuacagcuaccauacauuagugggcacacaaguauuuugaucuuuuuaaacccaucaucuuaucuuacagauguaccauuauauuugcuuuguuccuugcauagugucuuuccuuuuccuucuauuuguuuucaauaugaauuauauuaguuuauuaucuuagccaagguuuuauuuuggcauauuguauaaagaaauucauuuuacacaguaaaucaauaaauagauccuugaccuuauuccaguuucauauaaaggccuugcaguggaagaucuuuuaugagauauuugauggaacagacugacugagaagauuuccuuccucuuuucucccccuuuccuuuuuucuccccauuccaauuucuucucucucacaggucaaccccucugcuucucaccccggugaguaacgucugaagcuucugcucgcauugagucugaaucguucuuuuaauuuaagguaccccagaguucauggccccugagauguaugaggagaaauaugaugaauccguugacguuuaugcuuuugggaugugcaugcuugagauggcuacaucugaauauccuuacucggagugccaaaaugcugcacagaucuaccgucgcgugaccaguguaagucuuccccuaacugauuguugaacuuggggcauaucuaacaaagaaucccaagguggaugacaucaaaccauguaaaagaggacaauaguggaaggcauacugagugaacuguugggguugggggggugguguugagguauguguaaggcuauugcucaugauacagugaaagauaaagaucaaagaaccacuaguuuauccuguacccaccuugcauucauuuaaaucuuuauuauguuuaaaaacacacccucauuaccuacuuuuuaacccccuauuaauucagcuaaacuccuguugucucccaccacauaggucagaguuaaaaguaauguuuuuaauucaagaugcuuugucaaauuaauuuguucacugacuuuucucugaaugacuugaguugauuuauuaaaucuuauauauuaguaccuaccauauuuaaggcauaaauaaauaccuuauuguaguuuaaauuacucaugguaguucaugucugcugacagagauauuuucuacagcugucuaauugaaaccugaaagguaguuguuaugauucauuuuacuuuaucacuacaugcuucauuaugcuacucuaaaauacauuuucuuacauaaccauauuaugccugaaaaaauuaacaaucauuucugcaucauccaauacccugaaccuguucagauauucucuccauuguuucaaaaauguccguugacaguguucaaaauaggcuccaucaagguccacaaaauauauuuuauuguuguaguucuuaaucuagaacuauugcuuuuacuuucuuuuucugcaugcaugucagagauuuauugagaaaauuagauuauuucgaggaauguuccacauucugaauuuuccucguggugucauuuaacuaguuuauucuucuauauuucuguaaggagaaguuuaccuuaaaaugguugggguagguuaacaauguaaaaauaauuuugucuuuuuuacucgcauucacccaagaguguacguuguuguuuuccagaggcuauaugauacugcacauaugauauugcagcagaguacauacagaagcauauaaaagaauucauuuguagggccgggcgugguggcuuaugccuguaaucucagcacuuugggaggccgaggcagguggaucccuugaggucaggaguaugagacuagacuggccaacauggugaaaccccaucucuacuaaaaauacaaaaauuagccaggcgugguggugcaccccuguaauccuagcuacuuuggaggcugaggcccgagaaucucuggaacccgggagauggagguugcagugagccaagauugugccacugcacuccagccugggugacagaguaagacucugucucaaaaaaaaaaaaaaauuccuuugucuuccauuaaaccauauauuuaaaaagauuacaaaaauguaaaacaauaccagucuuaucacuaaauuuuucuuguuuuggaaaauacugacuuuuuaauuuuaaauauauauuuguaacauaaugaguuauaauuuuuaaugaauuaacauuuuuaaacuuucucagguuuaccaucugccacgguaaauauuaauagauguaacacacauagacaaaaucccucugagguccccaauaauguuaauuuuaagaguauaaagggguccugagacaaaaguuugagaaccacuguucaaaagucuugauaaaauuuaggcuaaacauuuuuugcaaggauacuuaauauguggugcuguauauguuauauugcaccgagaagcucauaguaucucauuauuucauuuuuagugauguaauuuaauugaauuuugauauagaagauguaauuaucaauugcuuauuuagauuuugauagcugaacagaauggaaauguuuauuuuuaauuuuuuauuuauuuauuuauuuuuugagacggcgucucgcucugucgcccaggcuggagugcaguggcgccaucucggcucacugcaagcucugccuccuggguucacgcuauucuccugccucagccucccaaguagcugggacuacaggugcccgccaccacaccuggcuaauuuuuuguauuuuuaguagagaugggguuucacuguguuagccaggauggucucgaucuccugaccuugugaucugcccaccucugccucccaaagugcuggaauuacaggcaugagccagaaauguuuauuauuaaaaacugauaggaaacauuuugcuuuagguagaccaaauuuuaccucuucauaaaggcuugggagaaaucuuuggagucaaagauuaauuauaauuauuuauugcugugaauauuccuucaauauccuuguuguauauuuguaugugauucuguuguugauggauauggagcuacuuuggacaauuaguuuaauuucauaugaaguuugagguuucauacccaguaaaaaugacagcuauuguuuauggagaaaguguguaacucucaaguuacuucuggcuuuguaauugggaugguauuuugucaguuauuauuauuagguguaugucuacaagugucuggccugaggccuuacuguuaaauuuauuaaccucuucuuaauacucacccagauucuaauacacaauauaauuguaaucccugaagcacugacucucaauuugggcugaaugggggcaggagaaauuuuuuuaugccuucagaugauucugauaaguacccuaaucauuauucuacauuuaugcccuuagaaagcucaucugcuuugccuuucagaguucuguaucaucauucccaguucaugucucuuauuauuccccuuucuuccccugaugcguuguaauuuacauucucucuuuuuuuuuuuccuuugagcauagggucgacuguuuauuggguaauuuccuccuuuauuuuguuuaaaauuguagaaaacuuaagagguauauuugauuucuuguuuuuuacucgcugcuuccacuacuuccaguuuauaagguucuugcuucagaauaccucuuagaugcaagccuucuucauucccauugccacaacucugauuucacaucuuccuuacugcacaccuugcauuauauuccagaaguaauuuacauugugaauuuauuuuuuuauuucacuuaaacuuguugagcuuucuugcuauccuuucuugguauaaggaacuuaagauaccaguuugcugauaucagagcaaguacaaauucuuaaucuuugcuauucuucaucuucauccaagcacucuauuuuaguuaaaucaguucucuucauuaucucgcacauaugccacauccuuuccuguauuccuauccauuuguaaauguuauauaauacuguaccuccacuauaagcuuuucugcuauccagucaauccauauacuuaacggucuuccuccaugacauuuuaucugauugguuucacuguauaaugaucuuugccuuuucugagcugauucuucucaauugauaugaaugauaaaauuuuguuuauuagugguuauucuacuuauaaauucauaaauucaauuaauguacuugcuuauuauuuuuauugcuuuauauuccuuaaaauauuuuaaucuaguacaucuguauaauuucauccuuaucuguagcacuauccuaaauacaaaauaaaucucagugccaguaaaugcaacauuuucugaaucccugcuaugucccaugcccagagcuugauacuaaguaaaggugaauaaucauauucccugucuucagaaaacuaccucuaauauagaagauuaauauguaaacaaagaauuauaauuacauuauggugaguauuguaauggagacaagcacuaaggagaguggaggaacaauggauaacccugcuauggauuagggaagauuucacaaaaagagcuguuguaugaacugucaaaaagagaagguagaagaauggugagaggccauucuaagaagcaggaauaggauuuacaugaaugcugagaugccaaacaccguaguacaauggaaggaaaggcaaauugaucaaauagagugaagcuguugucuuggacaaaucaauuuuugauccaaggacaaaucaauugcuacuuaguuucuccugcucccaaauccugucucaucucagagcagagaguuuccgguugguaauuaagaggcaaacuucugacugcugauauguguuuuuacugcuauuauauuguuguauuuuaauggugaaagagacuuuaucuguuuauaggcuuuuggaaggagcaagaggaagagagagagaaguagaaaucaugguggguggugguggauaggguagaguaauauccaggauucaaugggcuugugacaugguauaaugguaagucuugauagggaagguuuucuccugagguaagggaagcaagauggguuuuggaagcaaagucuuggguucacauccuugcccuaguuauugccauacgaucuugagcaauucacuuaauuucucuguacuucaauuauuuuguucucuguaaaagagauacuauuacccucuuacagauugcuuagcacaguagauaguacugguacugauaguaggcugugguuauugucuaugaaauaugaguugucaucuucuuggggggguguguagaaugaaagauggccuuuaaggaugauaaaggcuuaaaauaacaucuaugaaacuuugaacugauuaggaaauaauaauugugaagcagcaccaggcauccagaaucuuccuuuuuaguauugauaaacacuauuauguaaacaaugaauauauuguuuguacgcgugucuauguguaugcaaguggaaaagggcaaauuuuuaccuauuacauacuucuuucuugugaauaaccaauaauaggcugggccuguaggcucacgccuguaaucccagcacuuugggaagccgagguaggcagauugcuugagcucaggaguucaagacuagccugggcaacaugaugaaacauuaucucuacaaaaaauacaaaaauuaguuggccgugguggugcauaguuggcuguggugaugcaugccuguagucccagccacugggaggcugagguagaaggaucgccugagccggggagguggagguugcagugagccuagauugugccauugcacucgagccuggacaauagagugaaagccugucuuaaaaaaacaacaaaaaaacccacaauagcuuagauugcuaaaguaguccucaguuuucuauauucugaauucuguguaucaggguuugaagaauagaauagaaguuauugacauaaaugaguuagguuucauaggagaaaaguuaauuuuacuugguguauuuucuacugaauaaguuucaucuguguauuugugaauauuuauuaauuauaaacugugaccaagcacuauacuagguauuggggauauaccaagucaaaaaguugugccucaccuggaguuuacauucaguuuuguuaaaaaaaaaaaaauguugauagaagucaguaaguuggcugggcgugauagcucacgccuguaaucccagaacuuugggaggccaagacugggggaucacuugaggucaggaguuugagaccagccuggccaacauggugaaaccccagucucuacuaaaaauacaaaaauuagcugggcaugauggcaugugccuguaguugcagcuacuugggaggcugagguaggagaaucacuugaacccaggagacagaaauugcagugagcugagauagcgccauugcacuccagccugggugacagcaagacuuggucuaaaaaaaaaaaaaaauugauaacucuauuagagugauaagguuugugucuagaauagaugggagauaaagggugagaagcugaacuagguuuauuguuacagcacagcaaauucaaucauuucuuuuugcccgaaauguaugacuagguacuaauacaaucugacuuuuuuauuaaaacauguaaugaaguaauuagggaggaaauauaagccaguagauucaaaacugaggggaaaaauaacaaaaguuguaguggaucaaaguagauuuguagaucaacaugcuauaugagugauacugcuaaacaguaacagguguuucuguuaugugacuccugagccuuaauuuccucauaugauuaugguagucauaacugccaggccuacuaagguugcgaaaaacaaaucuguugaaauuauauaagaaaguacauuugaaaaaguugagaaauauauuuguuguauuugacauauaacuagauugacucugaaaugucuucuaucucaauagauucuugauguuucagaaggguuugacuuaggcuuucugcuacaaaagauugggaggauaguagcacuaacuggcuuucuuaaguguaaugaggcucauauuugcacagaaguuacaaaaucugugauugugauauauucaaggaauuuuauuuuuaaaaaugccuccaacuuuucaauaaaaaaguaaauagauggcaaauuauucuguguagagaugaauaucuagauauuaaaacuuaaaaguaugauucugauuacauaaucaagucauaggcuuucaguaguccuuaaagucugcuuucuauccuucagugaauuuuugaaguuuguuuauagaauauuuugugcuuaucauauuaaauauuagaagaccuuuggggacuugauugauucucugcauggcauaacgugccaagucagaguauuaaucagaaauauuuuuuuuuuguaugugcauacuaaaaauguacauuuagguuuuuuucuaucaguguuacugaauauauuauauaccuacccaucuaaaguguauaauucacugguuuuagcaucuucacaguguuaaaagaaaaacuucagccaaauuaaauuuaaaggcguuuaauugagcaaugaacgauucgugaauugagcaguccccagaaucacagcagauucagagagacuccagggaugccucauggucagaacagauuuauagauaagaaaaagggaugugacauacagaaaccagaugugagguacagaaacaacuggauugguuacagcuugcuguuugccuuauuugaacacucagcaauguaugagugguugaaauacagccgugagggcugggcgcaguggcucacgccuguaauuccagcacuuugggaggcugaggcaggcagauuaccugaggccaggaguuugagaccagccuggccgacauggugaaaccccgucucuacuaaaaauacaaaaauuagccaugcgcgguggcgggcgccuguaaucccagcuacuagggaggcugaggcaggagagucacuugaacccgggaggcagagguugcagugagccgagaucacgccauugcacuccugccugggugacagagugagacccugucuaaaaaaaaaaaaaaaaaaaagaaaagaaaagaaaaaagauagaaauuuggcuguugggauuggccaagacucagcaguuguuacgggcauacuccuaaguuagguuuucagucuugucuaccuguuaaguuagguugcaauuaguccacacagacucaaauuagaaguacaaaguccuucucgggccauauuuaguuugcuuuaacaacagguaugugcagccaucaccacagucaacuuuagaauaauuuuaucacaugauaaagauauucugcacccuguagcaaucacuuuucuauacaaacauuccccccacuccugugcaaccccuaaucuguuuaugucacuauagguuuuucuauucuggacauuucaucuaaauagagucauuuaauauguggucuuuuauuacuagcuucuuucacuuuguauaguguucucaagguucguccauguuguagcaaauguucaugcuucauuccucuuuaagucugaguaauauuccaguguguguguguguguguguguguguguguguauguauaaacacaauuguuuagccauuuaucgauugguagacauuuggacuguuccuaccauuggcuguugugaauagagcugcuacgaagaauauucauguacaaguuuuuguuugaauaucuguuuuuacuuccuuuagauauauaccuagaagugaaauuaccauguguauaugcuaauccuauguuuaaccauuugaagaacugccagccuauuuuccaauagcuguaccauauuacauucccaccaucaguguaagagaauugugaucucuucauauucuugccaauccuuguuguuauuauuauuauuauuauuuugagacagaaucucacucugucacccagacuggagugcaguggcacaaucucggcucacugcaguuuccaucuccugggcucaagugauucucccgccucagccuccugaguaucugggaccauggacacacaccaccaugcuggcuaauuuuuuuguauuuuuuguagagacgagguuuugucauguugcccaggcuggucuagaacuccucagaucaagcggucugccugcuuuggccuuccaaagugcugggauuacaggugugagccacugugccagccugugucuucuguucuuaaaaggacagcagucauuggguuaaggacccacacugcuccuggaugacuucaucuuaacuaauuacuuaacuaauuuuuuuuccaaaaaaauucauauuguaagguacuagagauuggaaccacaacauaucuuuuugagggacacaguucaaccccauaacaauucauggguucauucagcaaauauucaagucucuucuauguuccagacuguuuucuagauccuagauauugaauauuauuguuaugucaaacacagucccugucucuaaagaacuuaccaagggaaggggaacaaacaaauaaagcaaacaguuacaauacaauagaaaacacuuauuuuagggauagguacuuaaugaaagcauguaagagugguaccuaaucaaguuuggacagguuagggauaugguguuaaagaauuagggaaagacuaagauaguguuauauaugaagaugcaugauuuugaguaucuugucaaguuuggaaguaggaaaaggacaaggcaagggauaagggacaaaaggaaagcuuagacuuuaauguagagcacugaggggacuguuuuaaaaguggguagcuaucauguaugucaacaccuacagacuuaaauuuuagaaagauuauuucugacugcagaguggagaauggauuucugaggaaagacuaaauguugaaaacucaguuaaaaagguauugaaguaaucuaagggaaaugacuaauagucugaaauaaggaguuguaagagagaaggccaaaguggauggauuagagagauuuuguuugugaauuagauuugagcuaaccucauuuguuuuuuuccacuuaacauuuaugaaaauaaaugcucauguacauauauauacuuaagaucaaacaauaucaaaccugauugugagguuaaauauauaacuuuagauuuggggacuauaaaauuuauaauuuguauaugaaauguuuuauauauuuuauuuacuaacuuaccaaucauuacuuuuuuugagacagagucuuacucugucuuucaggcaggagugcaugguucagucuugucucacugcaaccuccgccucccagguucaagugauuuuccugccucaagcuuccugaguagcugggauugcaggcucccaccaccaugccuggcuaauuuuuuuuuuuuuuuuuuuuuuaaguagagauggaguuucaccauguuggccaugcugcucucgaacuccugaccucaagugauccgcccaccucggcccccaaagugcugggauuacaggugugagccaccacaccuggcccauucugucguauucuaaauggaguagcaaacuaugcuucuuggccaaauucagccuggugcccauuuuuguacagcccaugacauaaguaugguuuuugguuuuguuuuuaauuuuuugagagaaagucucacucugucaccgaggcuugagugcagugguacaaucauagcucucuguagccuugaacuucugggcucaagugauccucuugccucagccuucugaaucgcuaggacuacagacaugugccaccauguccagcuuuuuuuuuuuuuuuuuuuuuguagagguggggucucacuauguugcccaugcuggucucaaacuccuggccucaagugauccuccuacuuuagccucccaaaaugcugggauuacauuuacgaguaccaugacuggcugguuuuuauauuuuuuaauguuuggggaaaaugucaaaagaagaguauuuuguaugauacgaaaacuacaugaaauucaaauuucaguguccauaaauaaguuuuucuggcauacagccacacucacuugcuuccauauuauuuauggcuguuuucacacuauaauggcagaguugaauaauugcaacagacuguaugauacauacagccuacaauauuuacuauuaggcccuuaacaggaaaauuuacuuacuccuguguuaaacauaugucaccagaacuuuguaaaacauguuccccuguagaguccuguaagaaauuacugaucuacgaaaguaguggugauguucuucuauaagaaugcguuagccucuguauuuguaaagacaugagaaucuuggugcaaacaaguagcuacuuaacaggucagaaaauguguaggcagucuuuucucucuguuaagaguagaacuaaaacuuuaacauuuuuauuugccaaaugcaaacucaaaagcucaguugagaagaaaaucuucuuaaaugaaagaugucuuugauaguaaguuuaacagaaccuggaaagacuggugucacuguuucuguauucucaguauaguguuuaaccuguuuucaguuguucagcagcuuuuguuuuuuauuaaacugagacaaaaaucauauaucauaaaauuaaccauuuuaaccauuuuuaaguauacuguucacugguuuuuaguauauccacaauguuaaugcaguuaucacuacuaauuccagaaccuucccaucauccccaaaaugaagccccauaccaguuagcagucauuucccauucuccucuccaacccauccccuagcgaccacuaaucugcuuucugucucuggauuugauuuuccuauucuagguauuucauguaaauggaauuauacaauaaguggcauuuugugucuggcuucuuucacuuagcaaaauguuugcaagguacauccaugugguagcauguaucaguacuuuuuaauaguuaaauaauauucuauugcauauauauacuacauuuuguucuauucagcagguuuuauuucccuuuaguucuuuaguuucuuccucuuuuucucaauguuaaacugcuugacucuauagcugccucuuaaucuggagagagauugagaacaauguuuuaguccauuugggcugcuauaucaaaaaugccauaaacuagguggcauauaaacaacaaccauuuauuucucacaguucugaaggcuggaaagcccaagaucaggugccaucagauuugguaucuagugagguucuguuccucauagaccggacuuucucgugucauuuucacauggugaaagagucaaaaagcucccuccggacucauauuauaagggcaguaauccauuucacgguucugcccucaugaccugaucugcucucaugaccugaucaccucccaaagaccuucaccucuuaauacugucucauuggacguuagauuucaacauaaaaauuuuagggggacacaaacauucagacuauagcauacaugaaggaggaaauauagagugucuuaaaagguauuguccuagagcuagguuuauuauaucguuguuuguauucauugugcacagcacaccguaggcacucauuaauauuuugaagaauaaaugauucaaaguaaugucaaauauagucaaaaucagacauuauguauauuugggagaguuguauuuacucugugaaagagaagugaaauuugaggugaccuucagaauuauccuacuaaaaugaaguugaauagcagcaaguagaaacugauguaccuauaaaagcaauauauuuuauauuaauggcaaaaaacacaauuacuuuugcaugaaccuaauagaauaggaaaaacuauuuggugcaaauaaagcagaaaacaauaauagguagaaaggcuaucccaggacuagaaaggcucuucuguagguucucaaaucucaguuguaauuucugaacaacuaguuuaacucuuuccauuauggggcuaggucuguauuuuauuuuauuuuauuuuuuuagguauuuccccuuaauuuuuacccuauaauuacuacucucacuuuguucuuucuucccugagacuucauagggcagaccaaauuguaauuucccuugguguaguccguaaaauguuucaagacaguuuuucuaauguuaggaguccuuuuuugucaagacccaucauugucaauuuguaaaacuuguuccuuugaauuucuugagggaaggggcuuauaugcauuauuggaagagggagaugcucagcaacuguuuucuugaucuucaggagguuacauaagaaggaagagaaacuguaauugaacauaagaacuuggcaacauuguauaauauugcagaggccuuggugguaaagguuugagauucugucaucugagaauuuuugagaagggaccaagacagcuaacagacucaagugauuuuauuuauuuauuuauuuauuuauuuuuggagacggagucucucgcugucgcccagguuggaauguaguggcaugaucccagcucacugcaaccucugccuccuggauucaagcaauucuccugccucagccucccagguagcugggauuacaggcacccgccaccaugcccaacuaauuuuuguauuuuuaguuaaaacggggguuuuaccguguuagucaggcuguucuggaacuccugaggucaagugauccacccaccuuggccucccaaagugcugggauuacaggugugagcgaccacgccuggcccaggcuugagugauuaguucagcaugguaucaguaauccuuuacacucuuuaaaguuauugaggaccccaaagagcuuuuauuuacuuguguucuaucuacuuuaccguauuauaaauuaaaauagaauuugcaaaagcauuuaaaaaugauaaauaacauaagcccuguauauguugguaucaauaacauuuuuaugacaaauaacuauuuuccaaaacaaaauuuaaaaacuuacugagaagaggggcauuuccacauuuuugcaaaucuaaugucuagucuaaaagaagauugcuaaauucucauaucugcuuuucuguucagucuguuacaauaugcuguuuggguugaaguauaugaagaaaaucuggccucaugcagauauguaguugcaaaaggaaauacuuuauagaccacaagaaaggauauugaggacccugaagggucuuuauaccacaccuuugagaaccacaguuuuagcaaaccaaccaugcaaagugcaguccucagaccaacagaaucagcaucucagggugcuuguauuuaguguaaaauuuuggccccauuccaggccuguuaaaaucugcauuuuacauaguccaagggugauucauauguacauuaaaguuugagaaguaugagcugggucaguaaucccuuaaggucuuuuucaguuccauguaccuuuauuugguuaauuaaauaaaaaguaggcuauauaguauaauaccaaaauguuauuuaaauaaacuauuguucagucauucauguaaacuuuuaaguagcauuauaaguaaccaauuugacuuaaaaauuauauuauuauagcauuuauaugcaauuuugcauuuuuucugccuuuuugguuguugcuuuuuaaaaauuuucuuuauuuuauuuuauuuuuuuuugagacggggucuugcucugucgcccaggcuggagugcaguggugcgaucuuggcucccugcaaccuacgccuccuggguucaagugauucucccgcuucaaccucccaaguaacugggagggacaauaggcaugggccaccacagccggcuaacauguauuuucugguagagauggggguuucaccauguuggccaggcuggucucaaacuccugaccucuagcaauccaccagccccggccucccaaaguucugggauuacaggcgugaacgaccacgccaggccugguuguugcuuuuuaaaaaggaaaaccgguaaaucaagcuguagaaaauguggaauaaaaaacuugaagaguaaguccauuggaacugugcuagaauccuuaguuucuaaggaugccgcagguggcaugcauuugugcuuuauuuuuccucuaagcuaugaaaauuuaguuguguaugcucuacaguccuuaauucugcacuguccauuaccauacuucuugccuaggaaauacugucuagauuuuaccaaucuccauucccaucuucuggcuucuaguaaagaauaaaaagggcuguggucuuuguuacuuuccuaaaaguuuucuuauguuuugggugcugagauaaauguggaggguuuaaauaaguucuuagauaauauaauuuauauaauuauauaagcaaucaugaugauucuguguugaaauaggccuugaaauauuguaccuucucuuuuuuuuuuuuuuuuuuuuuuugagacggagucucgcucugucacccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucagccucccaaagugcugggauuacaggcgugagccaccgcgcccggccuguaccuucucuuaagucagcuugcaauuuaaauuuuuaguuaguaaauuuaacuaauuuuaaaauauguuagugucugucugcuuaacuauugcauacuuauuaaagaaacaugcgugguuauccauuggaagagaucgauccuagggcuuccugauacaaacacacccacagaccccagccacucuagauuucugguuuucaucccaggucuauuguguauacccuggcuauuaguaaccaguaaaccacucucccccuucuguagauuuaguacuaacuuagaaaaaggauacaaagaagaguuuguauuuaacagcucaggauugccuuuucagguggaagaaauaggcucuggaguuggaucugcuuccuuucaaauuccggcaaugucauugccuagcugugagaccuugagcaaauuauuuacuucucugagccuaaaguauuugugaagauuaaaugagaaaggcaaagugccuggcauacaguuaucaaucaguaccuaauagguaucaccauuaucaucaacaucauuauuauuaauacauauuuaguagugaaauaaggugucucuuuuuauguuaaccagugacauucagcaaauugcauuaauuuaaaugugcuuccuaagugucacauaaaaucaagcuuuaaaugggagaacaagcuaacauuuauuuguaaucuugucgaucaccuugcaaagugcuuuacauauacuguuuuaaucuuuuauaucaugauaaguagauaaugucuucauuucacagguaagaaaauagacucagaguuuaagcauuuugccuaaggacaugcaggagaaauaauaguagucagaaaccaagguucuguuaacaugauacuaauacaaacauuaacauuauuuuccuuuaccucuuuuuuguuuuguuuuuaaccuguuuucuagaccgcaaggaaaacugaggguaaaaaguuuaggagaugugaguaacaaaagucugguacugcaguuuugagcucugaguaaagguucauucccccuauuuaacagagaaaaacuuauuaauuguaugcuauacuuguagucuugacccaguugucaugaaagucuaugccacugauaaugagaagauccaaguaaaaguaggaauauauuuagcaccacuuuggugugcuuuuaaaauaauaaaaaccguagcaggcaaugauaucaacuuuuuauaugaaggauagugcguuugaacuggagcaguacacaagcuuucauguauucagagaguaacgagccuuggggaaucgugaguaaguuaauuucuuugauagagcuagcuugauuugguagggaguucaaagaggcuuguuuuccaaugggaucauaggguauguucaaauuccuguaaacuaaugguucauaacuguaagaaucuggcugaauccagcccuauaacaaccaaguuagaaauaauggggauuuuuaauuacuuuguuuguguaauuugacuuugucacugauuccauuagcuuuuggauugcaagguuugaacauuuugucugggaaaaaacagaacuaaagccauuaggguaaaauuccuuuuaguuuuuauauaacagauugcaauucacccuaccuuuuuacugaaacaagugagacugauuccugauuagaugguguuuaaaaaguugaaggaaacuuuguauuuauuucuuuagcagcuagaauuuguugugcuaucagugaaaaucuauuggaauuagcugaacugguuccuuaauaaauuuuguuucuaugucuauccagcaaauuuagguuauaauuguaaaagaaaaguuccaguacuagggggcuauaucuuaggaacauuuugcaugauuuucagaagcauuucauuauucugcugugauuuaauuaagauuaaaggugguagcauucccaguguuuuagguacuaaauaauaauuauuaaaucauuauuucagaauuccucaaaaaagcugaccuuacuuaccuacccugaauauugaucuguaauucacaaggcgguagacuacagaauaaaaacaaaggauauagaaagauuguuuuccauauuuaaauacagcaguacugaguuuucugauauacuguaaauaaccuaaaugcuaaaggauucauauagauacuuuguaauugcuacuuucucuaauggauuguauguauauaugauuugagguauacccugaaagaagcauaagacucaguugacugaaaaaagggggcagaauaggaaaaguauucuuguugguagaaguguucacuaaaguauucagugaacaaguaaccaguuugacugaacuuacuuuggggagauuggguaaagauguggguggaaguuaaauuaugauuuucacaccacuuuuaaaagcacaauaacauggaccagaaauaacauuaaacuagaugcuggaaaaucuggauucuaguuuuuguuuuaccauugauucggcccguacuuaacuggaguauaaauuauauuuaucuucuagguggugaagguggugcaguguaucuagcagauugccugauagcuguuagacuagaugagacacuccauagucaacuaguugaauuaauggauuaauucucuuuuuuuuuuuuuuuuuuuuuuuugagauauagucucacucugucguuaggcuggagugcaguggcaugaucuuggcucacugcaaccuccgccucccagguuuaagugauaacuccugacucagccucccgaguagcugggacuacaggcaugugccaacaugcccagcuaauguuuguguuuuuaguagagacgggguuucaccauguuggcuaggauggucuuucuugaccuccucgugaucugcccgcuucggcccuccaaaguguugggauuacaggcgugagccaccgcgccuggcuggcuaauggauuaauucuaacuuugacauagaauuaacauuucuguuauuugaacaaggaaggacucuuaaucugguuuauucuagaucugugauccuguggucauuuaguagguguggagaacuauuaaccguuuuugagcagugugauuaugaguuaaaugauaccagaugauuggaaaugguuaaaugucagaugcuuaaauggagucagaugguaggagcuagccacaauguaaaacacaaauuggagaugaagagaauggaaauaugaggcccaucuuaaacuggucuaggcuuaaagagaugagguauuagaaaucagaacuuugaugguuacuuuuguaauacaaaaacaaugacuugugaggcagcaaagaagccaguaaaaacuuuuuuuuuuuuuuuuuuuugcuuggucagagaucuuuggcuguuggagaagaguaagaauacuagucacaaaaccauuucccaguuguuuuuaacuuuaucuuuguguuaagagcccauagagaauaauaguaguacuuaaauauugugggggaagaagcauccaaugaugacuaagguuucuucucuggacuauggaaauaaugacacgauugaaagaaauaggggaaauccagagaaaggcacugacuuugagagaaagaggaauaaguuuagauauguaaacuguuaucugugaaugguacuuuuguuguaauauauugaaaacucuuauuuugauuuauagaaaagguugcucuuuauagaaucuagauauuugugccuacaucguaccuuugucuccucaagccccccaaagcccccucaguuugguuuauuuguugccuaauagaguuuuaaaacuacccacaucuuuauaucugauggaccuuugaggcaggacacguggcacuuguuuucuagcucuuucauuuagccaagcaugguccuacacaggcuugcucauacaguuaaguuagagguaggcugcacuuuugcagcacacauugcugcauuucugagcaauaccugacauccuagacuacuuaguaguaacaaauuguguugagccagagauuagugguaguugcuuugagauagcuuguuagaauuaguagcauuucuaaccuuuagauguauuacuuccaaacagcuuccaagccauuaucuuauguacuguugguaauugaagccuuagcauucacugucuugaucaggauucaagcuuacaaaauuacaagggagagaggacuuuaaucuguuacccauuacaacaaagcaaugagcaaugcuguuucuacaaucuuuguuaaugcccugaagaaaaacuuucccuuaaucacuaaaauuaaaguaguuuuuauuugggucuaugagaucuuccuggcaaauggaaugucuuaauuuugagacuuuuauaggagggagaagaagaggcaaaaaauuuguaccacuuguguacauaaauacuguugauuuuuuuuuauuauaccuuaaguuuuaggguacaugugcacaacaugcagguuaguuacauauguauacaugugccauguuggugugcugcacccauuaacucaucauuuaacauuagguauaucuccuaaugcuaucccuccccccuacccccaccccacaacaggccccggugugugauguuccucuuccuguguccauguguucucauuguucaauucccaccuaugagugagaacaugugguguuugguuuuuuguccuugcgauaguuugcugagaaugaugguuuccagcuucauccaugucccuacaaaggacaugaacucauccuuuuuuauggcugcauaguauuccaugguguauaugugccacauuuucuuaauccagucuaucauuguuggacauuuggauuaguuccaagucuuugcuauugugaauacugccacaauaaacauacaugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacagucccuccaacaguguaaaaguguuccuauuucuccacauccuguccagcaccuguuguuuccugacuuuuuaaugaucgccauucuaacuggugugagaugguaucucauugugguuuugauuugcauuucucugauggccagugaugaugagcauuuuuucaugugucuuuuggcugcauaaaugucuucuuuugagaagugucuguucauaaccuuugcccacuuuuugaugggguuguuugauuuuuuucuuguaaauuuguuugaguucauuguagauucuggauauuagcccuuugucagaugaguagauugcaaaaauuuucucccauucuguagguugccuguucacucugaugguaguuucuuuugcugugcagaagcucuuuaguuuaauuagaucccauuugucaauuuuggcuuuuuuugccauugcuuuugguguuuuagacaugaaguccuuacccaugccuauguccugaaugguacugccuagguuuucuucuaggguuuuuaugguuuuaggucuaacauuuaagucuuuaauccaucuugaauuaauuuuuguaugagguguaaggaagggauccaguuucagcuuucuacauauggcuagccaguuuucccagcaccauuuauuagauagggaauccuuucccuauuucuuguuuuugucagguuugucaaagaucagaugguuguagauaugugguguuacuucugagggcucuguucuguuccauuggucuauaucucuguuuugguaccaguaccaugcuguuuugguuacuagccuuguaguaauacuguugauuuuuaaaaaauguucugugaaagaguaguaaaguagucuaccuuaauaucacugccuuuuaaauuaggugaacagaggaacuauuaucuccacuuuaaaaacgaauuuaagggauaugguccaggucaugcaaacauaguaugugauggauugaacugagaacccagccccaguauugugauucccuguccaguguucguuuggcuacauauucugaguuuacacuuuguucauugaacucaaucccuuuuuucuuuuaaaguacacuuucaaaaugauuggaggaagggaguguuuuugguaaauggguuucuaguguacauagaguuaagcauccaagaaagguuuugauagguccaggagauagaaacugugcgcaaaguagguggagcauugagcaaguaaaaaucccauuuugcuugucuaggaucuauuacuguuggcagagaagcagaaggaauauuaacagaauaguuuuccugcuguugggcaugcaguuuuguccaucuagaauaaaucuguuguuggcugaguagagcaaauuccugucugagaguuggggaagcauggcuaguguuaaacaagaaacuguguuucagucugacuuugaugucugccuuccuuaugcugugggcugauguacaucagagacauuuuuuccuucauuuuccuccaauaagaaaucuguuuugccuuuucugauggauauuaaaaagaaagauuuuugcucaguauuugucaucauaaauucucauugcugcugcugcccucaaaaggauuguauaaaugagguagguaagaauuuccaguauauguaacaguuuauauuguagccuuuuuggugauauugguagaaaguuuccaauauugaaauuguuaacuuucaguuaaaguauugaaauuguuaacuugagaaugcuuuaaaaauauuuagaguucuguaauuuagugaauuuaugguguauucugugugaggaggggguaggcuuuuguaaauucugaaugguuagggaaaaguuuaccuuuauuaagaguuaauguuaauguuacccuacgacauuugaagcaucagcuuuuaagaagcaagugcuggcaauucuuaggaucugaaagauugcgucagagaauucuguguugugacucacuuuuauuuuucuagcagauuaguuggcaaaacacaguauauagaauucaaaugagaagucagccuauaaaaugugcauauguuuuugugggguuuuuuuaguucaaauaauacaacauaaaauuugauaaacauuugucuuauaucggacucucaaugugcuauuauagaguuacaguuguucauuuuuuuguaccccauuuaaaauugugcagaaguggccuuuguguuuuguaaugaguguacaauagauauucaagaaauacuuauauuuaaugaagaaaaauaagcuacugucccaugucaaaaaacauaugacacuacugccuaaagauaacucuugugaauuagaaaaguaagagaaaaauaucuguagagccagugaguuguuggcucuggaggaguggaaugagagggcuguauguccuuaacaaacucuaguuuuguucuguguaagauaguaacccaauuuaucuagcuuaguucuuuuuucuucuuuuaucaugaaaacaucuuguuaucauuacuuuguucugucuggugcuuaaaaucguguuuaagaauaaucuaguucaccuuucaaaaauuaucaguuauaaaaauuacauugaguucucaugucuuaagaacgagaaaccuaugaguacauuuuaaaaacuguaacuuuguauuuauuuuaaacagcuuucuauuacaugucccagaugacuuuucugugggucacuuuuaggaucagugagguuucauaaucauuccauguacacauuuacuuuuaauauacaauaccuguauaugcuugcuucuuaaaugauucagaauaccucagcuagguauuuuaauaauccuggcuuauugaugguugcugacugguaaaauuccuuguuauauuuuucaguauuuaaguggguagcauuaagcagucuuaaucuuuuaauaccagcuacuggacugguaaggugugucucaguuuuauuggcuaacuuggcaccuaugguacauuuuuuaaggcaguaguaguaucuaaauaugugguauagcauugguauggaauuuucuauacaaaacucuuggcuguagguugaaaaagcagcauaaccuaccaaauuuaagguuguauuaugcacaguuauugguuuugcuauaucuuaauaucuuuugcgcagugaguauuccuauuuguaaagucaugaauucauauauguuugcagggauaggauuaacaagaggauuauuauuaaggauaaucaaggaugaaagcagguucaagaaaagauuuuccuuccuuuauuaucuuuggugauugccuuuauacucagagguagccuugggucagcaaacuuaauacuucaaggagcuuugaacccagauacgacauuugaauucaguuggacagguguuaucauuauuggcuagacaggaaaccugaagcucagaacuacuucuacuuguccaguucacacugaaugucuuuuauuguuaaauguuuuuguccuuucaaugugccuaugcuagauuaaaacagaagaaucaguauacauuugcuuuguuaaauuaauacauaguuuuauugccaguaggcuacauacauucccuugaaauguaugugcuuauggaagaaggaacuuuuuuuuuugagacagggucucacugugucacccaggcgagagugcaguggcacaaucauggcucacugcagccuuuaccucccgggcugaaaugauccucuggcccagccuccugaguagguggaccuacaggcguaugugccgccacaccccacuaguuuuuugucucuuuggagagacagggucuugcuuugugcccaugcuggucucaaacagcugggcucaaacgauccuccugccucagccucccaaagugcugggacuacagcuuugagccaccacaccuggcccuagacuuuuaaaaugcuaucaaaauaaucagaagggccaauuguguuagcucaugccaguaaucccagcacuuugggaggccaagguaggaggaucgguugaacccagcaguucaagauuagccuggggaacauagcaagacuuuguuucuccaaaaagacaaaaaauuagcugggcaugguggcacacaccuguagucccagcuacuugggaggcugaggcaggaggaguuugaggcugcaguaagccacaaucccaccacugcacuccagccugggcaacagagcaagaacuuaucauuaucuuuuuuuuuuuguuuuuuuugagacagagguuugcucagucacccaggcuggagugcaguggcacuaucugggcucacugcaaccucugccuccuggguucaagcgauucuccugccucagccucccaaguagcugggauuacaggcacccgccaucaugcccagcuaauuuuuguagagacgggguuucaccauguuggccaggcugucuugcacuccugaccucaggugauccaccugccucggccucccaaagugcugggauuauaggugugagccaccaugccuggccaagaacuuaucuuuacaaaaagaaaguuuaugcaguuuuuauauguuuauuguagaaaacuaaaaccaaauguaaaccagaauacaguuguuccucccugucuggggaguugguuccaggaccccacacuccuguggauaccaaaauuugaagaugcucaaguuccagaaauauaaaaugacccauaguauuuacauguaaaaauuauuuacaauagcuaauacaccgugagugcuauguaagcaguuguuauacuguauuguuuagauaauaaugacagggaaaagccuguauguguucaguacugugauacaguuuucucuuuugaauuuucaauauacaguucguugaauccacagacguggaaaccaugaauaaggagggccaacugugcucaguuuuuuacuaucagagaauuuuuaguguguggcauucauuuuuuucuugcauuuccuauuuucauaagucuuaaguuugaaauaccagcuugcucaauuaaagcaggcuuuugcuucagcagcauuauuuugucuucacuagaauuauaugaagauaaaaacaagcugggaaaaacuuagguggaguuggaaaaauaagauugaggaaaauacagauagugaucuuuguagucauucucauaaaugaagcuuuuaaauacaugaauuuaacuuuagggucagcccugcuacacaguuccuugcugugaaaaguuagcccugcgaguagaauucuccaaauugggucuucggaauaauacaaugaguaauugagcauuauccagcuuuggauauaacucuuguacuuaaaagacuuuagagcuuaucauuuuauguauuucauuuauuucauuuagaucuaugagagauuacaugcauuucugugauuuauuagucacuaauuuuguuuuaccauaucugucauugacacuauagauaaucagaauuuauguauauuuaauaacuuaacuuuucugaccaccccaccccaacuccauucccuuuguuuuaugugucuguugacuuacagugccacuugaacagcauaucagugcuucaacucuugauccguguggugacuuagaugaggucagaauagaugagaucuuuuucucuuucaccccaccucuuagacaguagcauuuuguucuuacaucuuauguauauuuuccacacauugcuguuuuguuuuuguuuuuguuuuuguuuuuuuuaaagauggagucuugcucugucaccaggcuggagugcaguggcuugaucucagcucacugcaaccucugccucccggguucaagagauucuccugccucagccucccgaguagcugggacuacaggcaugcgccaccacgcccaucuaauuuuuguauuuuuaguagagacgggguuucaccauguuggccaggauggucucgaucucuugaccucgugaucugcccaccucagccuccccaaagugcugggauuacaggugugagccacggcgcccaaccugaaaauuuauuuuuaaagaauuuauuggcuggguaugguggcucacgccuguaaucccggcacuuugggaggccgaggagggcggaucaccugaggucagguguucgagaccagccuggccaacauggagaaacccccaucccaucuguacuaaaaauacaaaaauuagcugggcaugguggcguauaccuguauucccggcuacucaggaggcugaggcaggagaaucacgugaacccaggaggcagagguuguagugagccaaggucacaccacugcacuccauacugggcaacagagcaagacuccaucucgagggaaaaaaaaaaauaagaaagaauuuauuuauacuuuauaaagauuuuaaacuauuacugugaugacuacuauguaguaucacaugugauagugguaaugaguuuucuucugagauuaauugcagagcuugucuuucguauggguccaauauauuacuuuucauuguguuuuauuugugcaggacaauuugcucuucaguuaucauaccaaaacaauauaaauccucaacuccuuugaguuuguuaaagauuacuauaauaauauaaucccugccaaacuaagcaugugaauucaugcccacacauggguucaguguucaaaauaguuaaaugcuguauugauuuauguguuuagggaacaagguugaacaaaagaucuucuaaccaauuagaacauuuagcuuucuuuuuuaggcaauaaauuccuuuacuugaaacacagcagaagauauuaacaucugccuaaauuuuuucauugucacauauggaaguaagugacccugcugucacuguuccauguuuucuugugaagagcuaaguugucacuacccaacugugacacugcauggaccaacuccugcaggcgagucagaaaaaaagccgggauaguaagaaaggaaccuaaaagaaccuuaauuggaaauuuaaaaaacaaaguucaaaggcccugcuuuuauuaauguauuucuguuuaugguuuucagggggugaagccagccaguuuugacaaaguagcaauuccugaagugaaggaaauuauugaaggaugcauacgacaaaacaaagaugaaagguaaguugccucuuuugaucugggugauacuugaacaaaaccuaaaaaguaaugugcuuugaguacaacacacauucuacgguguauuuaauauuugugauugguuucucuauuugugccuguaacauuuuuaaagguaggguuuuguucauugugguuauucagauuugauauacuggaacacuguaaaaauaugguuugguagaguuucaguaaaccagaaccaccauaaacauagcuacauuccaugagaacugcuuacuuaaaacaucagcaugauuuauaaaacucaaaaaagaguuuaauaucuaacacaggaaaucuuuucuuaguccuuuaccauugaauucuaaguggugaaauaaaacuuuggcucuuuaaagucagcucagcuauuacaggucugauuugccguccuuacgccagaauugaagaagagcaaaacaucaaaauuccuugaguaaaaagagaagacuuggcccagggguuggaaggagauguggcuuagucauuuguacuaacagagggcuucucuuagaggaguggcaaguaucugaucugccauguagcugauucaucacccgucaggcauggcgaagguccagugucuguuucugaaaaacagucuaucuuugccacccccuuccauccuccaaaaaagaaaaaggagaccagcuaguacaaauacaaauugcaaauugagcauaaucuaccacuugaagaaugagagcuaucagauguaucaaccgaauuaaagaauuccaucuuuucaccucuccagucucguucuuuuuauaacaucguuauuuagaagagcuuaacuucaugguuuuuaagccuuuauuaaguaaaaauuuaguuugaguuuucauuuuuauauaugcuggguacuuaaaucucuuuaagaacuuuuuacuauaaacaaaggaauguuuguuucaacucuuuuuuuuuuuuuuggacacagucuugucacgucgccuaggcuggaguacaguggcauagucucagcuuacugcaaccucugccuuccagguucaagcaauucuccugucucagccuccugaguagcugggacuacagacgcacaucaccgcaccuggcuaauuuuuguauuuuuaguagagacaggguuucaccauauuggucaggcggguugcagacuccugaccugaggugaaccacccaccuuggccucccaaaguacugggauuacaggugugagccacugggcccagccuguuucaacucuuguuggagcaguuuauuagaugauuggcauauugaaaccauuuuaucuuaagauuguuucacaaucagacuucugcuugcccaguacacaaauuauugaacaaggaauuaagagaacuuacugguguaaauaaagcuugcugugguagaaaguaccaaacuagaaacaaaaauauuuauuuucuaguuucuauuucagcauuuacagcuuuuauaacugugagcaagauucucaaccuuucugggccuccauuuccuaauaaucaggagaugauaucaaauuggguguuggucagacaagaucauaaauaugaagauuuguguuacuuauaaaaugcuauauaaaugaucaugugguauuuugaagcuuuaauagagccaauuguguuagcccaccauuacuaguauacuauuacuaauaagaucauuggauuuaaaaauuauguuacaauuguguuagcucgccauuacuaguauacuauuacuaaugagaucauuggauuuaaaaauuaucacugucagcucuuauucaugaaugagauuguuaugauguuuuauaacuucagaguaaaccucuguaggcacccuucaaauucagcaauguaaaaaugaguuauacuuuccccuguauuuuuucccauuuuuuucuucugcgaauaacaauaauuggccacauuugaaaauuauuuuuucaaacuaaugguguuuuauuuuuguuccuuuucuuuucccucuguuuggaagauauuccaucaaagaccuuuugaaccaugccuucuuccaagaggaaacaggaguacggguagaauuagcagaagaagaugauggagaaaaaauagccauaaaauuauggcuacguauugaagauauuaagaaauuaaagggaaaauacaaagauaaugaagcuauugaguuuucuuuugauuuagagagagaugucccagaagauguugcacaagaaaugguaaauugacauuagccauuuuaaaauugauuuagacuuauauauaucaauacuaucauuaagcaaaaaagcaguugaugaagugccguguguggcauaucccauugacauaaaauugugauggcccuaaaaguuaucuuugauuagugggauuuucguguguguguguuuuuuuuuuuuuuaaacuucuuuguauugcuuuuauaauggguguuagauuuuauaguccuuuuuaaaaguaaauuuuuuuuuuuuuugauggagagagagacagggucuugcucugucaccaggcuggagugcaguggccugauaaucauagcuuacugcagccuuaaacuccugaacucaagcaauccuucugccuuagccugccgagaagcugggaccauagggacgugccaccacaccugacuaauuuuuguauuuuuaguauagacaggguuucaccauguuggccaggcuugucucgaacuccuuaugucaagugaucaucccaccucagccucccaaagugcugggaguacaggugugagccacuucgcccggccaaaaguuauuuuugagaaaauauguagauauauauauacauagggauagauagaugagauagauagguagaacuaguagaaugcauuccgaagucauuuugaaaagucuguaagauugagugacucccaguuuguauaagcaucauucauuaagaaugacaaguuauguuucuacauauugguacauuagccuuugaucaguuaucuggaugaacucuauaaacagacauaggaccaugaauuguuuuuacuuugaagagaguuuuccugaucaaauacuaguaggaagccuuugauguauuauuauuugaaguaugucuaaaagaucacucuuccauaaggaaacccuuccccaaauuuaugcuugccauagugcccaaaauagcugauuauuauggaaagauaacucagaauaucucuacucggauuuaucagaaccauucaaaagugguaguugccucugagaggagaucagguaugaguuacuuauguuuaauuguuagcuguuuguauugucugagcuuuuuugcuuuuuuggaggggaggagcaguguuaaaucuucauauucguaccacaguuguuuuagcagauuaaguaguugccuuguaaaagaaagugaaaucaacacagguuaauguuagugguuacgugugagggggaaauacagugaauagaacagaguaccuuacuugguuuaggaacugagguuuuaguugcccuauuguuucguuguuuguuauaaggagugaagguauaccuacccuucgaguuucugcaaaaauggugguacccaccccucaaguaucuacaaagaugguagggaaaugcauaaugcagauuuuacaguucgguuaaggccaguccugagagaauucuuucuuccuccucuucucuacuuuuuuuacaaugccuuuuuuuuuuuuggcggggggugguggugggggguguuguuuucuuucaauauacuacugcuuaauuuacccuuuuauucuguagguagagucuggguaugucugugaaggugaucacaagaccauggcuaaagcuaucaaagacagaguaucauuaauuaagaggaaacgagagcagcggcaguugguacgggaggagcaagaaaaaaaaaagcaggaagagagcagucucaaacagcagguagaacaauccagugcuucccagacaggaaucaagcagcucccuucugcuagcaccggcauaccuacugcuucuaccacuucagcuucaguuucuacacaaguagaaccugaagaaccugaggcagaucaacaucaacaacuacaguaccagcaacccaguauaucuguguuauguacguaucuugggaaguggacagauaggcuaaugauucuccuaauugguuuuuuuagcuucuuguuauuuugcacuggcuuuuugguuuugaauuaugaauccuacuauuauacaaaauuugaaaugguugucgucuagcuucucuuuauucuuauaucugugacuaggagaauagaaggauggggugguaaggaaaugugauuaggauacaaaauaauuuuauaagcuucaacaucuuggagguuucaauuuguagauuucuacuuuucacaauuuauuuaaauaaaacagauuuaauaaugaagaaugaacaagcuuggcuacuaaaauugaacccaucagucugguugagcucuuuuagcaaagcugaaugguauauagacuaaaaacuaaugagaacacugguuauuaauuuaauuacuuguuuaauacugagaaccuccuggccuccauaauuaagacuuugaaagcugugucaaauuuaaggcuuauaguguuucaugcuguuucccuuacuccucaggugguaagauucugugauagccauauggauuccucauuuaaauauagaaaucuacugaauauggcuacaauucauuuuuuauuuaguucaaaucugugcaaggaauaacuaguuaccccuaauauaaugggucuaaauaugagaaaaugugaaccuccauuuugugauuugucuuucucucucucuuuuuuuuggcgauucauuuuuccuucagcugaugggacgguugacaguggucagggauccucugucuucacagaaucucgagugagcagccaacagacaguuucauaugguucccaacaugaacaggcacauucuacaggcacagucccagggcauauaccuucuacuguccaagcacagucucagccccaugggguauauccacccucaagugugguaaguaaaugcuuaagagcauguaauacuacaaugagagccaauggauagucugcuaaauuaaaauucuuuguacaaaccaaguaacaguaugagucugaaguagaaaauauaaaaugcugugucucuaaagccuuauuauagaguaggauauagacauuaaugugugggcauuagcugaacugccuacaugaagcagcuaugugcaagauuuagauuagucugcauuuuuacuaaagggaacgcucucuuuagcacuuaagauguugaaacuauucacagcaacaaaagcuggacauacaaauguuuugcggguggggcgagaagaguuuuucaaaagcuuguuaaaaugauuacuaaguauuuccuguaagauucccuauuguacaaaacacagguaagaccuucaaaccauuauagaaugcugcaugugaguacucuagauugagggaauccuuuauuugaaugacuguuuaauuuagcgcuuguguugaguuaaucaucaguugcuguguguguuccugccuuuuaaagucuguguuggacacaaguuccuuccccaguauauguucuuuugcuuuuucccuuuaguugguaacuguuuuauuacugauuuauuuucagaaucaacuuauagaaauuauuuccugaaacauuuuaugcuuguauacacauacacacacacaauuauccuguguuuuacauuagacacucuuguuucucauauagagaauguuaaaguagaucaucagauaauaccccauuucuuuuguugaccucagaggaaaauaaaauacgucaucugccucugaaagguauuagaaaauaaguaacuugucacuguacagcacuuguuuagugagaucuuuaagcagacagauuuuccccuucucagaaagcuuuuaaucuaaacuuuguggaauucuugcucuucuuuaaaugaaaaucuuucucuguuaagaaaauacuucugcuuguucgauuuuuuauccuacagcuuggaauaaaagauguucauuuguuucagaguccguuuaauccugcuuuggcuaggucucaaaaugaauggccacaguaacacaaauaaaaaacuaauauacuaacuuuuuaaaacaaucuacuuucugucuuuaaaauaauugaggguagaauagaagaacuuuauaaagacugcacagaaaauauauuucuguguucugacaaauauuacuugucagcauuucuugucaguuucuaccuuuaauuguuuuuuuucuggauuauuauaacuagauuuugcuaagacuuuuuuuuuaaaauuuucucuugucuauacucaucaugggggagcauuaggucucuauuuuagaaagcaaguagaaugacaugaagauauuauuugagccauuaaucuagcuauauuuauugaugcucuaaaagcagacguucuugcuuuuuaaugacaguauucuauggagguauuaugaagaauuauuaaauauugagaauuuaaaaauuugucuaauucuauucuugucucauuucaggaauguggcuuacaauaauauggacaaauuauaagugaaauuuuagaaauuagaauaaaagaaauaaggcuagagagaaaucaaaacaggaaugaaacuaaacaaucauaugaugauauguaaauacuugguauuggugggccacagauuuggcccaaagcauucuacacagccaaguuuuggaaaugaaaacauaguuucauaguucacaacaucuaaaaggaaaauaacagucuuauucaagacaaccuuuaugguauugaucauacugccuuauagccauauuaaacccugugccugaacauuuuuuuaaguuuuuuuuuuuuuuuuugacagcgucucacucugucucccaggugggaauacaguggcgugaucuuggcucacugcaacuuucaccuccuggguucaagugauucuccugccucagccuccccaguagcuaagauuacaggcacccaucaccacgcccagcuaauuuuuguauuuuuuuuaguagagacacaguuucaccguguuggcuaggcuggucuugaacucuugaccucaagugauccaccugccucggccucccaaagugccaggauuacaggugugagccaccaugcccggccuaaauuauuauuuagagauucagauugaagauauucucccauugauuacuuuguaaaaguacaaaauauuuccuauauccaguugugaauuucuucuagaaagcuaaacuuuuuccuaguagaucaugacuuuuuuaccuuuacaaauaaagaguggcaaguauaagaaauacugugagccaacaacuuuccaucucaugucuucuaaaauagaaaugagaaucuuuuucugagguuuccagagcucuugcaaaauaauccaaucuuaaaauucucuguaucuuuuaauguacuuuaaacuaauagaauucauucuuguugaaucuuaaguuugccaaaguugcaagcuaauauucauuguuuucccugucugcacccuucagucaguuggucauucuuaaauucauacacuuguaacacuugguguuauuucagaauauuuagcaugauaacugaucauuaucaugaucauucauuaaaccuguccuugacugacaacgcagaauaguugugaauaguugugaucugucagaugugcuauguugaguuauagcucuccucaaaaaaaaaacugacuuuguggaauugggagaggauggaacauuucuucaugcaacuaugcccuguuaucauuguacuuuuguuuauuuuguuuucacaguacuguguuuuucauguguguguuuguuuuguguugagccucgucguggccguagcaugucgguuuguguucccaucuuucugcuguugccucugugucccgcaucucucccagugcucuuccaccccaccgccaguacugucugcaccucuuucuccuucccuccuccggacugccccgaggaaacuuuugccgaaaagcuuucuaaagcauuggagaguguccugccuaugcacucugccucucagcgcaagcaccgacgcuccagccugccuucccucuuugucaguacuguauguaacuguaaacuucugacaaaugaacaauuauuaccaaugaauacauccaggcaacaagaauuuuaauuaaaauugaauaaagaacaggacuaaacuugguuauauuaugcuucuaggauaccaguuauuccuguaggaaacuuuuuuguaauaaggcuuuaagggggaauaaaaagcaaggagguaaugagagagaauaccuauaauguccuuggcacauaccagcauguguccaauaaaauuuaccuuucauuauaucuuccuguuuccuaucgacauaaaauucuuucauuuucauauucuaguuuuaaaaggauuaauuuuaaaguuauugccuuaaucaaaagcaaauuuuaucaaacauuacccaaacauuuuuucuccucacuuuauucuaaggagacacuaauaaaacuggaugaguccuuuuuuuuuuuaauaaccuuagucagcaaagaauaaccuuggagugaacauuuauuuuaauuuaaucauuuauguaagaugauguaucagcaaaccaaagaacuacauaauguucccccauggaaguauuuuuuccuuagguuucaaccuaaggugggacuguagcucuaaugaaugcauuagaugcauauauaguauguaugacuuucuuuggcuccauuaauguuuauaaaagaucuaucuuauaaaauuauuuuaagcauguggguccuugcugcuuuuccaaauaaagaauauaguuaacuuucugaacuagcaaccccagaauuuucagauuuuuacuuaggagaaugaagaacuauacaguguuauuauggcuuugagacauaccaugaguaaauaacaauaaaaugagcauucugacugaaaauagaaauccuuauuuagcuauugugaacaguugaucuacuuugccagcucgauaaggaucuucccuauggaagaaugaaacugaauucuuuuaaaaagcgggggaggcugugauagugaauucuuacuauuauuuacuuauuuauuuauguuuuggagauggaaucucgcucugucgccaggcuggagugcaguggcacgaucucgacucacggcaaccucugccuccuggguucaagugauucuccugccucagccucccgaguagcuaggacuacaggcgcaugccaccacacccagcuaauuuuuguauuuuaguagagauggguuucaccauguuuggccaggauggucuugaucuccugacauugugauccacccccuucagccucccacagugcugggauuacaggcgugagccaccgcgcccagcggguaaugaauuauuauaguguauauuguuugcauuuggcaagcuguguuucuaaauuuagucuuaaaucuagaacugcuucuagaauaaaaagugcuaucaaauaaaauuggcugucauuuauauuacccuuuucaguugauuagaacaccaggaugucagaaucagaaaauucaugguuacggccgggcucaguggcucacgccuguaauccuagcacuuugggaggccgaagugagcagaucaccugaggucaggaguucgagaccagccuggccaacauggcgaaaugugucucuacuaaaaauacaaaaauuagcugggcgugguggcgcacgcguguagucccagcuacuugggaggcugaggcagaagaaucccuugaacccaggaggcggagguugcaguaagccaagauugucacugcacuccagccugggcgaaagaggaagacuccaucucaaaaaaaagaaaaaagaaauuucaugguuaugcaacucuuauuuaugaucagaaaaauggacauuuugugauuuaacucuguaacauguuucauguaguaaaaauauaauaaaacuauuaaucaucuagcuugggagagauaggagaaagacauuacugucacuagucaaauuauauaucuuuuacuauccaccaaaaaucucuucugauuucugguuagaaggcauacuauuaauugauaagaaaauaaaacugaaggccucuaacauaucacaggguaauaagaauauagggaaaguuaguucaauaguuuaaauuaaagcacacuucuuacaguauagaacuagucgggcuuuuaugccuuguuuuaguucuuacucuuccuuuaacucuuuuucuguugauguaauuuacauuaaugcuuaagagugaacuuuuuaaguguggguaaaaacgaaauaauuacuuacaaaguuuaauucuuccauuuccuuugagagaggaaaguuauggaaaagcagcucuuaucuaaagcaaagagcccacagauugauuucauuggcccuggauguauuuaauggauuuuuacuaugcacauaauuuccagaagcauuguuauuuauuuauuaauuauaaauuuaguguaaccauuucauaggguuacacagaacuacccaguugugcaugucugauguaauuucacauaugaauguaugaauuacuugucuuauucauguugauacagccucaguccauggcgcauccguguggggggaccccaacauacccagaaucacagauauuuuucccaacuauucaugaacguccaguuucuuuuucaccaccucccaccugcccaccgaaaguagccauuucccagcggcguaagagcaccuccuuccuggaagcccaaacucaccacuuccaaccccugcugaggacuguuggccaaagucuucuuccaccugguggcagcccaacuaacuggacaccagaggccguaguuauguuggguacuacagccaguagaguaacuggagagucaugugagauacagguccauccuauguuugaaccaucucaaguuuacagugacuauagaccuggacuaguacuuccagaagaagcucacuauuuuauuccucaggaagcaguguauguagcugggguacauuaccaggcccggguggcagaacaguaugagggcauuccauacaacucaucaguacugucaaguccuaugaaacagauaccugaacagaagccaguacaagggggcccuacuucaaguucugucuuugaauuuccaucuggacaggcuuuccugguaggacaccuucagaaucuaagauuagauucuggauuggguccgggaucuccccucucuaguauuucugcaccuaucaguacagaugcuacacguuugaaauuucacccugucuuuguuccucauucugcgccugcuguguuaacucauaacaaugagagcagaagcaacuguguauuugaauuucauguucacacaccaagcuccucuucaggagaaggagguggaauuuuaccucagcguguuuaccgaaaucggcagguugcaguggacuugaaucaagaagaacugccuccucaaucaguuggauuacauggcuacuugcagccugugacugaagaaaagcauaauuaccaugccccagaauugaccguuucugugguagagccuaucggacagaacuggccaauaggaagcccagaauauuccagugauuccucacaaaucacuucuucagaccccagugauuuucagucaccucccccuacagggggagcagcugcaccuuuuggcucugacgucucaaugcccuuuauccaucugccucagacaguguuacaagaauccccacuuuucuucuguuucccccaaggaaccacaucucagcaggucuuaacugccucauuuucuucaggaggaucugcacuucauccacagguuauaggaaaacuuccacaauuauuuuaaacuacccuacuuugcaccauaacauuuaaauuuucuauuccuuauuucccugaaucauggauuuuggagaaauauuguuuaauuuuaucaguagaguuuccccaucuuugggggguugugaacuacauauaugcauuuaaaaacaaaaugugagagaagcuaccugauuuaccuauuauaugugaaaaccaguggaaaaaacacaaaaacuagaauuuuagucauucuucacaaucacgacuucuaugcacguuauuuucaaccaguagugaaaaugcaaguguauguaauguaugguugacccagcauuauuuaggaauacaaaucuuaaguauuacuuucuuccuccaaacaaguuuuuaaaaaauaggauaaauuuuuuuucuauaaaauauaaaacauggaaaauagggaaugcuguuuuugagguaauauuaauaauacacagaauuuucauuagugucgaaggaucuaaaaagacaaaguauaucaugggaauaaaaaaagauagaaaaggaaacaguuuaggaauuugccuuaacaaaugaaaaugccuuuuuaaaauggcaucagucaagcaaguugcugugcauuauuauauguccaaauaaaaugcuaauucauaaaauuaaggacugauucuaauuuuuagcaacuaacaaucuagugaguggugggcuuuuuuuuuuuguuauaagaauuugugauauguugcaagcuaaggaacaguagacaucuuaggccuuguauuuuccucaacaaauuuaauuuuaguuauuuauguguaugagcauauacacacuuagcaaauaaagacaauguaaugaauguaauagaauucaaaaguacagucaguguuuacuguuucauauauucauuugguauauuuuaucaaauguguacaucuuauaaaaucuacauagaagacuaugcaguuauauauugaagacauuuggauauccuacauaaaguacuauguguuguucuuccuacuuucuuccuauguucuucccucaucaggagcauaaacaacucccaaaaugugcacaaauuaucaauuauuuagugcuguacuaagacacaaaaagauccagaagcuugacagcuauacaugggcaugcaguauauucacaucaguauucaaguugcagccccuauuauaaauauuaauguauugccaguaauuauccuuuagacuuuccaaaguaaaaaauaccagguaguuaauuuauagacauacuacagaaggaaucaauauuuauaauaguuaagcugcaguggaaugugauauuauauccauguaagcuuuaaggaaccccuuguaaacugaaauggaaugacaaaagugguagccuuuucauuucguuaacauaccuauauauaguccugcaucauuucucacuuucuagugagaaacacuguaguugggguuucucagacucaacacuguugacaucugagguuggauaauucuuuguuguggugggcuguucuauguauuguaggcuauuuagaacauccuugguuuauaccuccuaaauacuaguagcagcaaucucccucaguugugacaaccagaaaugucuccacauauugccaagugccccccuggggguggcaggauugcuccuggauagcaaugaucgcccuagguacuuggcaguugaugauaacagauuuuuugauacuuuugauaaaagucauuguggcacuacaagaaguauuaccaaauuagcauuaccaaauaccuuucuuuaauucuucagauaaauuucagauugauaguauuaauacuuuguuccugauuauuguauuucuaauaacaaauuuuauuaugaaucugacgauucuagccagcuaaaauuacagccugagcagcauugacagcuuagguuuucacugucaguggguuuugcauggguugggaucagaacauguugugugguaugauccuuuucuaaauuuuucuuacaaaaguugacccagaggccucucccauacauaaucagguuaauguuucauuuugaucaagcaaacucugaggagauuaaauauucauugcaaaagccugaccucuauacacuuacuuuaggccuucucuaauuuguuguguucacuucuuuccuucaggcacaggggcagagccagggucagccauccucaaguagcuuaacagggguuucaucuucccaacccauacaacauccucagcaggugagaacaaugcauugcaacauuuuaugaauuagcaguggccagaacacuauuuuaacuuuugugauuuguuauauaaauggccugcuaaguuuuugaaaggaaaauuaagaggcauaccaugucuuguguucaguaacaaagaaaaaaaagagacuuuucuguguuucagaaaaaucucuuuuguuuaauauacuuuugaacaauuuaguagacauacauuauuacugauauaauuaucuuuuuaaaagaggauucuacaccuuuuuuuugagacaaagucucacucugucacccaggcuggagugcaguggugcaaucuuagcucacugcaaccaccgccucccagguucaagcaguccuccugccucagcuuuccacguagcugggacuacaggugccugccaccacacucagcuaauuuuuguauuuuuaguagagacgggguuucaccaugcuggccaggcuggucucaaacuccugaccucagguaauccacccuccucggcuucccaaagugcugggauuacaggcaugcgccaccucacccagccuggauucuacacauaauuuacgguacaaagaguaugucauuccuuuucucuuuuuuuccacugcuugcagcagugauuugucauuaccuucauugugcuugccucuacuaauccugcacuucuuuuuaauuauuucuaaucuguagaaugaugugucagauuuuacgcuaagaagcaucuaaugaaaaccuaagaacaauuacuucaagaacauuuauuuauuuauuuauuuuuauuuauuuugagacagccuugcucuguugcccaggcuggagugcaguggugcaaucuuggcucacugcaacuuccaucucccagguucaagcuauucucacgccucagccgcccgaguagcugggacuacaggcgcgugccacuaugcccagcuaauuuuuguauuacguucuacuuaugccuggcuaauuuaguagagauggcguuucaccauguuggccaggcuggucuugaacuccugaccucaagugauccacccgcuuuggccucccaaagugcugggagccacugugcccagccaaaauauuuuaacuuuuguuuuggggggcuuguuccagaaaguucaaggaauucaagagauuagugucauccugauacauccaacaguaaaacugguaauucuaaaauuaaauauuuauagugcaucacugauauuaguuaauaguaauuauuugcaagggaauaaugcauuuuuggcauaauugaauacuuauuagcuauucuacauaaaauuuguagccacuauguauguaaugcaaacuuccuaauguuaguuccccauguggguuuuuuaaucagcaaacucuaaacuggcuucuguuucuauuaguuuuugguuuugaaacaaaguuuucgguucuuaauuacaaauggcccuuuuucaguccaacauauggucauguagucauucgauacugguuuaagaucaggaguugcuuguacaagaugaaaaucacuuaaaggcacuuucuacagaaacaguugauuaguuuguuuauacaugcauucacuccgugaacugaaggacugggacuuauaugcuuuguuuugcaccuguccuuucuuccaaacaagacugguuaaauucaaguaaacauauuuuugccaaccuuaacaaaaucuguuuuauucuauuaacaguuccuaauuagaaugcaaauuacaagucacauaaagcugguugagaauggaaguacugaguacuaaucuccuaacuugcuuaucuuuggauguagacgaacaccaaugaacugagcaaauuguaugugcucuguuuuuucuuuuccaaaggaauugguuaucugucuuguauuuggggauauguauguauacuuacuaucaaaugaagaagauaauaaaauaauucauugaguuucauguuaagaaagagugugagaaaagaagagagcaguaccauaaaugucagauuaaaagaauuagguagcuaccucuccaggagaaaaaaauauggcuaaaugcuaucucuacagcagaaacaaaaauuaauuuuuguuucagugauguuuuuguuuuagauacuuuuauagcauguguuguagaaucacaaaauugagcccucgauauauauaggaaguguauucggucuagaauaauuaacuucuccaaagucacuuagauaauaagggagcuacaaauuauaacccagaauucaagauuccuagaauaguauuguuucuuccauuuuaaauaaaguucugcagggacuuaaugauucugcaaauguaccucagaagcugucuuuauuuguuuuaauuauuggaguuccacguuugaaaaaagaaagguugaaaacuuuuuguacuauauggauagucuauuuuuagacaugauuuuuguuuuacguacuuucaggucccaaucccaccuuagagaaccauaucucuuguuuuauuuuagugaggaaagaaauauacuuuugcuaaaauuuacuuuauuucaugcguuucuugaacauaguaaaugaggaauugcuuuuuuguguguuuuuguagggucucguauagugauauacuagaucuuagcaagguaccaaaaauagcugccuccugcugaaaagcuuugugaccacaaacaaaguugugaacuuugucagacacagugccagcuacuuggaaggcugaggcaggaagaucacuugagcccaggaguucaaggcuacagugaacuaugauauugccaccauacuccagccugggcaacagagcaugacucaucucaaaaaaaaaaaagcaccgaaguugugaacuaccuacccuacuauccauaaagucuguuugaacugguuucaugaggcaagcuugggcagagcaugaugcuaaacuguuaagcuagaccaccccugccuggcugaagugcugauuauuagucagugggacugcgcacagcagaucaucauguacuucuggcauauccagaggugacacuucuccccagaugcucuaagauguaacauuaaccguuagccauuguaaacaacugguuuagagaucucuuuaagauguuaauacaagggucacugucauagaugccucucaguugucuuaagcaaagaaauaauuuguccauaaaacugcucauuuuugacaguccuuucagcuuuuuuuccuaauugaguucagauacugaaggucuaccgagcuggaccagguaugacuacuuugaaagagucuaaauaauauaguaaauauauauguaaauuucuaaaaaacaaauaaggauaauagcuaauauuaaagugcuuuguacauuguaccuacauucucauuuaaucguuuuaagaacccuauaaguauagaugcuauaauuauuuccauuuuacugaugggaaagcugagaucuggagaaggugaguaguuuacccaaacuuacagcuuauaagagguaaaaacagaauuuaaauccaaauaaucuaauuccacagcucaccauuugacuacuacccaauuauguccaaaaaaagggaagaaauuaacaucucucccaagcaggaaagggaauaucaggaagacuuuaggaaaaaggaggcauuugaaauggacuuugauuauaaguuagacucagauguagaaauaaagaauauuccaggccagaagauaaaaaaauuauacugugagcaaugugaaaggcccuaagauagaaaaauaggguacaaaaacaaaugugccuuuaguuugguuuaacuagagcauagauaugugaagguauaaguucaggaaagaguugauagagucuaaauuuugauaugagcauaauuuugaauuaaggaggauguauugggggcugggagcauaugauuaccauaugcccaaagauaacaugggaauucuuccucaaauuuauccguuagaaaagaggggaauaaccauguauucagaccuuuaucguacucucauauuacaggguuuucacuguccuuuacuuugaacaacaacaaaccaaaaaagguuaaugaaauaaaaugaaacaggugagaacaaaugugccugcaaagacuucagcucauguaguuagaaauguucauugagaacaucagacagaauauuuuuaaggaauaaacauaaauuuaguccuuauucucagcaauaugacuucacuauucugaggacuguaugugauuuuaaacaacuggcuuaaagaucucuuuaagaugucaauauaaggguuacaugaauaaaaaccuauaagagaaaggaaaaaaaaaucuaguuuuauuuuaauguuauguaaauaggugcuuuucacugcacauuuuaccugaagauacaacuuagauggaauguguuauguuaugccagaaaacugcaggagcguucauaauuuagcuucagugaagguaaagaugcuggugucuuuaccuauguagaguuugggggagagggagcaguauuucugaauuaauauauuuaauaugcaaucuuauuuacguguguaaauuaaugaguuagauaauuauagauaucucauucacauuccuuaaaguuuaaauuuguucaaguuggcaaauaaaaaagguuuucugguuuuuuaguuccuuuuucucaggugggaaauuaacaaauuugucuuauauucagagcaccuuuagaauuggcuacaugugguuuaucuuaguuugcagaaaauaaauuucauguaauucagcagccauuucugcuucuuuaaaaguuaaaauaagaauacauuaucagaggccggggcgcgguggcucacgccuguaauccuagcacuuugggaggccgaggugcacggaucacaaggucaggagaucaagaccauccuggcuaacauggugaaaacccgucucuacuaaaaacacaaaaaauuagccgggcgugguggcaggcgccuguagucccagcugcucaggaggcugaggcaggagaauggcaugaaccugggaggcggaacuugcagugagccaagaucgcgccacugcacuccagccugggcaacggagcgagacuccgugucaaaaaaaaagaauacauuaucagaaauaauuaaauaggaauaaaccaaacaugacugcuguugccauuauauuuuagcauucuuuuggugauuuuaauugacauaaauauaagaagagcaaaaauauuauuuguagauuaucaccuaacaaaaucuaagacacuuaucaagguggcaagauacauaauaaauguacaaauaaauagcuuaucuuuauaccagcaguaaccaauuagucguauggguauaccagcacauacguaaaaggcuguugguugcagcauuauuuuaaguagcaaaaaugaaacaaccaaaguguuuaucauuaggagacugaugccauuuagaaauuaaaguaguaugcuauagaacacuauguauaggaaaggcauguuuuuguuuuguuuauuuuaacaaaaaaagaaaacuaugugaaaauggccacuuacgcauagaaaaaaauccaugaagguuaugcaccaaacgacuaauagugguuaccucuggagaauaggauuagggguauuuucauuaacuuuauaauaugauguacuaguuaaaauuuuuauuacaagcagauguuguauuaaagaaaaaauauaaauuagguauuagaagaucuugaaagucagcccuaaacuucauuuuuuuuuuuuuuuuuuuuuuuuuuuggagacagaguuucgaucuuguugcccaugcuggagugcaauggugcaaucucggcucacugcaaccuccgccucccagguucaagcaauuuuccugccucagccuccugaguagcugggauuauagauaugugccaccacgcccggcuaauuuuuugcaauuuuaguagcgaugggguuucuccauguuggucaggcuggucuugaacucuggaccgcaggugaucugcccaccucagccucccaaagugcugggauuacaggcgugagccaccgcgcccagccucaaguuuuuauuuguuagacagaaggggcaguacucuaggggucauaguccuguuuuguuugguuuuguuugcuugauuuauuacagaauuuaguauucgaguacaguuauguuccaugcauuaaauuagguguauaauuacgcaccaugcauuaaauuauacuugagucccuaguacauaguagauucccaggugucauucccuuugccccacuuugaguuaaaaaauaauguccuuguuucaaaaagagaaacuucauuuuuuuaauaaaauaagcaaucuaaggcauuaacagcuaguaaauauuaaagcuaaaauuugaaaaugucuguuauuccaaauccagugcuuuccucccuauuuuguagcuauaaucaaagcuauucuucaagcauauuaauuauacaguugauaaaauaggguaaggaaaaaagauuaaaggaagcuauuggaucuaucugauauaggugccaaagagagagcugaugccaagagauagggaaaagggaauggcagggaugggauggggaaaggaacugucuggauauguuauguaaaugucuuuguaaagaccuauuguuggggugagggagauaauugggugaagagccaaugguaacuugaguauuaaaagauugguuaauuuuuccugguggcaccaucacaaagaacaucagagggaaaacaaauauauaauggaaauugaugaauuuggguuugugcaugucuugauuacuaaaaucaucauuauuuacagacacugaaggcuuuagguaaacaugcuuccuuagaaacaugcuguuauugauuugaaauaaaacugaaucauuguauuuuauucuuagcagcagggaauacagcagacagccccuccucaacagacagugcaguauucacuuucacagacaucaaccuccagugaggccacuacugcacagccagugagucagccucaagcuccacaagucuugccucaaguaucagcuggaaaacagguaaacuuuuuuuuuuuuuuuaaacagguaaacucuuaauuucugaaagggugcuaaaagggauuuccauguaacuuguccuuucauguggauagacuucuaccuuuucuucuaaggguaaccaacccuugaaguagguuaaucucauugcagaaaugaagugaagaucaccucauuggugcauaugcauuauuuaauguaaauggguacguuacugacagcagugacaauccaaaguuucacuucuagucuuaccaguccaaaauugauguaacagguauuagaaauaacagguuaaauaaaggugcucugguaacugaaccuaugacauucccuagaauugugucagcuaugucugauauucuagguuugaaacuaugcuuuauuuucauguagauuucugcacuguuuacuguguggaauguuuuuuuuucuuaaguaguccuccuaaucacuugagaaguacccuguagaagguaugcuuuucugaaugaccuuuuuucaacuuuauuuuugaguacuguugugcauguaugugcacaguguauuguuacccuaauauuucaucacaucugagaugcuaucaacuuuaaaauguaccauauuuuauguaccacauuaucaguuauaaaguagaucccaauuucucacauguuaaaaugaucagguaguggagagggaugauugcauccuagaaugagugaaauaugugaauuauaccaauuuuuauugagccauguuggacuuaagaauuuuagaaauaauacgaaugaaaucuuaauuccacugggaaggaauucauuugaauuucaguaacuacuguaacagcagucguaacuuuagugauagcauuaugguauauaaaauauauuccaauaaagcuguuaaaaaaaaaagccaaccccuugucuauggaaggguccucuucuauugccaaaugcugaagcauuagcaaauauuucuaugacaaaagguguagaacaguaauagucuauuuagccucuuucucuccugcucuccuuuccauauucuuauguggcauauuaacuuaacacuaauguaugcaggguuuuguugguuugguguuuuuuuuuuuguuuguuuuuuccuucuuuuuggcuaauacauaaaucuugcuuuuggcagccuugcuuuuuuuuuuuuuuuuuuuuuuuuaagccugucuguuuuguuuuucuuuaccuucccagcuuccaguuucccagccaguaccaacuauccaaggcgaaccucagaucccaguugcgacacaacccucgguuguuccaguccacucuggugcucauuuccuuccagugggacagccgcucccuacucccuugcucccucaguacccugucucucagauucccauaucaacuccucaugugucuacggcucagacagguuucucaucccuucccaucacaauggcagcuggcauuacucagccucugcucacguuggcuucaucugcuacaacagcugcgaucccggggguaucaacugugguuccuagucagcuuccaacccuucugcagccugugacucagcugccaagucagguucacccacagcuccuacaaccagcaguucaguccaugggaauaccagcuaaccuuggacaagcugcugagguuccacuuuccucuggagauguucuguaccagguauuguguuaguuagcaaaagagggcaccacagaguuugauccuaguagaucaucaggaacauggaaaucuaauaguugagugucagaauaacuagcaauaacaugucaacuagagaagcaaaauaguaaaauucugagaaaggauuggauaaugauguucagugauuccugauccauuuuucucaagacacuucuucagagaaaaaugguucucucaguauucacuguaagcugauugaaugcuagaugugguuaauaguacaccuggcaacuuuuacauauauggguagaauaaauagaauagccaacaugguaucaacaaaaagcuucgggguuuagacugggaaaauuagcauuucaugauaugacuguuauguggaagaauuuuugcauuuuuccauuuaagauuggcuaggaagaaauuguguuccuccuauuuaaaucaucucuaggugaagauaaccgacaauaaaguaguauuguagaguccugucucuucuguuggaaccagucuacuacuucauuucaagaauguggucuuuauaugcccuuuagauuauuagaaagagauuggcuacuauucuucuuugcugugugcuucuuuuuuuuuuuuuugcaugucuugcuguuuugcuaauuuauugacccccaaccugcucuaacucaccuuccucauuucugucacagggcuucccaccucgacugccaccacaguacccaggagauucaaauauugcucccucuuccaacguggcuucuguuugcauccauucuacaguccuauccccucccaugccgacagaaguacuggcuacaccuggguacuuucccacaguggugcagccuuauguggaaucaaaucuuuuaguuccuaugggugguguaggaggacagguucaagugucccagccaggagggaguuuagcacaagcccccacuacauccucccagcaagcaguuuuggagguaaauagaauuacugcauguuuauauguaaaacguauauauguaauuggacaacaaugauaaaggagaaagaaacaggcuccccugguuuagaacuuauuuggagaccaugucaaacuaacuucugcaugacuuuuucuuacagcagaaugaaaugccaaugugggguccuuguuuccacuggcuguucuguugggaagugagugugccuuggagaagaugaacccuauuagcacuucacuucucuagcuaguacuuuagccauuauucuuguccuuucacaaacuuuuuccauuggcagucauaagaguaucuuacccuccugugcucucagcaaucauuuuugcccugcuaggagaagaucugaauucaucuuuguacuaugcucugucugcgcuauugcacacucuugguaagaugcuggcugcauggcaaguuguagguucacacugccuagcagauauguuggcugaccucauaccaugcagucuauaccagagacuagcuuuagcaacuuccuuuggaauuuuaagaccauuaucucuagaugcugaauauugagaauuuacuaguaaauuuagugcuucuaggacguaguggggagggauaaggaaaaaaauaaguagauuauuggggauagugaaugauaaaucuauuacuaccgagauuugaguuaucuuuucgauucacagaguacucagggagucucucagguugcuccugcagagccaguugcaguagcacagacccaagcuacccagccgaccacuuuggcuuccucuguagacagguacguaaaacuagaauucuccuuccuugacugguaaauaagacgguaugaaacgccaaacugucagaccuuuaaaucucauauuauaaacugcacuuuuuuuucuuuuuaaauuucaaagugcacauucagauguugcuucagguaugagugauggcaaugagaacgucccaucuuccaguggaaggcaugaaggaagaacuacaaaacggcauuaccgaaaaucuguaaggagucgcucucgacaugaaaaaacuucacgcccaaaauuaagaauuuugaauguaaguauuccuaauuugugaguuucauguuguuaaaggaauuugacacugaaaaagauuuuagaggucaucaaauccaaaccacucacuucauaaaauaaagauaacuaucugugugugacagauaauuuuuuuuuuuuuuagacggagucucgcucugucgcccaggcuggagugcaguggcaugaucucuucucacugugauugcagugccuccuggguucaagcgauucuccugccucagccucccaaguagcugggacuacagacacgugccaccacgcacggcuaguuuuuguauuuuuaguagagacaggguuucaccauauuggucaggcugguuucaaacuccugaccucaggugacucaccugccucagccucccaaaccacugggauuacaggcacccagccagauaauuuauauaguacucuucucauuucaugcccacagucucuuugacuuaaauaucacauuuuuagaaaaaugaaaagguaguucauaaagcuaugauagggccagcaguuaauaucauuuaaauauuucuuaaggcuuagaugaauugaugaauguauaggaucuuauaauuagccaaaugauauucuuacauuccauauuucuaugauaaagcacuacuuaucuuuuagaaaaagaauagagaguuuuaguaaguagcucaaaggcuaacgucuucucaaagauuuuucuugcuaccaguuuaagagacaaaguacuagugcuccaaggaacagcgauaacacuaugcuuccuuagacauaaagucaagugcuaaucugcauugcuuuucugaaauucaguaauaaagcugaauauggucuuuggagaugauguaccuuuuuucuuuuuagguuucaaauaaaggagaccgaguaguagaaugucaauuagagacucauaauaggaaaaugguuacauucaaauuugaccuagauggugacaaccccgaggagauagcaacaauuaugguacgucugcauuuggaguucuagguuuuuccuuaguacuugaucuuaauagccauugcucuaggcaaauaugccauauuuuauaauccauguuuuuuuaaaguuaugcauuuacuucaaugugaauaaaacuaucacacccaaccugugauuuagugauguuuuugucuaggcuaugucuaacuagauauugaaguucuuaaaaagagaagagcuaacuugaguacaaaauaaauaaaaauauagguaaguaugcagauaggacagaagucauaaaagugacauaaaguuugagaaaugacacuaauuagacugacaucacauuucuuuuacaggugaacaaugacuuuauucuagcaauagagagagagucguuuguggaucaagugcgagaaauuauugaaaaagcugaugaaaugcucagugaggaugucaguguggaaccagagggugaucagggauuggagagucuacaaggaaaggaugacuauggcuuuucagguucucagguagguucaccacucccauagugaaacuuuguugauuuaaaauauuuucauaguucuaaauuugcuaugcaaaauguccagugauaucaccugacacccaugaccgacaacaaacuuuuauguucucuucacauguggcaguuugcuuugccuagucauugagauugcauuugagaauguauuuaaucacuuuuguuuguuguagaaauuggaaggagaguucaaacaaccaauuccugcgucuuccaugccacagcaaauaggugaauuuauuuucuuuccuuguuuuuaccuuugacuuaagaagccauuagccgagggugguggcaggcuucuguagucccagcuacucaggaggccgaggcacgagaaucgcuugaacccaggaggcggagguugcagugagcugagaucgcgccacugcacuccagccugggugagagaaugagaccgugccucaaaaaaagcaguuguaugugccaauaaugaagucuaacaauauuuauaauaauaaugcuauuaaguuacguuuguuuguuuguuuuugaccaggcauuccuaccaguucuuuaacucaaguuguucauucugcgggaaggcgguuuauagugaguccugugccagaaagccgauuacgagaaucaaaaguuuuccccagugaaauaacagauacagguaagggauugauucugccacauuguuauguaaauucuacagugccucugcuauguugaaagcuuaaucauaaagcaguaauuuaugaugacacagauaauaaaaaagaauagaaaacugaaguuauaaccaacagauaaacauaugggagagggaaauagaugaagaauacagagaauuacagaaaaagccaagaagcacggccauaccaagauauagucuguauaauagauauuguaguauguguuuauuucugcacuuaguacuguugucuauguuuuaagauuacuccauauuuuuuaucaaaaacagauauuuauaggagcugacuuaggcuagcagacaaucuuuugaauccauccuuuuaaaaucagcugauucuuaucuuuuuguauuccuuugcaguugcugccucuacagcucagagcccuggaaugaacuugucucacucugcaucaucccuuagucuacaacaggccuuuucugaacuuagacgugcccaaaugacagaaggacccaacacagcaccuccaaacuuuagucauacaggaccaacauuuccaguaguaccuccuuucuuaaguagcauugcuggagucccaaccacagcagcagccacagcaccagucccugcaacaagcagcccuccuaaugacauuuccacaucaguaauucagucugagguuacagugcccacugaagaggggauugcuggaguugccaccagcacaggugugguaacuucagguggucuccccauaccaccugugucugaaucaccaguacuuuccagcguaguuucaaguaucacaauaccugcaguugucucaauaucuacuacauccccgucacuucaaguccccacauccacaucugagaucguuguuucuaguacagcacuguauccuucaguaacaguuucagcaacuucagccucugcagggggcaguacugcuaccccagguccuaagccuccagcuguaguaucucagcaggcagcaggcagcacuacugugggagccacauuaacaucaguuucuaccaccacuucauucccaagcacagcuucacagcugugcauucagcuuagcagcaguacuucuacuccuacuuuagcugaaaccgugguaguuagcgcacacucacuagauaagacaucucauagcaguacaacuggauuggcuuucucccucucugcaccaucuuccucuuccucuccuggagcaggagugucuaguuauauuucucagccuggugggcugcauccuuuggucauuccaucagugauagcuucuacuccuauucuuccccaagcagcaggaccuacuucuacaccuuuauuaccccaaguaccuaguaucccacccuugguacagccuguugccaaugugccugcuguacagcagacacuaauucauagucagccucaaccagcuuugcuucccaaccagccccauacucauuguccugaaguagauucugauacacaacccaaagcuccuggaauugaugacauaaagacucuagaagaaaagcugcggucucuguucagugaacacagcucaucuggagcucagcaugccucugucucacuggagaccucacuagucauagagagcacugucacaccaggcaucccaacuacugcuguugcaccaagcaaacuccugacuucuaccacaaguacuugcuuaccaccaaccaauuuaccacuaggaacaguugcuuugccaguuacaccaguggucacaccugggcaaguuucuaccccagucagcacuacuacaucaggagugaaaccuggaacugcucccuccaagccaccucuaacuaaggcuccgguaaaauuauuguuauaaaauaauuagauaaauaugaucaguuuuuuuucucccuaaugaguacauuuuucacuucagccuuguaaguuagaaacauauuuauaaagguaccuggcuuauaguauuuauuaaauugacagcaguuugaggguauaucuacaaugaacaugagauuuuuuuuucaaguguggcaggauuuuaggguuaauuaugcugcacaguuuuccaagaugguauaauuaucggguaaaauacagguauuucuucugaauugguacaaacugaagaagucuguaucccaaaagggagcuaaaugcaucugucagcaaaauguacguaaauaauagcaguucauagucuuuguuucagugagaaugaagcaaauuuuugguuuuguuguagauuccacaguuguacaguuuggggguuauaaaaaauuggaaguuaguaaggaaauugauacagaggagaaauaaauaaucuaauccuaggacugaaguaacuaaaauuuauuaucuaauuaugcugugguggauuuccucuuguucugccaccuucuccaaauaacaaggcuguguuacgucuacuguauuguaugcuucagccucuuucugcauugccauugaugugagguucuuuuuauaguaggauaaugcagaaucuucacucagauaaaauagaaauucuugauaauaguauuagauuucugaugccuuuuguuaucagaccugcccauugguuauuucuuaaccaguuacuguuuucuuuucucagaaaaucuuguuuuacauggcgaaagucugauacauacuguaccaaauaaguagcucaagaauaucuggacacugccacuuauguacauauagccuuuguucuguucucccuaggggacaacuuuuuacuguauuuuacuauucauuuuauagguauaucguaguaaccccuauaauaacaacauuaguugucacaccguuuuuuuaagacagauaccagagaguaaccucagugauaaacaugucuuaacuauauauauuuuauucuuauguuugugcauucaaauuaguugauuugcucuucaguacgcagucuuuauauuuagcgucucacggacuugauuuucccuuuguugucuguaggugcugccaguggguacugaacuuccagcagguacucuacccagcgagcagcugccaccuuuuccaggaccuucucuaacccaggugccucaagacuugacaaauuucuuccugugcccuacuuucuuugacaaagcuugcugaaguucuccacuacguggucuuggcuuuugccuauuugucuuugacuuaguaacaccuuucuuuuaaaauguuauaaccaaugacccaguuccuacuuaaguaagaagcuucauagcucuuuuguuuguaauguugcuuccgguuauccaaaaacacuugauacuaauuuuuuuuuuauaucuuaugaaggaagaaaacagcaaagcaaacauuuugucagacccauauagcucccuuuaucacucacacuucuguagaauagcgaaauugcguauauaaucaaaauuaacuuugagagugcccuagaaaggagaagcacaauauggcaacugagaaacuuuuuccgcgaguccagagcaaccagucucuucuugaauguugaucauuucuuucacuagccaccuaaugaaggaauuagcuuacuuauagguagguauaggggugauguuucaugaaaacuaugugugcugucucuuuuaaaauaaaagccaccgagcucagugagaugcuaacauuaugagaucacucauggaggaacugagaccagccucaugaacuugagauucccaucucacacaguucugcucacuugagugcagugguggacagaauuaccuguaauauuuauuauuucucuuucccaccgcaguccaccgccaacacauuuguugaauuuccauaagaaaaguacuaauugugaaucuguugugaccaggaaaaaucuucugacaugagacaagccaguaaacuuuuaaacuaaauuaggaauuuauuuuugaaucauauauaagaaauaagaaaaacaugguaaauugcuuacuugagaagcugaguuggaauuuaucccuauuucuuuggucccaauguacaggggaacacuauuugaggaacuugccacaaugaaguaaaaaccccaacagagaaagcacuccaucagccaccacauuugggggaaagugcauugugaaaguccguaaaucaggaguuagaaaauuaguuuuaaacuuauuuucucauuuaaaaacauggauucagauuucuaagggaguauaaagugugacaaaaaauagcaagugagacauguggagggguaaggguaaauagcuagugccuagauagagggaaaggccuaagcaaagacugugcaagaauagauugauagaagccaagacagauguaggauuagacuguggaaggguagaaggaagcugugugcuugcgguggauggaaugguuaacaggauggaauacccagaccuccuugccaccaucuguagggaagaaguauacauguaagaaagaggaaaauaauacccugugauagugacagaauauguuaaugccaucuuuuauucauaggggcaccuucccagaaagauguauaaaacugagaaagaaaagagggaacaugagauacagugaaucuaccaguagaucuuuguacauuuuucacaauauauuuuaaaggucgcacaaauaaauaacucuuucuaccguuuugaguaacaucaaacauagaauguaauaagacuucucuuaaacugcaaaaacaugaacuacucugagccuugagagucugacauacaaucuugagaaacuggcaaaauaaucaaagcaguacacuaaauuugaguauaguuuuguauguuccauaaagacaaauguuauguugugccaauauaaagcauaaaacaguguguccuaucuaaauuggcuauauaucgugacucugaaggugccacggaacuguauuuacugugauuguuuucauucagucccagcaaccucuagaggaucuugaugcucaauugagaagaacacuuaguccagagaugaucacagugacuucugcgguugguguaaguuuugaaaaucuugauaaaaucuccucauaacccuaauauauuauaugccugggacacaaacuguaaccuaaaccauuauuaauaccuuuaacauguauucagaguuccugcuuauucuagccaaaagaaaugagacugauuaaugaaagauucaugcugacucaggaguaucacuauggaaaagauuuuauuugaaaggugcuuuuuuaguuguacgucuggucagauugugccauagaucaauucuauggauuucguauuuuuguuucagaggaggcuaaauuuugucagauaaaauaauguuuugggcuaggugcaguggcucacgccuguaaucccagcacuuugggaggccgaggcgggcggaucacaaggucaggagaucgagaccguccuggcuaacacggugaaaccccaucucuaguaaaaauacaaaaaauuauccaggugugguggugcacgccuguagucccagcuacucgggaggcugaggcaggacaauggcguaaaacccaggaggcagagcuugcagugagccgagauugcaccacugcaguccagccugugugacagagcgagacuccaucucaaaaauaauaauaauguuuugauugaaacuguuuuucugugaauauccaaguuauacccuuaagcauccuaugagaaaaauuaagaaagcaaucaagaauuaagaguagaaauucauucuuuuaaaauguaccuuuuuuuuuuuuuuuuuugagacaggagucuugcgcuguuacccaggcuguagugcaguggcacgaucuuggcucacugcaaccaucaccucccagguucaagugauucuucuaccucagccucccgaguagcugggauuacaggugcccgccaccacacccggcuaauuuuuguguuuuuauuagaggcgggguuucgccauguuggccaggccggucucgaacuccugaccucaaaugaucugcccaccuugaccucccaaaaugcugggauuacaggugugagccaccaugccuggcccuaaaaggugccuuucuuuacaucagacuuuuagacuuuaaaagaaaaaggaaagaagauaaaauguucucagacauaaguguuucaucacauauacugucuuucugcccuuuuacaaagaccauaggaaaggcaacgaggcaaaaguuugagugacugaagcuaaagauuuguggugucugucuguguguguuuuacagccuguguccauggcggcuccaacagcaaucacagaagcaggaacacagccucagaaggguggugagaaacauccuuccuccuuuuauauuacuaauuccagcccuacccguaguugauucaggagguuuaccguuucaaagacacauuuccacguauuugauaacugaggagcauugguaguaauaucuaaagcuugaaagauuagcaaauuaauaaaucuguuccguuauuauuugucagaggaaagguuauacaggagguaaugauaagacccuucauuauuagcuaugccagauccuugcuauuagagauuaggaaauuaaagcauacuguauuuagaaaaguaaauuuacugauaaccucuuagcuuuugugacacuggauauauagggauagaagcuugaauagucuggacauauauuuguauugaaauacaaauguaagauuucaguuaaucaauuuaaacauuuuuauuuucaaggcaauuauauucucaauuggcucucauuuuaaaagugauuugcaaaucauuagaauggucuagaaauggaaaaaugaaaggggaauguagauuaucaaaauauguagaguaucaaguauguacaaugaaaauaauaaagauuacuaccaauaaaaagagaauguagaauaugaaaaagguagcuuuucaaaucauuggaagauggaauauuucuuuuuuuuugaaguggaguuugcucuuguugcccaggcuggagugcaguggcaucaucucgacucauugcaaccuccaccucccagguucaagcgauuuuccugccucagccucccaaguaucugggauuacaggcaugcaccaccacaccuggauaauuuuguauuuuuaguagagacaggguuucucccuguuggucaggcuggucgcaaacuccugaccucaggugaucugcccgccucggccucccagagugcugggauuacaggcgugagccaccgcgccuggcugaaagauggaauauuuuuauaagugguuuagaacaacuugaaagccaucuggaaaaaagcaaagguggaucacuagccuagacauaaguaaaguccaaguggaccaaagaugaaauauuauaucauaaaauaguacuauaugaaaucauaaggggauuuuuuuucuuuuuuuuuuuuuuuuuaguuuuuuaauuuauuaguaauaacaacuugagaauugcauaguauuaaggcaucaguucuuggagugugggcugaggacccuuuuggggugccuaugagggcaacacuauuuuacaguaaaacuaagacauuauuuuccuuuuucacuauagacaaaaauuuagccagcuguggugguguaugccuguaguccuagcuaaucgggaggcugagacgaggauugccugagcccaggaguuccaggcuacagugagcuaugguuuugccacugcacuccauccuagguggcagagugagacccugucucaaaaaaaaaaucaugcaugaacaaaaaaauguauaggucaauggauuuuaauggccacaguuaugaauaucuuauuacuauuauuucagaucccacauuauaacuaacuuuuuuuuuuuuuuguggcuuggaaaucuuuuuuuuuuuuaauuuuauuauuauuauacuuuuaaguuuuaggguacaugugcacaacgugcagguuuguuacauauguauacaugugccauguuggugugcugcacccauuaacucgucauuuagcauuagguauaucuccuaaugccaucccucccccgucccaaggggauuuuuuucaacuaucuagagcaggguucacaaacucuuuuucuguaaagggcgagaugguacaaauuuuaggcuuucuagaccauauagucucuugcaacuuacucagaucucacaaguagcaauggacaauacauaaauaaaugaguuuguguuucaauagaauuuauuuacaaaaacaggcaguaggcugaauuugguccauggaucaguuuggaguucucagauaaguuuaauagagguguuaaguucaaugucuaauccagaagcaaguaguaauagauauaaaauuuucuucauggaagaaaagugccaccgauugcaaauauaaaugaaaaacuggggaaauauauauauuugugggagggggagggguauguguagucauaucacaaaaagaacucguuuugcuaauacaaagaguuccuaaaauucaacaugaaccaaaaaacaaucaaaagauaacagaaaaggaaacuuagacaugaaaauauuuaauguccguaaugauagaaacacaaaguaaggcuacaagugauagcaauucccaccucucauugguaaauucaggggucuaauagccaccagugacuugguacagccucuggggggaucaguuuauaauagugaugucuacuacagucuuaaauggaaauaauucagcacuuucauugugguauauuuauuguacagaucuauaagagaauauuuauuucuaaaauagcaagaaauucugggccgggcaugguggcucacaccucuaaucccagcacuuugggaggccaaagcagguggauugcuugagcccaggauuucgagaccagccugggcaauauagugagacccccaucucugcaagaaauuuuaaaaauuagccggaugugguggugugcaccuguuguucuagcuucucaggaggcugaggaggaaggaucaccugagccugggagguugagauuguggugagcugugauggcaucacuguacuccagccugggugacagagugagacccugucucagggaaaaaagaaaagaaauucugaauaauuuaaaugcccaucaguagaagccugauuaaauaugaaauauauauaugguauauacauaggguaugacacuaugcaaucauuaaaaagaaugaggcauugauauggaaugaucucaaagauauagaauuacaugaaaacauaaaaaucgcucaauguucuacuagcuguauaaaauaaauauaucucuagaaagaaacucaaagcauuguuccccggaaagguuuuuaaauugcccaaaacuaaauaauucugagggcugggugcaguggcucacgccuguaaucccagcacuuugggaggcugaggcgggcagaucacgaggucaggagaucgagaccauccugacuaagacggugaaaccccgucucuacuaaaaauacaaaaaauuagucgggugugguggugggcgccuguggucccagcuacucgagaggcugaggcaggagaauggcaugaaccugggagguguagcuugcagugagccaagaucgcaccacugcacugcaaccugggcaacagagugagacuccaucucaaauaauaauaauaauaauaauaauucugagaacuguacuauccuauucuagaauuugccaguguuacauugagaaaauaaaauuagcugguuuucauuuaacaauggaucuuggcuggacauggugauucacaccuguaaucccagcacuuugggaggcugaggcaggcauauuaccugaggucaggaguucaagaccagccuggacaacguggugaaacuccgucucuacuaaaaauauaaaaauuagccgggugugguggcacacgccuguaaucccagcuacucaggaggcugaggcaggaggaucaccugaacccaguagguggagguugcaaugagcugagaucgcaccacugcacuccagccuggccaacagagcgaaacuccaucucaauaaaauaaagauggguccuuaauguccucaguaaaaucucauccuucauuucacuuacuuauauaucugaauuaaagaaugaguaauugaguuuuuaaagccuguuaaccuuuguuuuuauaguauauguuaauguuguaguugguaucuaguaguagagcaaacaauaacucuuuuccccuguuggacagagccucauggagggaggagauaaggaaguucucuuugccucuaacagcuuuccucauguguaguuugauuuugcuguauuucuagcuaaagggaaaagaaguuaacuggaaggagacacuuauguuuuccucauccauguauuuguuucaguuucucaagucaaagaaggcccuguccuagcaacuaguucaggagcugguguuuuuaagaugggacgauuucagguaagacagucacuuuguguugccuugauuccuuccuuuggaggaguugucuauauaauaaaauuacugccuaccuauuugggacacaauugccagucuagugauuucugucacauaguacuuuauagcucuuuuuagcauuuuccuaauaaaaguaauauauacuaaauaaaauauagaaauacuuagaacaguagagacacgguagauagucguacuaucuauccacccaccucccaagauuacuuuuugggguguauuuccuuccacuccuuguuuucuguacaaguguuuaucuaaaauuaacuaccauuucuccuguuccaaauguuacagcuuuuuuucccauccaguaauugguuuaccuaaccagucucuaucaucauuucucauuuuuccaacauaauaaguuaaguaacagcaaacaucuuuguguauaaaaauguuuuccacguuuaaaauaauuguccuaagauuaauucuuuaaauuaaaacacaugauaccauaucacuuuauuuuaccagguuguccaacaugugagcauuuucuggcuggggagaguaggugauauuuuucucauuuguaaacagguccugaaccuuuauaggugggcugaguuuguauuuguaaauacauggacaaaccagaacaaggaucuggauccucuuuuuuaguuaccaguuaguuguguugauucuugaggcauaccaggcauuuaacauuuaccuuguaguuuuucuuauucacaggcaacccuaaaaauucuacaaugccuugcuaauuuauuuuauuuauuuacuuuuauuuuauuuuuuuauuuuuaucuauuuauuuauuuuugagacggagucucacucugucacccaggcuggaaugcaguggcaugaucucagcccacugcagccucugccucccggguuuaagugauucuccugccucagccucccaaguagcugggauuacaggcacacgcuaccaugccuggcuaauuuuuguauuuuuaguagagacaggguuucaccacguuggccaggcugaucugaaacuccugaccucaagugauccaccugcuucagccucccaaaauggugggcuuacaggcaugagccacuaugccuggcccugaccuuuuguuauguauauguugacuaagacauaaaucugaauucuguguaugacaucaaauacgaaaguaaauuauuuacuuuauaagcguagccagccacacagaaucugcaucucaguacccauguguucucuaugaugguauucaauuuuucuuccuagucaaaaguggaggcgcuauguaaagagacaaucagccuacucuuugacagggaaauaaagugauucuuuuuuuccuuuuuuaaauugucugugauagaaauuggauauugagaacuuaaguuuuuaaucuuuguccuuuuuuaucagguuucuguugcagcagacggugcccagaaagaggguaaaaauaagucagaagaugcaaagucuguucauuuugaauccagcaccucagaguccucagugcuaucaaguaguaguccagagaguaccuuggugaaaccagagccgaauggcauaaccaucccugguaucucuucagaugugccagagagugcccacaaaacuacugccucagaggcaaagucagacacugggcagccuaccaagguuggacguuuucaggugacaacuacagcaaacaaagugggucguuucucuguaucaaaaacugaggacaagaucacugacacaaagaaagaaggaccaguggcaucuccuccuuuuauggauuuggaacaagcuguucuuccugcugugauaccaaagaaagagaagccugaacugucagagccuucacaucuaaaugggccgucuucugacccggaggccgcuuuuuuaaguagggauguggaugaugguuccgguaguccacacucgccccaucagcugagcucaaagagccuuccuagccagaaucuaagucaaagccuuaguaauucauuuaacuccucuuacaugaguagcgacaaugagucagauaucgaagaugaagacuuaaaguuagagcugcgacgacuacgagauaaguaaguauauuuucucuugugaaagaaugucagauaagguuuucagaccuagaucccagggccaagauuaauaauauuuuucgccacaauaugcuaaugucucauuucuuuuaaagagacagugccacagaagccccaccccauaccuccccaccacacacacacacacacacacacacacacacacacacacacacacacacacacgauucccaaccacugacucacaggcacaggcagcuucucuugcacucauacagacccauagcauuucuaguucuagaacuucuucauuguuacuauauuauuacuguauuauuguuacuguauuguauuauuauuuuuauuaauagcauauuguaucacuauuaacugcucuuuauuuauuaguccacuaaaugaaucuggcacugggauguaugauuauuuggcacguuuuguuuggcagauugggucagaguagcaaauucagcuauugugugcguggccucaaaagucaggaaauguuuuucuccuaaaacauuaucaaccauuuguuguuggcuaggagcuuguuggaacauggcuuggguaaugcaggccagcaaggugaguugacaaacuagaaucucgugguaguacauuuggggaaaagguucauuaguaacuacuacauacuugaaagcagguuuaggaauaugcuguuaauucuugucugaaugaagaggauuaugguauuuugaauuauguuugguuaucuuucacagacaucucaaagagauucaggaccugcagagucgccagaagcaugaaauugaaucuuuguauaccaaacugggcaaggugcccccugcuguuauuauucccccagcugcuccccuuucagggagaagacgacgacccacuaaaagcaaaggcagcaaaucuagucgaagcaguuccuuggggaauaaaagcccccagcuuucagguaaaaagcccuggacuaggucagccacagcuguccuaucuuuuguuucugucuccagcuguaugugaccugcugaacauuuguuguuuuuguuaaauuucaaaggaauuuggcucuccugauauuuuugcuuccuugacugcuguacuuacauuuauuguaccucuuuuugagucuauagaaguagacuuagugaauacaauggcuuauuccauuguaauccauauugcuaucuacugguaaucuuuauuuauaguuauucuuaaggauagacauuuagcuuugccuguuaacucguauaacucacauuuaaccaaacucuugggcaguuggaagaaaauacauuauucucuguuuaguaaaacuuggguagauucuuuguuuuaauggaugacuuagucauaauugcaacuuagaugaauguaaucgucauauagauauuuguguguaugucuaagugguaacuucuugauuaagguuuuuauuucauuuauauuggguuaaagaacuugcuagucauugguuaggcacgguggcucacgccuguaaucccagaacuuugggaggcugaggcaggcagaucacgaggucaggagaucaagaccauccugacuaacacggugaaacccugucucuacuaaaaauaaaaaaauuaggugggcaugguggcaggcgccuauagucccagcuacucaggaggcugaggcaggagaauggcaugagcccgggaggcggagcuugcagugagcugagauugcaccacugcacuccagccucggugacagagcaagacucugucucaaaaaaaaaaaaaaaaagaagaacuugcuagucauuaaaaucaaagaaauaguuaagugauacucuuuuguaauguaguauauauauauauuuauuuauuuuaagagacagggccucacucuguugcccagacuggagugcaguggugugaucauagcacacaacacaacagccucaaacuccuaggcucaggugguccuccuaccuuagcuuccuggguagcugggauuacaggcacacacuaccaugcccugcuaacuuugaauuuuuuuuuugagacagaaucccgcucuguugcccaggcuggagugcaguggcacgaucucggcucacugcauucuccgccucccaguuucaagugauccuccugccucagccccgcauaguagcugggauuacaggcacaugucaccaugccuggcuaauuuuuguauuuuuaguagagaugggguuucacuauguuggccaggcuggucucaaacuccuggcucaggugauccacccaccuuggccucccaaagugcugggauuacaggcgugagccaccgugcccggcccuggacuauauuuuaauugggauagauagagaguuucuaauccuuuggugaaauuaugguaguguuaacacaauuaguugaaaaguaaaagaagguuaaaauauguuaaaaagcaguugcaaacuucuuagcaguuccauucucuggaaagguucacagauauccaaauguagcacauuagggccaguucaugcagcccauuaguagagaugugauuguaagagaaaucagcuaauuucugaucugaucccaaucagaucuuuuuuguuuuuguuuuuguuuuuuugaggcagagucggcaguggcucaaccuccaacucccagguucaagcaauucucaugccccagccucccaaguagcugggauuacaagcauguaaucccaaaccaaauguauaagaacaccuggcuaauuuuuguauuuuuguauuuuuaguugcacuauguuggccagacuggucugaaacuucuggccucaggugauccgcccgccucagccucccaaagugcggauuacaggcaugagccacuaugcccagcuaugauccuaaucaaauucuaauccuaauuuugacauacuuuuugaguggacuugaauucaacugggaaccggggagcagagagucaauuuuaggacaaccgaccuauugaaagcaaccuaccaaaaauaauuuuaaacacccauugcucuguagugaccuccaucauuuuugaacaccucuuuuguauuugcucugaugcacguuuauaggaaagucuaagcagagacugccuagcaaaccuuuuuguauaaugauucaacacauuuucuaauaggguaaaaaaaaaagcaaucauggaauugcagaauggaaucuggguauccacuagguacucuggucuucuuacgcugcucagacauguggcccaucuagguuuucuaaagcuaaaaagcucuggaauaguacauauggcccuauuaccuauggauucuuuucuuuuuuuuuuuuuuuuuuugagugcaguggcaugaugucggcucacugcagccucugccucuggguucaagcaauucuccuuccucagccuccugaguagcugggauuauaggcacccuccaccacgccuggcuaauuuuuauauuuuuaguagagacaggguuucaucauguuggccaggcuggucucgaacuccugaccucaggugauccgcccaccuuggccucccaaagugcugggauauuauaggcgugagccacaacacccagccuaucuauugagucuuagugucauuccucacuucucccguuagugaggacuuuguucuucucaucaguuuguagcuuuugacccaucauucaucacucaguggaacaaaccaaauguauaagaacagugccugaugagugcaugggaagagcuggacauguuuccucaugccacuuuaucuuuuggcagguaaccugucuggucagagugcagcuucagucuugcacccccagcagacccuccacccuccuggcaacaucccagaguccgggcagaaucagcuguuacagccccuuaagccaucucccuccagugacaaccucuauucagccuucaccagugauggugccauuucaguaccaagccuuucugcuccaggucaagguaauaaagcaaccaucaucguccaaaaacaauaaaauggagauguugccauaccugggacaaaagccuguuaaggcggguugggagacuagcugaccagaacacagccuguguguuguacacugaagaaucugggugaaaagggaaguggagugauaaugagaaucggugggcucacugcucccauuaggugaaauuacuuuuuuucaaggaauuacagugaaaaguuacaucuguguggccuauaugacuugcucauuugggauuuggaacuuaggcuuuaauauuaggcugagauuuccuggaugaaauucuaagguguuuuagcaguuucugaagcuaauacauuuucuuagccauuguagaauuuuguuacuuuuaaguaugggaguggcauacuaaaaugaauaaccuuacaauucaguuuuuuauccauaaucuacuuuccaaauauagcucuguuuauuagugauugcugaaaaaauucccacagaggaaagagcuuuuagucauauuagaacaagaauugaaaagacuugggcaucugggugagaagaaugaaaaaaauauagguacuggcuuaugugccuuugccacaguuucacagaaauuagagaucagucucuucacaggaagaaugcacuugauugguaaggagggcaaacuagcuagcauuauucgaacuaagaaaagcuuccgcauuuugcagauggguagaauuaagaccuaauauuucaucucuuacauaucugaccuuccccccagaagcuuguucuucugugugccaucuuagugcauuucaccacuccagccucaaguuucuaacaucuuguaguuguguucugucucuucuccucucucuguucuacccuguuuuuccccucucacaggcugugcgaaguuuaacugugcaucugaacaggugacauucaaaccugguggcaggaggacccgauuucugaguacgcccugcuuggcucuuuguguguaacaccuuuacuccuuccuuguccuuguguuucugcugcuuggaucugauguuucacgcaguccauuuucauuugucucuuuuuguauaucaucuacucaguggcuuggcugaauuacuguuacccucagaaguuugggcccccacauuaauuaugauaaaaaaugucaaaauaacaaguuaucuacaaauuucaauguaacuuucugguagaagugcuucuucauggaucugugacagagaguggauaugguaucuaggcaauagauugcugggucauuuagaauaaugaagacugaacuccacagucguagucagugcugucugucugcccuagcauuagaaaugagagaaaucagccagacacgguggcguacaccuguaaucccagcacuuugggaggccgaggcgggaagauugcuugaggccaggagcucgagaccaacccugggcaacauggugauaccccaucucuaaaaaaaaaaaaaaaguuagccuggcaugguggugugcaccuauagucccagcugcccaggaggcugaggcgggaggauuaccaccuuaagaccaggagguugagacugcagugagccaugauugcaccacugcaccccagccugagcgacagagugagacucuaucucaaaaaaaagaaacgaaaugaagaaagcauuuugaccaaugaugcucuuagauccuggcagcagguaaaaauuauguaccauuuuuuuccauucuuugucagaguagauugaaaucuuauuuuucuucucuauuaagccuaagcagcuaccaguugaaaagaugcuaggaucucuucauuggaucauuccaccacuacuguccucuaaccccauaaaaucaaaagcgguuuuuaguuugguuauucugauaaagcacuuagucuaauaaagaucaaagcccagcaucugcaagugaaaauucuccuucuaacaugauuucugggauuuugcagcuuucuacuuaaaaacaaggcacaauagcaagucaccccaucuuccccauaugugaaauggagaugaugccaguguccuagggccaucguacaaaucaagcuaagaucauguacagagaaacagguagcgcuugaaaagcacucaugguuucucucugaugagucagugccuaccuggcacagaacagguagucaauaacuguucguggaagaacaguuuaaaacaaacaaaaacauaguucaaguagaaaaaccuuuguuauaauuugaauaaagaucuucucuguuaaggccucaaacuucugaugugauuauugaagugcuuuuuacaugcaugugcucaggccaucacuguuucugaguaugggucagaggcccuugggccucuucacggugggaagaauuuacaaccucccuuuguucucuguagugacuagauuuaaagcgaagcauaugacacguuuaacugccauuucccucacacauaccccuguuauuuuuaccugcauuagaaauggauuggcuccuuccagcaccccuauuauuuguaccuguauuaguaaugaguuagcuguacuugagaggcagucuuuacugacuuuccccacaugcacuagucccaggcuguuuaacaaagaagcggguggaaggcauuacccaauucgaucguuuuccaggcuugugugauuuuuuuuuugaggacucagaucaauaauuuuucuggucagacuuuccuggacugugcauauuagcacuuugacaguugaauaagcauuuaauuugcauguccaccuagaaaguugcaagggggguguuuuugaaguagaaugugacaugucaggccuauggucuacagccugaagugucugagagggaagaaagagaaccaaagcuucuguuucugaaauauaaugugacaaauaccacuuuaauuaaauuccauaaauucucaucccacuuuuaaagguaggugguauuaccccuguuguucaaaugaaaguggucagaaauauugaaucuugucacuucccuuugggugcaaaaugaaaggcccuacauccuuagaagucacaucaggauacaucauguaagccugguaaacaaaucccaagagacauacuugaaauauggaaaggaaacagguacuugaaagaguagggcaccuuacuagcuugagauguauuauucuaugcucucaaaauagauaaugguuuggaagcacggcuuggcuuacugcuauauuuauguucagagguugcuuguuuuccacguacuuuuaaaaacuauucuggaagggaagggguuaguauauauaugugggauguggaaauauaauagccaauuuaaaugaacuuaaagcuguaacagugauacuaucagucuacuguggugggguugcuaaugcauuuaacugagugcuuuuuaacagcccagcuggagaaacaggaagugggacaggaucaguggaaacgcugcuuggguauuugaaauucaagcagugagaccugagagacuggaguuccucgccaauuccagaaccucagugcagggcauuacucuuuuagauacaaagauuggguguagaaacuccacaucugucagccacguaacacagcccaucagauaaucauguuaaggcuaacagccaguucgaaacauucuguagaacuauaucuguucaagggcuaccagguccuaccuaucugucucaccuccugcuuucucuugcugggcguuugugugcuguuuggagauucuaaauauuuuacacugauguuucuuuaucuuuaacacauugcuucucucuuugugcuucagggaagauggugaaaaaagucuguccuugcaaccagcucuguaguaauuaucuuuucuguuauuuuugguccuugauugcaaagccuguuaaccaugaguucuuucaacucugcagucucauagcucccugauuccuaacuuccaucuaucucuguauccuauucuaauaaauauuuaacaugcuuaauugagaaaucaucuccuagucggugcccucagugauaaccccaugugagccuagcuugugacagacauggauugguaauggccauggguauauauagggaggucagggaugccuaguuccuaugggagagcgauccuuuggucagcaaauaugugccgggcaguguuauuaccccaacuggaaacucagcagugacgaaagcauacaaaaguccaugcccucccacguucacacugaagugggagaugugugcuagauugacgaggagaaaaacaccacuuucuagaguuugucuucuuagacuguggcuucucauacuuuaaugagaaggccacuuacaguguuguagguagggucaacagggaaauucuguacuugggauguugggcuguaaguuaugguucauaauagguuauuguuaguaggaucuggugaugugggaauaggggaaauguauuauaauggcaggaggaaauuuaaaaaugaaucuuggggguaagucuauacuacuuauuagggcuuuucagaagaacuaaaaaagguuaagaaguuagcauauucucucaaaggccuuucuacaucuuuuauagucaagucuccuuuucuuaggaguuaauuucuggucagaaaaugauagguuuguuucauucuuuaaugggaggccuguauacagaagccagaacgugaagguuuagcuguaugguugacucuuccucaugguuucucuuuccucauagagaauccuguauuagguaauguaggguaaaaugaaaagugaaauuucguucuaaaggggccucgcagcaucaggggcgacagacuagagaggugugucucccagcaugagcucuguggauaagcaauggucacgccuccugagcuucuuguauuuagcuuuugacagcucugcuccccugugauuauuucuguuuuuuguuuugauugucucucacaucaagcucaccaagcaauaauuguucaaacaggaugacaauccccaugcaugugauaugcuugcuuucuagauugagucacucacugucaugacugcccauccucauugccugugcuucccacuucaccacucucucacauuggcuguucauggaaggcuguuuucugugcucucaugcuucuccccucgcguuuccuguacuguagggagcuuacucuucccuucacacuguaugugcaauagcaauccccuuguggcuccagcagacaccaagaaaugagcugacacucacacugcaguaguuccgugucuugccauagcgguaagaagcaugugaccuuccucacugcagcuucaccucagaauuagcuguuacugcagcacagaccugcuugugugugccauuccccaggugguaggauauaagcuugacuugagaccagcgauggucaguaacaggcuuugaaguggcaggauugcguuaggugugcugcugugaucuggugcugcuuugaccuugaaagcaggauaacgcaugcacuuacuuacccccgcauuacuuggguaccuuaaggacuagugguucacaacuuacuuuaggagcuuuuauuuauucuguaacacgugagaucugguaagacagugggggguaaggaaaacagacaagaccaugacucuucuuucccucuuccccaaaacgugccucuuggaauaaucuucagugugcccuccagcagagccgaaaucaggcaggcauagacucccuccucucucaucaaaccgcagaaauagaguuccuucaucauaaccgcaaagcuuccuccuccccuuugcacccugccucagcugcauuuucuugucgcuucuacaugggagugcuugcuguucugggaagaguggggagaagcggugggaauccuugagccaauugaaacugaggucaucuucaggaaaaccaugucuuccugaaguugaaagauucaggcacaccauacaguccuuuccucaugaauaaucuuguucuuuacucaugggaaauugggagagguuaaccccucccaaguuuauguuugcaaauucauguuuauggguccaggugaaaaacuuuucugaacacagcaugcuacuucucuuauuaccucucucuauuuaaagaauggcuaggcugagcaugguggcucacaccuguaaucccagcacuuugggaggcugacauggcaggauugccugagcccagcaguucaugacuaagcaacauauggagauucugucuauauaaaaaaguaaaaaauuaacuggguguggaagugcauacgucuagucccaagcuacuugggaggcugaggcaggaggaguuggaggcugcagugagacgugauugugccgcuguauccagccugggugacagaaaaagaagagacccuuccuuuaaaaaaaaaaaaaagccgggcgugguggcucacgucuguaaucccagcacuuugggaggccaaggcgggcggaucaccugaggucaggaguucuugagaccagccuggccaacacggcaaaacccugucucuacuaaaauacaaaaauuaacugggcaugguggugcacaccuacaaucccagcuacucuggaggcugagacaggagaaucgcuugaacccaggaggcagggguugcaguuagguaggaucguaccacugcacuccagccugaguaauagagugagacuccaucucaaaaaaaaaaaaaaaggcuaaagaauguggcaguguccaaugguuuggaaacccaccuucuccuuauccuuagccaagcaucuuuuccuacuccuacuuuaaccgugcccaaugcacaagaaaaccucuuuuucccugcauucugcaaaauuccagagcaacuagccuugcugauuguaucacaccuccaucagcaacgugaugcugggaauagcguacuggcgagcaguuccaauacucuuaggugcuuugugaauggacugaaagaggccccugccuguguaccuaccgucauccugaguuguucagccuuagcagcagcuacugaagagaaacuguuuucaucacccuauuauaccaaaacaaauggcuaaacaaaaccuuggaaucuucccucuugcauggcuucccaguucauccucuucucauucuguggcuugccauucaucaucccgugaaguuuucccucuuccugaaauuguaaccuaggcuucuuuuaaugcucguauucuguugcuuauaauaggaaccagcagcacaaacacuguuggggcaacagugaacagccaagccgcccaagcucagccuccugccaugacguccagcaggaagggcacauucacagaugacuugcacaaguugguagacaauugggcccgagaugccaugaaucucucaggcaggagaggaagcaaagggcacaugaauuacgagguaagucucucuuuugccgcagagaauccguaacacacaucugagucaaggugauagaaacaacuaagcugcugcuuaacgucuuacgccacgaccuucuucaauuuuaauacuuuagaaaaacaaggcaaaaaucccccagguacccuuuuauuuuuccuucccugaauuccuaaccucuuguuggucagcucaacuuuuucuucuucguuuuuccuucgucauccucaacuacacacacacagacacacacgcacaugacaucccucccucucaugaggauuauuuucacccuuacuugguaaauauaaagagccaauaaauacuacagaagacuguucugcuguaucuuacaggauuauacuagaaguauauguuagcgccacacauuuuauaccauggcccacaccagacuugacacguggugguuuuguuuucagggcccuggaauggcaaggaaguucucugcaccugggcaacugugcaucuccaugaccucgaaccuggguggcucugcccccaucucugcagcaucagcuaccucucuaggucacuucaccaagucuaugugccccccacagcaguauggcuuuccagcuaccccauuuggcgcucaauggagugggacggguggcccagcaccacagccacuuggccaguuccaaccugugggaacugccuccuugcagaauuucaacaucagcaauuugcagaaauccaucagcaaccccccaggcuccaaccugcggaccacuuagaccuagagacauuaacugaauagaucugggggcaggagauggaaugcugagggggugggugggggugggaaguagccuauauacuaacuacuagugcugcauuuaacugguuauuucuugccagaggggaauguuuuuaauacugcauugagcccucagaauggagagucucccccgcuccaguuauuggaaugggagaggaaggaaagaacagcuuuuuugucaaggggcagcuucagaccaugcuuuccuguuuaucuauacucaguaaugaggaugagggcuaggaaagucuuguucauaaggaagcuggagaacucaauguaaaaucaaacccaucuguaauuucgaguggguggagcucuugcuuuugguacaugcccugaaucccucacucccucaagaauccgaaccacaggacaaaaaccaccuacugggcucucuccuacccugcccuccucccuuuuuuuuaccccucucuuuuuuauuuuuucuuugcucuuuagaacccagugaaaaauaccaggguacuggggugcaacucuuucuuaugauaggucauuagugcuuuaagcaaaagauauuagcagcuuugacugcagcauuagcaauuaggaaaaaaaaaaaauuaaguucccugcggacauguaacuuugccaucaguuuugauguggaaacacugugauauauaaaauguuguuggacaacaguaguuuuaagaguaaaauaugaaacguuuaaaaaguuccaaaaaaagcuagcucuguccuuuacuuauugagacacuuuaacuuuuuccuuuguauuuccauuguauuagauaaauaaaugugaauguaaaauuguauaaauuacuguacuugaauacuucuguuucccaguguugcuugcuggacauuuuagugccuuggacuucuauugcuucugccauuagcaucaacuuaccagaccccagaucaauaaagggcauguggaaggaaaucguagguccaugugaccccagcaguccagcagugguuaugccaaagggaaauugaaaaaguauuuuuuuaagucauucaacaacuuugucuagagcagguguaagaugaguagggugggaaguuagguuggcaucagugguuaaaaacagaaaguucuguuucgggaauagugaggaggggguguuguaacaaaauuggacaacuuaaaagaauggugugugcugggugaaagacaaagacuaaagaaugaggaaacaaacgugaugccuggccagugacugucauauaaaccuuucuuauuugagcuaggcuugaacagacgugaccuagaagaaacugaacauaaagagaaggggguggggggcuaguuuucaaguuggggaaccugauagugaaaagucacagauggagaaaauugcucucagaaaaacuguuuggauugcuuuccucuuguugcacauguaccaugcauuucucagcuugggguacuacauuuuguggaaaguuaaucuaucuaucuuuccacaucugaauuaaucauucuaggaaagaauacuuauuccuacucauuuccuuuaugauguccaaaugguugcaggaucauaaucuauugugccaccuuuauuucuagaaguacaacuaauauguucacauuuucaaauaaauaauacuccccguaaguaauaacugcaaccaaucaguguuauucagugcuaugccuccuuguaauggguaguuauuaauuauuuucagagcuuuccggaaauacuguccuaacuggcuauguuuaggaucuuuguuaucucugaagacaaagaaagaagcuaggacucuuaauuuuggggugcuucuugacucuuaguugggaaacugaaaauauuuccaaccuuuuacccacgucaauggcauauucugggaaucaccaccaccaccaccacuaccacagaaagaggcuggaggcuccuguacccuguucauuccuuaagggcccugcuucccuuaguaaguaaguaaguuggucuacggcccuaaauaugcaaaugagagcugaagguuuuuaaaagguagaaaggaaaagggcaagggcuuccaccccugcuuuaaaaugauuuauuuauucucugcuuguauuucuuguggagagaguaaggauagaaccaacaaggggcugaguagcugagaaaggggccacccaagagugaaacauacuuuauaccagaggagcaguggagccucaugcagcacauuaucauuuguuauuuggguuuaauaauaauuuugacaucuuuucacucauacacaaaaaaagucagaacugguguuauuuacuguugauuucauccuccuguguaugaaauaacaagccuagaggaaugaacuagugcuacugaacuguuuaaauuauuuuuguguuaauaguacacuuugaguaucuuuuuccacauuaaaaacuuucugaauuauaaauguuuuccuuacauuauuuaacaauguacacuguuaaaaauaaaaauaaaaauucaaacuuuggggguuucucagcagccguuaauuguacauuuugcacuaacucuggguguugcgcuucuuguaagauugcgcuuugugcuucaguuuguuaccuuuguagacuuauuuaaugaaaccauucaaauaaaccaaacuugcuuuuguuga

SEQ ID NO: 191685 - RNA, 101516 nt, Homo sapiens
auggggagcccccgggccgcgcggcccccgcugcuccugcgcccggugaagcugcugcggaggcgcuuccggcugcugcuggcgcucgccguggugucuguggggcucuggacucuguaucuggaacugguggcgucggcccaggucggcgggaacccccugaaccggaguaaguagcacccaggggaggcgaagggcgcgggggugggcggcggcggcggcuccugcguuggggggacccgccucucaucccauccucagacccgauuucccacccauuucucccucaggugcccggcgucgccccgcgcguacucggggagagcugcgggcgggggaagccgcggggccgagcgcagaauucccgagcccgggccugcccgccggccacguggguccggggcacccugggggcuccucgcgucuccccucggagagcgacccggagagaggcuccccgcccgucccgccgagacgcuggcggagaccgggccccuccagccgcuccgggcuugcgguucccggggaggagguccgugggguccacgcgcgagcuagggauucgggugcgggaugcccucggccguccacacccaggcgcgcgcuccaguccgcgcagcccaaacuuugcccaccgccuucuguuuggcucacuccguuuccucuccugcugcaucuucuagggggguucuuuuuuaccauaccucggagagucccgucucuuccccgcuucccauacgucgcuccucucccagccuccguccucggcucuuugaaucucccaccuccucgcugcgcccucuuucuccuguucgggccgccccuucugccacuuuucugaacccugagcaaaucuaccaaacuccccaguuuaaggagaugauggacagcacaguggaccgggcagcagguagauuccuacuucuguuuuuaacuuagccaaagccacuuaauauuuccgugccucaguuuccuccuaggaaaacaggagagcguggucucuuugccuuuuuacaucaauagguauggcugugcgaggugguuuucaacguacuguggaugggccuaacaaaguaaaacugacagugacaggggccguaaaagauccuguaauaguugggaaaagaaauggagaaacucccguuacuaccaggugcccaacgcaagcccggggagccgagguucaaaguucuggcacguggccucccaugccuucacuuuccucccgcuuuggggaaacucggacagaguggcugagcaagcagcugagaagauacucugacucugaccugucgucgugucagcuucucuacccagaguuggguguggugcugugccuucucuuguggccaaagagagagaauuacuagggacagucgcugagcugguucagguuggaaauguauauuuauggccuaaccuuucuguggugauggaaaucauuccggcugugaguuagaggagacuggcucugccacuaacuagcgggggaaucaagggaaaaacgacagcuucucaggugaaaaugaggccuuugguccaaaugaucuccaaggugucuuucagucuggauacgaagacugaucugcacgcaagcguuuccagggccagagagcucagcacaucaccaggaagccauagcuuccaccccggggccacgacuccaagcagcagagccccuuccucugaugaccaaaaucugccgcccauagugaauucuucccuccucugggccuuguucuuccuucugaaagacagagagugaaucuauucucccccgccauggccacucaggcccaaauggaugagcuccuuuggagugugugugggugggggccugggaggcgacaccuccucccaguguagccaucauuuuguuuagccagugggaucuugugcacaaauuaaaaacagagagaaaggcaguugcuuugugaccuuggaaucaguaaccucccuuucucccucuccucacuuuucuuuuaccuccgguguguuuucuccccaaaccuggaucuaguuugccacagucauaaucugacacucuggcccucgaccucugccucugucucccgugggccgccucauuccgagccaucaauucuugagucuguuggguuccccucccagaagaaucuuaacucucugacuggguuuccuuauuuuuuauuuucuuuuccaaaccaauuauccagaaaacucuucccagccucuaugccagaauugacuucguuuccuuacucaugguuuuuaacaggaggcuaagcucacacacugaugcaccuuguuuccucucuccucuuagaacccugaaauucaucuauugugcagggugucuuuuuguccugcgcugucccguuauauucuacucucgauuucccuguggaauaagauuuagacuggagcugugguuucugccuccuugucucccauccuuuuuuguuguuaagaagcccagacaucuugcaucaaaguucccucuuuuccuauagguuucauucucagcucagagcuauuccucuggagggagagccagggaggaggcauuaggaaaggagaggugggaaggggguugcuagcauucccaccuccacacucuuggauaccaacaggaaccaggguaguaaaacugcaccucccaggccuguaccucuggccucaaccacagcaaccagaaccagcuuguuggcucugcuuuccagcaagccacccugccuccccucucuagcaaucccugccaacucacuccaccacccaccagcucccugucaucuggaaggccagcccccauuaccaggaaccuuucauuugccugucccuguguuggaucuggugcuggaagaagaguauggagagauggcagucacaaacuccaggguuaccaguaaugacaggggagcauauuuccuucuuuaucuucgugaaauaacccaguaguuuaagauguggaugaugugcaauuugguuccauaugcagaaggagauacaaccacaacuggaguggcuucagagaaaaacaaccaaaauccuuaacaaauagaaaauugacaaaagaauuaggacuguucacgcauucauuuacacaaauauuuacuuagcgcauaccucgagccaggcauugugccaggccguguaggugugaugaccaggaugugguuucuagcaucuacagcuucauuuaggaggaaagcuaaggugccuauaucaaaaugguuguaauauaaagcagucauuaaguuuugcaaacauaggacgcauauguuucugugacaccucuugaaaugggggcacagcucucccaacuaauauuucauggaaauggugacauuuugggacguuuugaagaguugguaagauuuugguggauacagaaaggcuauucgagacagaaagaguuacgucaacaaagaccaagagucggggaaaguuuauguuugagaauacugagcagcugaguuuggugaaacagaggguauaagaagaauagaggaugaugcuguauguggaaggcugaauaaagaccuuaaagaguggcauuuauucaguagcuagcagaaagcaguugaaaguuuuagaauacggcagcauuguagaaugggacggguaaggguaacaauacuuuugguguggcauggugguucuggaacaggguccugacgaguccccuuguugagcccaacauuaacucuuuagcugcugggucgugaagcuguccuggggagggguccggguggcagugggacacucagagggccuggggcagccacuguacuaacacaugcuuaaggauuucaguguuuuaauaagugguacggcuauccugguguguacuggcugaaaagcagcccugggaacaaauuguuauuggaaguuaaagauucuccaauuaggcagguuuucacaaguuauauacccauuuguucauauuggaucagcaaagauucuaucugaaggcagaguucuggacuagaggccgggggugguggcucacaccuguaaucccagcacuuugggaggccgaggcgggcagaucauuugaggucaggaguucgagaccagccuggccaacauggcaaaaccccaucucuacuaaaaaagauuaaaaaaauacccaggcaugguggcgcacaccuguaaucccagauacuggggaggcugaggcaggagaauugcuuaacucaggaggcagagguugcagugagcugagauugcaccacuguacuccagccugagugacagagcgagacucuacuuaaaaaaaaaaaaugguuucuagagaugaaauaucucagagccaagggaugacauuugggcgcaaauccaagacagaaggauggcaugugcuggcuccuuuuagaucucccauuuaagugccaggauuacuugcuggaucccaaaguauucugaagcucaggaagccguuggcuuucgcugccuuaccucuaucuguaccacaucucucugguuggccuuugugacuucuggcugacucgagugggcugagggaggcacacccgcggugugaggcagugacugcagcucuggccaccacagccguucugauuuggaaaggauacaaacccuccagugagagagguaaugcagggcacagcaguaaucugagaugcaggcagggagagagggagaagcaaaugagacagaugugugggcagaggagggauaguguggcauggaguugaaacccagugaagcagcaagcacaaccgccucgugugcuccugugggcagggacugugucucaugcagcucuggugggugugugccucucugucccagggaaccuccuuuucacgugguuuaccucucguguagcuccuuuucacguguccgguuuaucgcucuuuaugcugauauuccagucaccaggcuacuaugugugucuucuaaucaacuuucaauucugggcacauacuaggcgcucagauaaguaccuucucguuaugaaugugucagcucugaauuuccaagcaccugauauuuuccacuggcagauacuguguuuaucagggacugauccaagaauagaaccuaggaauucuuguucccuguaccauaauacauauacacaacaauagccuuugaauacaaauacagaagauaagcgauaagacaucaaugguuuuuuuuuuuuuaaucauaagcguauuuucuuugggcauugccuauacgaggaaugcaguuuuugacaauaggugaccuuacccauauuuagagucucuccuuucccuggucucucagucccugugcugauguggccggcgaaccucagcaacacaucugccaucuuuacccugccuacuacccagggacccucaaguugaggucccauuccccugcuugauggugcuggggcugccugccacucccuguccugggaguugaggucccauuccccugcuugauggugcugggguugccugccacucccuguccugggaguugaggucccauuccccugcuugauggugcuggggcugccugccacucccuguccuggggguugaggucccauuccccugcuugaugguccuggggcugccugccacacucccuguucugggaguugaggucccauuccccugcuugauggugaugggguuuccugccacucccuguccugggaguugaggucccauuccccugcuugauggugcugggguugccugccacucccuguccugggaguugaggucccauuccccugcuugauggugcuggggcugccugccacucccuguccugggaguuguucagacgcugugcaugguuauaacugcuuuguagcacaaggucuucugaaagugcuuccgugcuggcuucuggagaggcugguaaguacgcugcaguaauuuuccaggccauggagccugggcuugcccucuagugcugagcuuuguggagcagagcagagcagccgacauagcagaguuugcuuuggaagggguccuagaggcuguucuuggaguuggccgcucgcugucuaguucuccucugcagcguuccaccagucucaaaaacuacgcuuuuauuuuccacaagcacuuuucguuauauguaaagauuauguggucucaacuaggccaaccagacauuuggaguuuucagacaauucuuugaccuugugauucacauaauuaauagauuuauauguuaaccacuauacaaaaaugcgaguggaagaggugagaauagucggauaguggcucuaaagggcacugggcugcauguguuguauauucugagcaaagugugacagaucuuuaaauuuuugcagacucaaguuaacaagugcuacuuugaauuuagaaguauccauuggaugagcaaaaaugaauauucuuuguauucuuguaauauuuuaguauauaauuuauuuuuauguucaauauguucuuuauuucauaacuacaaaaggccugauacugaccaacuuuuaagaaaauaaacaugcaaaucgucccugugguuccucuuuuuuuucaaguauauguacggaaagcuugaugagcaguuuucacaaacugaaaauaccuguguugggagcaccacgaugaagacacagaguauuaccaguaccccaguaccccggugggggcggugcuaugaaucacuaccaucagcauagauuaguuuagcauauuuuaauauuuuauauaaauggaauaauacagauugugguucuuuuuuuauuagcaauuuuuuaaauuaaauuaaugaaaguauuuuuugagacugagucuuacucugucucucaagccagagugcaguggugugaucuuagcuuaugcagccuugaacuccugggcucagugacaggagugagccacugugcucggccucauuuuaaaaugauauucuuuaugaugauaaaaauaaugcagccaggugugguggcucacaccuguaaucccagcacuuugggaggccaaggugggcagaucacuugaggucaggaguucgagaccagcccggccaacaugaugaaagcccaucucuacuacaacuacaaaaaguagcugggugugguggugugugccuguagucccagcuacucgggaggcugaggcacaagagucgcuugaaccugggaagcagaggcugcagugagccaagauggcgccacugcacuccagccugggugacagcaagacugugucuuaaauaaauaaauaaacaaaauaaaauagggauaaaaauaauccaugcuuauuauacuagacaacagcuguguaucuggaccacauuaacccugcgaaagcacuuuuuugccuuuaggcaccacagcaucacuaacaaaauaaccuaaggccaaggaagaccaggggccucaagacugcaggauacauaguagccucuggaauucuccaguagcacccugccaggguggaguugagaacuguugcucauuccuguaugagaacgcucuaaacauguuucuucuggucuuggucuuagaaacagcugugcuucucuugagcgguuuguuuuaauuucuauuggucacguaaguugcauaaucacucagauuucucucgucguguugguuacuaggaagcuuuaggguucaguuuuuucuucaccuggagaaaaguguaaaggauuuuaugaucuguauuuuucuacuaauuuuaugacuguaccuuuauuuuaucuccccacucccacaacuaacuacuuccaguuuaugucaucuuaucuuauauggucauuguaaacuacuuuaguuuuuccuggaccaaaucaaggcauaaaauaaaucaacaaaagugcuaugguauacauacaaauaugaagaagaaaugaacaaucaccuaaaaugucaccacucugaccuagacauuguugaaaaaaugaaguguaauaagcagugauaagcagauguuggauuccaggaugccuuagacaaaaagucuggauuuaaaaacuuaaaaagccaaaaaaguauugcccugaccuuuuugggggucuuuauuuagguacugaaaaguugaaucacauccacaaauaaauuauuacgucuuuccauauaagaagacuaccaaaagcuuagaauuuacugacagauauuggggacugagccacuuuuguugaaaacagugacaccauacaaggcaaauucaauaaaauuggaggcauccuugacacuaccgagagaacagccgagagacuggccaggaaggccagaaaccuggugugucaugugggcacccaucccugcaaaggucucacaccagcuccucacaccagcaaggacaccucaacaugaagaucuauggcugcugccagccuguggcuuuuggaugcauaaagucacaaacuaauuuagagaccuagccccuguauuagcagcugagaaucccugcccagggaauagacuucaugugucucuuccacccauuucuucuuugaaauuguguucucguggugccuagcagaggcuaugugugugucucacucugcacagcucacauucugcuuuguggccacacgacccaggaagagggcccacaaauggacgagaauagagagaggugggaguggaaauagagaaaccacauuccaggccgaccaaagacuuuauguauaaaugcucaggaaauugaacguuguguauucugcaguuuuuauuuauuuuguaaaccuugaguggcugcagaagugauucauucuaaacuuaaagcagaauguuuauggagcauuuacuuuuuguggcagacucugaguggacugaaaagcauugauaauuccuggaaaaacuguggagucugaaggcagggcaagguuccaguucaagcgccaugacucaccaaucgugagaccuuguaggaagguacuuauuccuuuguaagucucgggagccuugucuggguaguggagcuauaaugcuguucccguagaacuuuccuuaugacuaaaugagguuuagugagccgagcacauauuaggaucucaaugaauauugguucccaucuccucccucucagucugauaggaauuagagaauggcugggcaggaggggacaaauagacacauuccucaacuggcccuuuuuccagugcuucuuaaacuucucagcccaugacacagcuguguccaguaccccagcauuacugugccauccauauccagcacuugccaccaaauacacauucuucaaucacuuuuuuccuccaugauguucagcaaugccugcaucuuuccaucccaggcaaagauuuauauuaggggugggggccagguuaggagucaaggauuuugcggagaacgagagcugucuggggggcuguaccaggacacagaagcacagcaacugggaagcgauagccucucacucugcugcauaccccuguguacacacugggauuucugggacuaaaaggcaggaacaccuggcaguuaucucauuauuuauuuauuuuuaaaaaauuuuguuuuuagagauggggucucacuauguugcucaggcugguccugaacucuuaggcucaagggauccucccaccucagccuuccaaagugcugagauuacaggcaugagccaccgcgcauggccaguuaauguacaccgugcauggccaguguacauccuagcuuuguaacuaauuugccugguuuccugucuacaggaaaucaguuuaccuguaacuaauuuccuguccuuuugagggcuucaguuccauaaucuuuggagugagaugcuuccuugcaggaguagauuuggaaguugcgcacgucacuaaggggugaaagggacagucggaagggaauaucuuugacaucuggcccuggucuuucaaggcucagucgccugaaccgagagguggcagcucucccaauaguucugacugcuuucgccuccaaggucaucucugacaacauggucuccguacaagcaguugccuaaaagauuaaaggccucccugcugagaucuucuuacaaauccucugauccacugcuuuccacccugccugccaagcccagguucaaacgaaugugugcagugugugcucacgcacaccucccucaccagccagcuggucccgacugcucaccagcaccucuuagcaaaggugggcaggaggaugaggacguggaggauucccucauggaccaggcacacagcgcaauacguacucucugucccgggucuccuuucuucccauuucagcugaguagagggccugggaaagggcaguggagaugggcagcacgucccaggugaaugacuuccgauagcagaaggcaggggacguugcacaggcacagaaaauggguagagaaaugagggaacgaaauggagggagagaccgcuaccccauuuuuucauuuuagugacuguuuuguuuuguuuuguuuugagauggagucucgcucugucacccaggcugaagugcaguggcacgaucucggcucacucuaaccuacgucccccagguucaagacauucuccugccucaaucucccgaguagcugggauuacaggcaugugucaccaugcccagcuaauuuuuguauuuuuagguuucgccauguuggucaggcuggucucgaacuccugaccucaggugaugcgcccgccucagccucccaaagugcugggauuacaggcgugagccaccgugcccaguguagugacuguauuuuucauaucuguaaguuuuauuuuguucuauuucaaauuuguuggguuuuuaaacacuacauuguggcugggcgcgguggcucacaccuguaaucacagcacuuugggaggcugaggcaggcagaguucgaggucaggaguuugagaucagccaggccaacauggcaaaacccugucuacuaaaaauacaaaaauuagcuggacgugguggcacaugccuguaauccaagcuacucgggaggcugaggcuggagaaucgcuugaacccaggaggcggagguuucagggagcugauuuugugccacugcacuccaacgugggugacagagugagacucugucucaauaaauaaauaaauaaauaaauaaauaaauaaauaaauaggcugggcacgguggcucaugccugaaauccuggcacuuugggaggccgagguggguggaucaccugaggucaugaguucaagaccagccuggccaacauggugaaaccccgucucuacuaaaaauacaaaaauuagcugggcaugagauuacaugccuguaaucucagcuacuugggaggcugaggcaggagaauugcuugaaccugggaggcagagguugcagugagccaagauuaugccauugcacuacugccugggcaacagagcaagacucugucucaaaauaauaauaaaaaauaaauaaauaaauaaauauaaauaaacuacaucauucuucugcauuuaaaaaauuuaaaacaaauuuauuuaauuaucuaaaauuguugguugcaagaggcugccaauauguuagcaucugcuuacugcucugauuuuuacaucuucaaauuuggcugcuggagauucucuuaccuuguggagggcuuuacuauguaaauaaaacagcaguuugucauacuucaucuagcauuuuuaauauuuugcuguggguauuuuccaaaaggaaguccucuggcuugaauuucuaauaccuccuccagcgacagcaggcuguuguuauucgggugugugugucuaagcaaaggugaauauuuccauuugaggaauauagcauaagcuaaguggaaagucuggggaauacaaacuuuuguagggaacacaaguucuguagugcagaggcuugaaggagaugaagaugaaaugguaguugcaaccucauuguggacucuccugagggccagguugcugaguuuggacuugguagggagcaacauacauuuauuuuauugauuaacugauguuuuuuauuuuuagagacagugucucagucuguugcccagccuggaguuugguggcaugaucauggcucgcugcagucucaaacucuuggacucaaacaaucaccccaccucagccucccaaguaggcaagacugcaggugcaugccaccaugccugcuuauuuuauuuuauuuauuuuuugagacggagucucgcucuuucgcccaggcuggugcaucuuggcucacugcaagcuccgccucccggguucacgccauucuccugccucagccucccgaguagcuggaacuacaggugcccgccaccacgccuggcuaauuuuuuguauuuuuaguagaggcggggucucacaguguuagccaggauggucucgaucuccugaccucaugauccgcuggccuuggccucgcaaagugcugggauuacaggcgugagccaccgcgcccgaccuaugccugcuaauuuuaaaauuuucuuuguagagacagagucucacuauguugccuaggcugguucaaacucuuggacucaagcaauauuuuugcgucuaucuccaaaacugcugggauuacaggcacaagccacugugacugugucuagccaacauaaauuguuuaaagcaggaguuugauauggagggaguguuuucuuuuuuucauccacugauuuguacuuuaauuguucaaacacuuuuuuuuuuuuuuuuuuuuggauacagaaucuugcuuuuucacccaggcuggagucuagugguucacugcagccucgacuucuucagcuuaagcaauccuccugccuuggccucccuaguagcuaagaccacaggcauacaccaccaugccuagcuaauuuuuaaacuuuuuguaaagaugggccucaguauguuguccagacuggucuugaacaccugggcucaagcaauccucuuuccucagccucccaaagugcugagauuacaggcgugagccaccccacugccuuuaaauacuuaccaaccccuucuacaucccaggaacuugugacuguagguugauuaggcuguuggaaguuugcaggauggcuaggauguagugaggugguuacugcagugaccgagaggguggguggugagcgccuagccggaaggaguggcagaugaaagcugagacaugucaaggcaggaagugacagaguuuggcaguaggguugauggagaaggugauggaauaccaaaguuguggguuucauacgugggucucuggcuguacucugccacaaucauuuaauuaaggguugucuugugcauccagcaucucagaaauggucuccugagaaaaaaaugccuucauuuguccuuguacuuuccucucuggagcuugaguaccauggugguccuacagaagaaugcaaaggguggggaggcagacauucauucagcagguguuuacugagcacuuguuauaugccaggcuaugcucuggguguuagggagaucauggggaacaagaaguuggaagaguuugccaucacagagcauacauuucuggugaggaagagacagaggauaaucgcguaaacaaacagaucgggauuugagauggugaugcuauuugggaagaaaaagaagcaauaaucgcacaaagggacuagcuuggaggaugagggggcucucccagaagugacaguccuaagacagauaacucagggcuggaggacaugacaccaaaagggugucaggauuacaaagaccucaggaauuuggagaaugggagcuggguagaagaggaaaaaaauguagaacagagucauugcugguuuucaggauaagcgucuccuuccuaauccauuguccugaaaacaacguccuccuucaccucacuggcaggaauagagucagccucagacuuggaguuuucuaccaggagugcuugagaaagagguacuggcuaaagacugucugggcugggcagaaaaugaucguggcuuucuucuucaucacaaacccagaucccaaaaccaguauggggggaugggggauguccuauugaaagccagacuggaacuaaccccguccccucccucacaacacuuuuuccgcacguccauuaguacacuuaucaaccuuagcauuggaucagaguuauuuuugucuguuugucuucccccaugagauuguaaauuucuagauacuggaccugggcauuucccccucuuuguggagagauuuuuaaccuuuuguggaucacauacauccguaagaaucugaugaagaggccaggcacgguggcucaugccugcaauccagcacuuugggagacuaagguaggaggauggcuugagcccaggaguuugagaccagcaugggcaacauagcgagacccugucucuacauaaaauuuaaaaauuagcccaggccaagcaugguggcacacaccuguaaucucagcauuuugggaggcugagauggguggaucacuugaguccaggaguucaagaucagcuugggcaacaucgugaaacccugucuacaaaaaauauaagaauuagcuggaagugguggcacuacuauagucccagcuacucgggaggcucaagaucacuugagccugggaggcagagguugcagugagccaagauugaccacugcacuccagccugggugacagagggagaccuugucucaaaaaaaaaaaaaaaaaaaagccaagugugguggugcaugccuguggucccaacuacucaggaggcuaaggugggaggaucacuugagcccaggaguuugaggcugcaaugagcuaugaucucaccgcuguacuccagccugggugacagagugagauccuaucuaaaaagaaagaaaagaagagaagagagaaaagaaaaaaggaaucuggugaagaaacgguuacacuuuccccagaaguuugcucgucuccuguauauuuugcauacuauuuugggaggagguacacaguccccugaccccuauacauggaucccuaguuaagaacucugccugaagcuuuacccagugccugguauguucuuggagucugaugacuugggaauauucuccuuauuaaaucuccuugcucuaguugcaggggacagauguuaggugggagaaagagagccaggaagaacccugcugcugggagaugcagaagaguguuuaaaucauccaucuggaagcagccauccagagagcaguagcuucacccucacuuccugucccggcagaaccggagguggggucuccucccugggcuuggucuucccuugggcucugccgcgccuccucuucgcccugugccugcuguuuuccagucucaugacaucccucugcuugucuuucaaaacucugcuuauccuucucucucaucucuucccugaagccuuccucaauuauuuuagaaccagcugacuucguucuuucuggaacuuguguugcaccuaaguuuucugaaacuuacaauugaucacugacuuucuuucauuccuacuucaucuggguuggucuugcgugucccagcuagguugcuagagaagccaaagauggcuccagaguaucugguuaggacaguuugcuucacucuccccacagcauugauggaaugcuuggaagaggcaggcaguucccuuagaaucgggucggcgcaggcuucgcugugcccguguuuccuccguauggacauggccauccuugcugccuuaacuucuggcauugcuguugugcccuccaggccaucugcugcugucuuugguccuccauuucuuccuuccuuuaccauggcauaguggugagaagcuuugaagucagacuacgugacuuugauccccggcucuuguccuuagucagcugcgccucagugagcauauuauugagccucaauaugucccaguuucuucucuguaaaaugggacuauuaaugguaccugucucauuguguuuuuguugugacaauuaagugaaauaauacagauaaaguacuuagaacaguuucuaauacauaguguuugauaaauguuagcugauggcuggacacaguggcucacaucuguaaucgcagugcuuuuagagguuagaggcugagguaagagaaucccuugaggccggaaguuuaagaccagccugggcaacauagcaagacccccaucucuaccaaacaauaaaauaaaauaaagaaaaauuagcugggcaugguggugugcaccuguaaugcuaguuauuaauacuugggaggcugaggcagguggaucgcuugagcauaggaguuggaggcuguagugagcugugaucacgccacugcaccccagccugggugacagagcaaggcccugccucauaaauaaauaaaugcuuaucugagcgccuaguaugugcccagaauugaauguugauuugaagauacaugcaguagauguuaggcgccauuguuuauuauaacuuaaucagcuuuucaauacccucugucccuguuuugauugguuuuagcaugcugacuuucacauaucaaagaauccuaggacaggguggaccccaggggugcagacauggaagaaaaccaaaagcaaagcagaaguccagagauuuuaaauucugaaauggauuauaucugcauuucuucuucuaggcccauggcagacaucuccaauagaacaugaaauucuuuuaccgagcucagcugcagccucagaauuuucucaacauuucucaccaggcagucacuacaaauugacuugagcugccccuuaaaaagguuaucuauuuacccagccuccugauuuuaccagugaagaauugaaagccuggagagcuuuaaucaaccugcccauauagcaguuuauaggacuccuggugccuagacuauuguuuacaacacaccaugccacucacccucugccuucgcucauucccuuuuuguuugcugaggaugccuccuuuuaacaucugaguuucacgaggucagggaagauccuuucuuuuucuaacugcccuaacaaucugguaguauauugugccugcauauagaccaaccucaagucuauugaucuauuuuuuucuuaccagugaacuagcugaaguuauugccacucaguuggggguggaucaugcauguucccaacucagcugccuuuaggggugauccaugcacugacacccugcauugacauugauauuggagaguaaccugcaaagaaguuauuguugauguugaauugaauuuucacauugcacgagaaaggccaaggcucgacauucuucauccaacagguuccuuuguugcacacucccguccugagaaacggaacccauuccaguguacagcuucuuaaauaaaaggcaaauggagucaugauuuccucucucacuuucuugaaucgagaagggaugggaaauaaugaauagaugaaguugauuuuagaucagaagaauccuggaacacaugaaugaugaagcccuuugguagacagauucaugauguauuuaaaacauugcugucuuauccguuauucuucucucuguguagaaauauacaaguugaugagggcagauauuuucauaauccuaguucuguuuagcaaauggaaguccauuacuggcagugugaggguaaaaagugaaauggguaacagauuaaagaaaaguggcagagagguagcaacaaauagguucagaacauguuuggaagauuauagagggggcacaaugguucagaaugccugcaauccuggcacuuucagaggcugcugugggcauauugcuugcaccuaggaguuuuagagcagccugggcaacauggcaagaccccaucucuacaaaaaauuuaaaaguuagccaggcaugguggcccaacccuguagucccagcuacuugggaggcugaggugggaggaucgcaugagcccaggagaucaaggcugcagugagcuguguucgcacuacugcacuccagccuggguggcagagugacacucugucuuuaaaaaaaaaaaaaaaaaaaaaauuagaggagguaaaaaaaaaaaaaauauucaagccugauuuagcuuguugaaugagaauucaauuuugcuuugaugcaugaaaauugaaaaaauauuugcauaaagaaaauucuccaguaguaaagcuuuaauuagguugcuuaggaaauaccaccugucuguuuuagggaaguauuuauugauugaagcaagagcuaucaaauuggaagucaacauuuaccauuuugagaaaaagaaaugggcaaaaacuacccaagguacuuguuaauacaaaaaagaauagggaaguucaguuucugggauauagaaauugguugugauauuuucagugaugauucuucuagcagcuuuuucaacaggaaaaaaaauccuuaagaaaggguuuuucuaucuuuuucugauccuuuguaucucuaagaagguugggaaaguuccaggguggugaacacuuucuccagccggcaggguuuucacgaaccaaucuugggaaggaagggguggaagggcaggcaaacaacaguacccuguuuuuacauagaaccuuucuccugggaagucacagcugugguuaccuucaggaucagagguugcuacugcucuucucccugaaggaaguuugguccuuuuccacccaucugggaagguguccuuauggacaauggaaguggaaaaugacacccaccuagcgugaugaauccuggaguucgcugggaagacagagguuacagccuccuuuauagagaggggaaacuaaggcaagaggaagcuggcacagacaaaccuauuaaguccugaaggaaucaaggcuucugacucagcuccagguaggggauguagcagaguucagaagcucagcaggccacaggagacagccuagagucucucugcagugaccugacucuuggugaagguauuuuguuucauggcuguggcuuuuuuuuuauuauuauuuaaaugaagcagggucucaccauguugcccagguuggugucaaacuccugggcucaagccaucauccgaccucagccgccagaguagcuggguuacaagcacgugccaccguguucagugauggcuguggcuuugauggugucacugccccacucugcccagaucccuucccugaacuguuguucuuggacugccaaacuggguaggggcaguaggacuuugaaucuggucaucagcaguaaaaggggauauacuuaggggaccuuuggucaccuaacagccaagaagagaaacaaagugaagucagggaaauaugggggacaggaucuuacuucuaaggacucucgauaagggggaaguugagcaacugugucaggugcagauaaaaagucuggaagaaugauaccugggaagaaaccagcacguuuggccaaggaacagggagaguuacuggugaauuguguuaacugagacgugccgcagcaggaggacggcagaagccacguuguagaaucauagaguauuuaggcuggaggggaacaccguguccaacugaggccuuuaguggucgggugauuucucucucguuuuugcucauguaagugcaguggauccuggaguuuguuaccaggauggggaguucuauucagaacugaccaauuaaaaaaaaaccaaccaggauggggaguucuuuuuuuuuuuuuuuugagauggagucucgcucugucgcccaggcuggagugcaguggcgccaucucggcucacugcaagcuccaccucccggguucacgccauucuccugccucagccuccggaguagcugggacuacaggcgcucgccaccacccccuggauaauuuuuuuguauuuuuaguagagacaagguuucacugcguuagccaggauggucucgaucuccugaccucgugauccgcccgccucggccucccaaagugcugagauuacaggcgugagccaccgcgcccggccaggauggggaguucuauucagaacugaccaauuaaaaaggaaaaaacauaaguccuuuuucucuuaagcauaugguuaggguaagaauacucuugugggauucaggcugugugggguccagucuugguucugugggaacuggcucugugacuuugagcaggucagcucugcccccggacgucaguuuccuuuuccguaaacacggaaggcuugacggugugguuccugaggucccucugacccugacauuacggaaggcuugacggccugguuccugaggucccccugacugacauuauucccaaagaaaaugcauuggccuuagcacuggggauucugaguuggccguggcuggagaaagacuaugauaaggagcccuggggagaugccuggguuccuauuggugaccucgccuucucguucaagcaggacggggagugggacccaggcccagccuuaucuccgggaccgcggcuguccucaccccuccuccugucaccugagaauaaaagggugggcuccauaggcgggggcugugaggaggggugcaauugcaugggucauggacgaugguccuuagacaucucuggggagccuuuggcgggagaggcgcagggacuugggggcacuuccccaggcccuggugaccguggucaucuuugucacagccuccuccucugcccuugcaggccaaggacuggaccagucccucucagccuugccucuaucucucccugccugcucggcagccaacacagaaacacugcugugugcuuagcccaggggugggagggauuucugcccagggauuggccauggaauuggcugcuuauuuuggcagcucccaccacaaagaccaucagacgcugagggaaggcgaggugggaguuagugagucauggccaugccucagggagggagggagcuuucaccagaggugccccuggaggaagcagacuuccccuccaaagaagaggggugggacucuggaugcuuccucccagggucacuggcuuaggucaacuaaggggaugagcauccccguggcguucuguguaaugggaauaauggcccugaccucacagugccguggcagcaaguugaaaagcuagcacaucaagcucucagugaaggguugcuuuccuuuccuuggugugccuuaggauaugacgggguaggcaccaugggugcagacauggaggaaaaccagaagcaaaucaggaguccagcugcccacauccagucacucuugauucucgugguuucuccagugcccagcugaggcuggccauggugggaaagugggacuuugcucugugcugccuucuccuaacccuguguuguccugaggccaggcagacaggccccagucauuaccucaccgcagggccccugucugccagagugcaugguggagcugccuggguggagagcggagcuaauuuuagaccuggagacucuuugccaacagcuguggcugggcccaggcagcugggcuggauggcuggggggagucucagccgcccugcagggagcccuggacacagcgcuccaggucugcucuugggggcauauuccugccucagccucagcuguggggaagccuggaugagggucccucugcacagagggugcuuccuuccucccucuugcaucaagauauuucuguccuccaucuccucuuucuagguggcuuuguagaccagaaaacauugauacggcaucuuagaugguaggucagugggccucugaaauggggcagguaggggcaacaggaagaaaaggguguccccaaaucguucuggguuuauaggcuaaauccagccucccacucaaccccgagccaauaaucuaauugagugcuucucaaccuccuuccuguuaguacacagagaaaaugacaggaaaagauacuuguaacacacauagggguauaaagagguuugugguuggauguugccagcccucagauucugcugcuccaagcacugagggcugauacuuugggacacguuaccauuuggagccuacuagcagccacagcacaccaguggggaagcucugauaucguccgucaguggcuugccacaguccauguaugccaaguccaagcuucaggaaacaucuccuuggcuaaucauagaccugugcuggaagggaacccagagagcauugaaucugugcucuccuuuuacagaugaggaaacugaggcugaaagaggcuuguccaagguuaaaaagcuaguaagucaaaaucccaguuuuaaguucuguuaggacagucaucccuucauuuauccaacauuuauugaguuccaauaaagaucaauauuuggaggauacaaugaugaaaaaaguuguggggauucgucuguauuugguaaagagaaaaccaaggaaaccauucaggaaggucguuauuuccggugagagagauggggaugugauuggagagaggcacagagggcuucaaaacgugucuguuucuuaagcauaugcagccaggcaccguggcacacaccuauaguuccggcuacucaggaggcuaaggugagagguucacuugagcccagggguuugaggcugaagugauguaugauagagccugugaauugcaaccacauuccagccugggcaacauagugagaccccauuucagaaggaaagaaaguguacacagguguuauucuucuuuucucucuuuuuuucuggagacaggaucucacucugucacccaggcuggagugcaguggcaugaucauggcucacugcagccuuaacccccuggguucaagugauucuuccacuucagccuccugaguagcuggcacuacagguggaugucaccucauccagcuaauuuuuuuuuucccuuuggagagacagggucuuaccguguugcccaggcuggucuugaacuccuggguucaagcacuccuaccaccucagucucccaaagugcugggauuauggacauaagccaggaugcacgguuguagguguuauucuuuaaaccauccuauauauuccuuuagaugcauauuucuuuuaaauagcaauugauaaauauagaaagaaaagugagacagcuagagaaaaguggccuguggaguuagguaaggagaaagacaaguagcuuugcuguuacaaggcagggugguaagaaccauggcaaagcuauuauaguaacagcccagcuuggcuggacacaguggcucauaccuguaaucccauaacuuugggaggccaaggcagaugaaucauuugagcucaggaguuugacaccagccugagcaacauggugaaacccccucucuaccaaaaauacaaaaaauucacuggguguaguggugugugccuguggucccagcuacucaggaggcugagguaggaggaucguuugagcccgggaggcagagguugcagagagcugaggucaugccacugcacuccagccugggcaacauagugagacccugucccccacaauaaauaguagcccaguuaugugcacguggcacaugugaucucauuuaauccucacaacggacacuuucuauuguuuccauuuuacaggugagaaaauugaaguucagagguacuuaccuuguucagaguuucauggugaaucuucuuugcagucagauucaagugcucacaucuuagccaugacacugcaaugguggaggggcgaguugacuugcacagugagcuggccuuggggugggauaggggagaaaaaggcaggaaaguuacuaaaucucucuaauuuguuucccaguucauaaaguggaacuaacuuuacuugcugcuccuucuuguccaaauaauuugaauaugaaagcacuauaucagcauaaaagcugacauuuaugaggaacuaaucccguaccagcgacuuuucaggugacaccuucucuaaucguuccuugaccccaucaggagcacacgaucccuguuucacaggcagacugccucccugcucuuagcauccuccaguuacacaucucuuuccgcccugccuuccccgaggugcuggcuuucacuugucagugacggucauucugaggcugagauguaagagauacgaaguaccuguccuuaccccaccccuaaugcaagcaaugccauccuguuggcacgugccacgguuaucucuggggccaucacccuuugcugagaaggcugaggcuuugaaauccuugagcuuucacagugguucucggccuggcugcacacuggaguaccugaggagcuuuaaggacucuagcuuuaagaauuauucguguaagaccucaccccaagucaaucaguuagauuugagaggaggaguagcccagcaucauucuccaggugacucugaagggcagucaagguagagagccucagguguacacuuucucuccagaugagcugagcugagaaauaaagggucaugaagagaugagagaacacagcuaagcaaugaccuggaugccgccuggccccaggcuggcccaaggauuaggcaggacaagucaggaaaugggaaaagaaacagagaaggaaggagacaaugaagucuacaggaaagaggagaaaaauuaaaaaaaaaaaaaaaccacucguuuugguuuggaggaugcuaaauuccucccaguaauggucccagaccuuuccagugguauguauggugugaauuccgguguguucugaacucagguccauccugugguguaugugggcuucaggagauacaaggaagugugaacgcuguccaacugguauuccaagagcuaugguguucucgcauagacaaaauauacacgucacacauaacacaucccuuuggcauguucuccccagcacccagaagcacccucaugagaagugaauucuggcauagaggaggaagacgugguguuggaggugggauuugaacugggguguaugaugcagaggacuuagaugaugagggaggaugaagacagaggaaacaagcacggaugugccagggacaggacaagccuggccugaugugagaggaggcugcuacauccccagcaagcgugggcacugagaagaaagauguacuuacaguccaagggcagcaaaguugagagaaaaggagggagaaaccagcuaugggaaauggaucaggcucaguagauaugugaaugguagauuaaucacuugaccacacaaauacauuuucuaucucuacuuggagucugauucuaugacauuaggaaccagcaaacugggacccccaugguggggugguguuuacagauguuccacuaggagcaagagaugugaagaaaccaagacccagaaauaugugaaugaccucagggucgauagacccaaggcuucggcuggcgacugagaaugacaacaaugauucucaaccucagcuacgaaugggauugccuaggaagcuuaaaaaauaacugaggcgauacaagcauaugauuuaucgacacucacggaacuguucguguaaaauggauacauuuuauuauauauaaauuauacuuuaaaaaguugauuuuuaaaccuagucaacuucuggucuaccauguaaggagcucagaaucucugcccuucuguccuaaccacaaguaaagagcugaacagacugggaaaucgacaauucuuagauuccucagagaagggaggugagaaggaaaacugcuguccccaaaacuggggagacagguaggcagaugcagagaaucacaacuuaccaaagcagaaauccaugagcagaaaccucugcagaaaccagugucuaggcaggaaaaccuaaacuguaauugaugaauuacuggaggcucagugugaacaagucugagaauuaaaaauuccaggggacucagucccaagcuugugugaguuuuaccucuaggagccuaccaaguccucccuguacauuuuggagaaaaauccccuucuacuuccagcagggggagggaaaaagaaagcauucugaaauacaccaaaauauucuuuuuuuuuuuuuuuuuuuuuugagacggagucucacuuugccacccaggcuagagugcaguggcgugaucuuggcucacugcaaccuccaccccucaaguuuaagugauucucccaccucagccuccugaguacuugggauuacaggugccugccacugcacccggcuaauuuuugucuuuuuaguagagaugggguuucaccaucuuggccaggcuggucuugaacuccugaccucaugauccacccgccucggccucccaagugcugggauuacaggugugagccaccaagcccggccuauucuguuuuucuuaacaaggccugcccucaggggaaacuauuuuacgagccugacuugcuguccuaaccuaccuaggggaggggaaauacccaacaccagccccuucuggucauccugucccaucuagaguggggagaagucugauguagaucacaguccagaggcagaagcucauugaaagacugagauaaaacuauagaaugcaucugcuccuggacaccuaaccacgauaucacuaaaggcccuuuucauaauuuguuuuacucagcacaucacuuucaacaaaaaguuacgaggcauacuaaaagggaaaaaacacauuuugaagagacuggacaauuagaaccagaguagguauggaagaaguguuagagaggccagacauuuuuuuaaacuaugaugauuaauauauuaaaauuuuuaaugaaaaaaguagacaacaugcaagaacagauggcuaauguaagcagaaagaugggaauucuaagaaugaaucaaaagaaacccuagagaucaaaaccccucuaacagaaaugaagaaugucuucaauggacucauuaguagaugggacacagcuacgaaaaggaucucugagcuuuaggauaugacgacauaaacuuucaaaacugaaaagcacagagaaaaaagacaaaaacauaacagaauauccaagaacugugggacaauuacaaaaggugaaauauacauaauggaauaucagaaggaaaagagagaaacagaagcaauauuugaaacgauagcaacugacaguuuuccccaaauuaaugauaaacaccaaaccacagauccaagaagcucagaaaucaucaagcaggauaaacaccaaaauaaaacaauaaacacaauaccuagccagaccauauucaaacuaaggaaagucaaagauuuaaaaaaagucuugccgugugugguagcuuacaccuguaaucuuagcacuuugggaggcugaggcgggcagaucacuugaggccaggaguucgagaccagccuggccaacauggugaaaccugguuucuacuaaaaauacaaaaacuagcccgguguaguggcgcaugccuguagucccagcuacuugggaggcugaggcaggagaaucacuugaaccuaggaggcagagguugcagugagccgagaucgugccacugcacuccagccugggcaacagagcgagacucuaucuugaaaaaaaaaaaaagaaagaaaagaagaagaagaccaagaagaacagccugggaaacauaguaaaaccuugucucuaccaaaaaaaaauuuuaaaauuagccaggcauggugacaugcgcccagcuacuuugggaggcugaggugggaggaucacuagagcccaggaggcugaggcugcagugagcugugguuacaccauugcacuccagcuugggcaacagagcaaggcccugucuccaaaacaaacaaaaaacccaaaacuuguaaguagccagauagggggaaaacaccuaucaagaagcaaagauaagaauuaacaucugacuucucagaaaccggguaugggccaguauggugacucacguauguaauccuagcacuuugagaugcaaacaagaagugagucaagugaaauauuuaaacagcugagaagaagaaaaaaaaaaaaaaccccaucaaccuagaauucugaacccugugaaaugauucuucaaaagugaagcagaaauacuuucucagacaaacaaaaauugagggaauuuguugccaguagaccugccuugcaagaaauguuaaaaguaguucuuuaaagagaaagaaaaugauacgucagaaacuuggaucuacauaaagaaaagaagaauguuguagaaugaauaacugaagguaaaauaaaaauuguaauucuucauugaucuaacagauagguuuauucaaaauuauaacaauguauucaauuauguaugcucauauauacugauguaugcuuauauauaagugaaaugaauugcagcauuaaugcaagagaugaauaggcagaauuaggaauauuuuguuauuguaaaguacuugcacuaccuguggagugguauaguguugugugaaaguggaugucccagccugggcaacauagcaagaccccaucucuacaaaaaaauuuaaaaauuaaauuuuuaaaauuuuuuuaacaauggcacaugcauguagcuccagcuacuugggaggcagaggugggaggacugcuugagcccaggagcccaagguugcagugagcuaugauugcaccucuucacuccugccuagggaacagagugaaacccugugaaaaagaaaagaaagaaaagaaaaaagaaagcagaugugguuuacuuguauguuguaaacucuagggcuccacuggaaaaaaaaaaaaguauaacugauaugcuaacaaaggagagaaauaauggaaucauuaaaaugcucgcuuaaaaccacggaagacugcagcuauaaaaaagaauggguucauguccuuugcagggacauggaugaagcuggaaaccgucauuuucagcaaacuaacacaggaacagaaaaccaaauaccacguucucacucauaagugggaguugaacaaugagaacacauggacacagggaggggaacaucauacacuggggccugucagggguuggggugggggggcaaggggagggagagcauuaggacaaauaccuaauguaugcagggcuuaaaaucuagaugauggguugauaagggaagcaaaccaccauggcacauguauaccuguggaacaaaucugcauguucugcacauguaucccagaacuuaaaaaaaaaaaaaaacccacaaaauacagaaaaagaaaggaagacaaaaauagaaagagagcguaagggcaauacauagacaauaguaauaaauaugauagauauuauuaacccagguauuuuaauaaucauuuuaacugugaauggucgaaauaaaccaauuaaaagauggagauugucagagugcaucuaaaaacaaaacccaacuguauauuuuccacaagauaaccacuuuaaauagaaagacucauauagauuaaacguaaaggaauggaggaaaauauaccaugcuaacacuaauaaaaagaaagcggaagaauagaugaauccacuguuagaguugaagacuucaacaucucucuagaaauugacagaugcagcagccggaaaauugguaaagacauaauugaacuuaacagcaccauccgucaacuggauauaauugacaucuaugaacugcuucauccagcaauagcagauuacuaauucuucucaagcucacauggaacauuuaccaagauugaccauauucggggugguaaaacacaccuuaacaaauacaaaagaauagaguuauacaaugucugaucucagaccacgauggaauuaaacuaaaaaucaauaacagaaagauaacuggaaaguccucaaauauauggauauuuaaaaaugugcuuucgaauaacacuuaugucaaagaagaaaucucaagagaaauguaaaaaucuugaacuaaaugaaaauauaaccuaaaauuugugggaugcagugauagcagugcuuagagggaaauuuauaacacugaaugcuuauauuagaagagaagaaagaucuaacaucaaugaccuaagcuucuaccuuagaaaacuaggaaaaaagagcaaauuaaauuucaaaaacagaagaaauaaugaaaauuggaacagaaaucaaugaaauugaaaauaggaaaucaguacagaaaguuaauaagaccaaaagcuguuucuuuaaaaagaucaguaagauugauaagccucuaagccaugcuaacuaagaaaaaaaaacaaauuacuaaugucacaagugaaagaggagacaucacuacagaucucauggacauuaaaaguauaauaaaagaauauuaugggcuggguauggugacucacauauguaauccuagcacuuugggaggcagaagugggcagaucacuuuaagcucaguaguucaagaccagccugggcaaaaccccaucucugcaaaaaauacaaaaauuaucugggcauaguggcuugugccuauagucccagcuacucaggaggcugaggcuggaggaucauuugagcugggaaguggugguugcagugagcugagaucaugcccugcacuccagccugggugacagagcgagacacugucucaaaaaaaaaaaaaaauuacggacaacucuacaccccaaaauuugacaaccuagaugaaauggaccaauucuuugaaagacacaaucugccaaaacucacacaagaagaaauaaaccaucugaauagucauaucuacuaaggaauuugaagaaguaauuaauaaccuuucaaaacagaaagccccaggcccagaugggucugcagaugauuucuacuaaacauguaaggaggaaauuaugccauuucucuacaaucucuucuagaagauagaagcagagggaauacuaccuaacuaauucuaugaggccagcauuaccuuaauaccagacccagacaaagaccuuacaagaaagaaaauuacagauuaauaucucuuaugaacauagaugcaaaaauccucaacaaaauauuagcaaauugaauccaacauguguaaaaagauuauacaucauggccauuuuuucuagguaugcaagggugguucaacacuuaaaaaucaauuaauguaauuaaucacauaggcaaaaaaagaaaaauuacaugaucauaucaauagauacagaaaagauauuugacaaaaccugacaccuauucaugauacaaauucuuuuuuuuuuuuuuuaagacagucuugcuuuguugcccaggcuggagugcaguggugcaaucuuggcucacugcagccucaaccuucugggcucaaacaauccuugcucuuuagccuucugaguagcugagauuacaggcgugcaccaucaugcccagcuaauuuuuguauuuuuguagagacgggguuuugccauguugcccaggcuagucuugaacuccugagcucaagcaaucugccugccucggccucccaaagugcugggauuauaggcaugaaccaccacacccagccugauuugugauacaaauucuuaauaaacuaggaauagaggggaacuuccucaacuugauaagcaguaucuacaaccuacaacuaacauuauacuuaauaguaagaaacucaaagcuuucccauugaaaucaggaacaaggcaauaggccgggugcgguggcuuacgccuguaaucccagcacuuugggaggccgaggugggcagaucacgaggucaggaguucaagaccagucuggccaacauagugaaaccucgucucuacuaaaaauacaaaaaaaaauuagccaggugugguggugggugccuguaguuccagcuacucgggaggcugaggcaggaaaauugugugaacccaggaggcggagguugcagugagcggagaucauggcacugcacuccaguuugggcaccagaacgagaccgucucaaaaaaaaaaaagaacaaggcaagaaagccaccucucacugcuccuuuucaacauuauacuggaaguccuaucuaaugcaauaagacaagaaaaggaaaaaaagguauacagguugagaaggaagaaauaaaacuguucacagaugucaugauauucuauauaaaaaaucugaaagaacugacaagaaaacuggaacuaauaagcaaguauagaaggguugcaggauacagggauacagaugucaauugcuuucugauauaccagcaaugaacaaguggaauuugaaauuaaaaacucauuaauauucacauuagcauccccccaaaauggaauauuuagguauaagucuaacaaaauauuugcaagaucuagaugaggaaaacuacaaaacucucaugaaagaaaucaaagaacuaauuaaguaaagagauauucuauguucaugaacaggaagaaucgauauugucaaaacauuuguucuucccaacuugaucuacagacucaaugcaaucccaaucaaaaccccagcaaguuauuuugugaauauuggcaaacugauucuaaaauuuauauggagaggcaaaagacccagaaagucaagucaguguuggaggcaaagaacaaagucagaagacugacacuaccugaauucaagagaguacggagcuacaguaaugaagacacuguuauauuggcaaaagaauggauaaguagaucaauggaauggaauugagaguccagaaauagacccauauaaauuauauucaacuggucuuugauagaaaagcaaagacaugcaaugugguaaagauagucuugucaacaaguggugcacauaugcaaaaaaaaaaaaaaccuagacauaguucuuacacccuuuacaaaaaucaacucaaagaccuauauguaaaauuugaaacuguaaaacuucuagacaaccacauaggagaaaaccuaggugaucuuggguaugccagugacuuuagauuuuuagacaacaccaaagucagaauccaugagaaacaauugauaagcuagacuuccuuaaauguaaaaucuguucugcaaaagacaaugucaaaaagaacaagaagacagucuacacaaugggagaaaacauuugcaaaagacauauuugauaaaggauuguaauccaaaacauacaaagacaauaagaaaacaaccccauuaaugggcaaagcaccugaacagacaguaccaaagaagauauaaacauagcaaguaaacacauggaaagcuguuuaagaucauaugucauuagggaaaugaaaauuaaaacaacaauaagauaucacuacacaccuauuagaauggccaaaauccaaaauauugacaaccucaaaugcugacaaggacauggagcaacaggaacucucauucauugcuggugggaaugcaaaaugguacagccacuuuggaauucaguuuggcaguuucuuucaaaacucaacauacucuuacuuauuccuuauuguaaggaacuaagaccuucuguacaguguugaaauauaaugguuuuuuuuuuuuuuuugguuuuucacgagaaggauauaauucaccauuuuaucuagcaagauuuugaaaacaaugagagcaucucaucucagccacuuuccuuagcaguuccugcuuuuauucauuugcuuuuuauguugccucagacacaguuuuuauuucauuaaaacaugaauugugcagauuuggaggcaguuuaaaaaaaaugaaaaguaacaauagauagagguagggggugaguuuuauuaauauccuggaaauugaucacccaaucagcaguagaguccguguuggaaaggcaguccacacuucuccauaguucacucagcgugagguucccucaaugaaguucucauuuuuaaugacauaggucaucauuagaaaaaggccugguuggccaggcacaguggcucaugcuuguaaucccagcacuuugggaggucgaggcaggaggaucccuugagcccaggaguuugagaccagccugggcaacauggugaaaccccaucucuacaaaaaauacaaaaauuagcugggugugguggugugcgccuguugucccagcuacucgggaggcugagguggggaggugggaggauugcuugagcccggaaggucaaggcugccgugagccaugaucgugcuacuguacuccagccugggcagcagacagagugagaccuuguauaauaccuugaaagaaaaaaaaaaaaaagcaagaaacaaaggaaaaggucucauuguccguucuuaaauguaaagacucuuagcuucaucagucagcguucacauugcaucuggggucccaaacagccaaccccuuacauuaaacuaaauucugcuuaaccagcucucacacugaacuuagaagccaagaguucaggaguaugagcgcuggagucucccucccucuuccuccauuuucuaccaucccauaguagucaugcaggauugggugggaccauagcuuaagguguugaggccagcacccagguauaacuuguauggcuucggagaauuuccugagcauaugguuuuccccaucucagagacccguguaguacuggacgcugggacauuggaacaggaguguaggagaagacccacagauuguccccuugucaccagcccuaucaaucaaugcacaccaaaaacuggagcaccaggcuccugaggcagugauggggggaguaaacuggaaaggcugacuggggccuaaugugugcgggggggagucuuuauucuuauguauucuuugauaacagaaucauuaaugagagcauuguccggauuuagucucagguuucacucguuagguugaaaaugugaaaagccucuaccccuuuagcuacaagugaggaaaccuggguauaaaaaggaggccuggaguucuuguucuggcucugcauagcguaagcacagugccggcauuuuacuauuaaauaauaagaauguguggaccacuuucuguguuccuggcacaauggaugcacuuuguauguggcagcucauuucaaucucagagcuuccuucucuuuuacagauuaaauaaacagaagcucagaaagguuaaauaacuugucucaaguuacacagucacacuguaacagccaggauuugaaaccaggucuaucugacuucagaacccaugcuccuagucaccucaggucugcccccuaaaaggguuugcuuuagggguucaguuuccuggggagggguuuccaguugcucucuuugagguuucucauuuccuccugaauucuugggucguucuuuuuccccuuagucccccuaacuuucuuuguaaaccuuaguucagcugaucaauguacccuccgccaaacguaccguaagaaacaaaagggucaucuagaccucaggcaugcaauaggugagguaaaauuaccucuaagguugccuccuauuuucagcacuuggaaguaccugcuguguuucuaggccuaugcuuggggcuguuguguacagcuaugcagguuguucacugcagagaugcucccuucuuagggggugaaugcggaccagacucuagcaugagcuucacuugccaaacugcgugccugaggggaaggcacaaagacacuggauggguuaaugguagcccugacucugcugggcucagggguaagucuggcccuuggguagcuuucuuaucuuuauuuagaaaaguauccccaugaaauaauggaagccgggucugcagcucugcuguguugcagguagugugaggagugcagcaggugcucagcuaccaagaauuacaagaagaucaauguucaugaaugauauacauuugaaaaguuuacauguauuaaacuuuauugacaguauauauuuguguuuauaugugcacaucuauaaauauaaaagcagauucacaucauucuccucccuuguauuccaauacacuuucuugagggguacauaaaagguuggaauuuguuagcuccuucagaguugcagagaacccuaaauaugcccauauaugugucaugccauguccccuguccaggaucauggcagaaaaagauccagagcuguggaauucgcgaacaaaugguagcaauguagucccuuguccaucucuagcucucacuuuucuuuucugguauccagcagccuuggucccugggcucccuggaugucuucauuuacucuuaaaaaaaaaauugagcuggauuucauguaacauuaacuuuuaaaggguacaauucagcgguggcacaugcauguagucccagcacuuugggaggccgaggugggcagaucacuugaggucaggaguucaagaccagccuggccaacauggugaaaccccguaucuacuaaaaauacaaaaauuguccaggcgugguggcacacaccugugaucccagcuaccuggcaggcugaggcaggagaauugcuugaaccugggaggcggagguugcagugagccaauauugcacucugcacuccagccugggugacagaacaagacuccaucucaaaaaaaauaaaaaaauaaaguguacaauucagcggcauuuaguacauauacaauguuguaccaccgucaccucugucuaguucccaaauauuuccgucaccccuaaaggagacucugcccaugcgcguuaagcagucacuccuuccccuuccucagacccuggcaaccucuauucugccuucugcgucuguggauuuacccagucuuguguguggcuucuuucacuuagcaugacguuuucaaaauucauccauguguagcauguuaguacuucauucguuuauucuauuuauuuagagacagggucuugcucugccgcccaggcuggagugcaguacagaucacggcucacugcagccuccaauuccugggcucaagggauccucccacucagcuuccuucacuuucaauuuuuuguagagacggguucuugcuguguuucucaggcuggucucaaacgccuggccucaagcgauccuuccaccucagccgcugagaguacugggauuacaggcgugggccaucgcuccuggcuuucauuuauuauuauuauuuuuuuaauuauuuuuuugagacggaguuucgcucuuguugcccaggcuggagugcaaugccgcgaucucggcucacugcaaccuccgccucccggguucaagcgauucuccugccucagccuccugaguagcugggauuacaggcacgugccaccaugccugguuaauuuuguauuuuuaguagagacgggguuucuccauguuggucaggcuguucucacucaggugaaccgcccgccucggccucccaaagugcugggauuacaggcgugagccacugcaccuggccccuucauuuauuuuuaaggcugaaucauauuccauuguauggauaugccacguuuuguucacccauucaucugucaauggacauuuggguugcuuucaccuuuggcaauugugaauaaugcugcuauaaacacugguguacaaauauuuguuugaauaucuguuuucauuucuuuuggguauagacccaggagcggaauuccugggucccgugguaacucuguuuaacuuucuggagaaccggcuuuguucauuguuguugagcaccgagccagguggucacuuuuccucaugcuugaccucccgcucuuugugucuaagucaggagguagucauuuuguuugucuuguuuucagcaccagcauucccaggcccugcaucccugggcuguuuuuguugcucuccuguucaguagcacagccacucuagaaaguguuuugauucuuuacccuaaccacuuccuagccuguuuacagccacuggauuccuaaagucuccuccuggguaugacacacacucgauuucucagucucuucugaugccuccccacccacagcuuccaaacccaccccugauuucccauucagugacuaaacaauaaacaaaccuuccucuacuucuccaguuuuauacacacacgccccuucacugcccugucgguugcgaaguucuucaugcugucuccugggcuuacuaguaccuuggcagugccccacaguugccccugaagagagauuguuuuucugucuuuccauucgaugcuguuucugauugcguaucaugaagccagccuugucacuggcucuuccugccgcugagaggugauuuugaaugagaugcuaucccuccccagcuaccucuccaccauguccgcccaaguccaguugucacccagagcccagacacuucagaagcagcucacugagaggccacugugugcuggcuuuggaugcuccaaacccucuaccaugcacuagaaugaugcccucuggaccacgguuaauuuaaauaacuccaucuguggccccaucucuaguugacuuccuguuuuuguuuuguucugauuccuguguguuguccacacccacauugcuaguuuuuuacuagcuuuaggagacaaggaucccuguguguauaagauaauggucuuggggcaggaggaacaggcaucauagaaggaagaaaaguuccagauuggaaugacaagcugagaaaaagcaguauguggggcgacgcuagcugguggaagaccuggaagacgaagguggaggaauuuaccuuugauaaagcagcguuuauaacuuugucuuuuuggauguucccgcgucugucuuuaagagguuccuucaagcacgcuggacagccaggggcuuucaccgugggucagagagcaccauucucgugcaugguacagggcugggagcguccaaagccagcagacuguggccucacaguuuccauugcccuacccuggaaagaaucuucaugauggugucagcuggacaguagaauugggaaauccaaugaugaauggcaaguugguggaucuggggacaggauaauggagcuuuggcauacagagaggacacaaaaucuggugggguauucuagagcagggcccagagcccuucauaauguauaauuugagaugagaguuuugggggaggauagaggggcauuuagggauuggugcugucccuucaggaaguuugagcuggugagcagguggaaucauggaaauugccuaccuggcuguggucacucuuaccuuuguguauuuaauuuagggcagucaaaaacuuaagauccaugcagguagcuucagucaaagaagcagauauaagugugaacacauacucugugugagguaugaggacuguggugcaaggggagagcccgugcucucacuaucuagaacaguccuagcccguggagcccgugcucucacuaucuagaacaguccuagcccguggagcccgugcucucacuaucuagaacaguccuagcccguggagcccgugcucucacuaucuagaacacuccuagcccguggagcccgugcucucacuaucuacuagcccguggagcccgugcucucacuaucuagaacacuccuagcccguggagcccgugcucucacuaucuagaacacuccuagcccguggagcccgugcucucacuaucuagaacacuccuagcccguggagcccgugcucucacuaucuacuagcccguggagcccgugcucucacuaucuagaacaguccuagcccgugguaggcacucaaacaaaacaauauuuguuaagugaaugaauaaaggaguggucacuuuauuggcuccagcgcuuacuuuccauuugguuauaggcccuguuuugcccauuugcccuacuuuucaagagaaacaagaaauugaggguuuuaugugaaauuucccaaguuuuaaauguuggcucaaauuuuucuaaaauacagugagcuaaagucaggaggcagcuguuuuauuuuucuuguuuucagcaccagcauuucccagcccugccucccugggcugcucuugccgaggcuugcuggccauucucuuguugcucucuuguucgauagcacagcauccucuaacguuaggauuuugcaacuucuaacuuaaggcuuucaccuccagcagaugcacaaacuuuuaggagaagcagcuuuuuuuuuuacguuuaauuuuuuuaagaguuggggucuugcucugucacccaggcuggaguacaguggagcaaucauaccgcacugcagccccaaacuccugggcucaagcgauccucccgccuuggccucccaaaguguugagauuacaggcaugagccacgcccagccagaagcaacucuuuaaaaucuuaucuuucacuuaucaaccuggauaaagguucugaaagcaaguuucaacaggagguucaugggaggaucacaucuaagguucugaugccuuaaauugugguuguggcuugguuucucuaauggcuuucugcugagccuaguccugcauguaacagggcuccaguggcagguggugggagccaggauaacugagcugggcagaaugaugcagugggcagaaccuuggcuuucuaguauggacauucggcugguacacaccuuccggucauuccacuuaugcugaaauacugaaauauuucuguauugggagguaaauagcuacugcccugaaucccgugggugccccaacccgggacccaccaggccuucauacuauccagcaaugaauggggucaugccuggcuacagugugucucuaggaccgugcuucaaggccagggcuggcauccauucucagugcucaaugcccguauuauggugcuguaagcauuuugaacucaccccuggauaaaucugaauuugaauccuggcuccacugcuuuuuuuuuuuuuuuuuuuugacacagggucucacuuugucacccaggcuggagugcaguggcaagaucuuggcucacuacaacccccaccucccagguucaagcgauucuccugccucagccucagccuccugcguagcugggauuacaggcucacccagccacucccggcuaauuuuuguacuuuuugguagagacaggguuucaccauauaggccaggcuggucucgaacucccaaccucaggugauccaccccccucagccucccaaagugcugggauuauaggcgugagccauugcgcuggccccacuuuuuacuuggcuaaguauuuacugacaaauuacuuaaucaaugucucucagcuuauuuccuucuuccauaaaagagggucuuuccuccauaaaaaggaauacuacuacuaaaacuaaucuauuugcaggguuguugugaaauguaaguguguaacugagauaaggcuacuguuauuauucuacacucuaaacaggaaaacagcauccuuuguaccuuaucuuuauacaaaggcuuggagaaauagggaucagauuagccaggugugguggcgcacaccuguugucccagcuacucgggaggcugaggagggaagaucacuugagcccaggaguucgaggcugcagugaacuauguuugcaccacugcacuccagccugggcaauagagugagacucugucucaaaauaagaaaaaggaaaaagaaauaggggucagagaacuagaggcugaggauugcacagugacaugacccacugggucccaaaagucgguggugcccaguuggccacucaacuagggagauuguuaaauacagaugccccuacauuuagaaugagaaauucuaauucaggaggucuggguagaguccaggaaucauuguuuuuaccaagugcccugugaugauccugauuaagagcugaaucugggaaccaugcuguucucuugucggucaucucugccuguguuucuucacacagaaccggugcaggcgguacuguacuuacggcaggugcucaguccaccagggugacuugauggauucacgugaauccaugagugggccugggccagcugaggcagggccuuccccucgcccuuuauugcugccucugucacagacuucauuccgucuccuaggugggaucuaggccucuccuaaggcugagagcacaggacaggggagaacaagccugagccucuugcugggcuucaggauaaaccagacacacagaaugaggauugaguugccuucccaggagguggagaucugagcuaggcagauuaacuuguuuaugaggguguucuccauugcauuccccccgggcauggacccaguuggcugaccuuguguggaccaccuguugacagggcuuccugugucccagcguccugcagcccucggcaucaggugcucugacuuggagcaacugucguaguuaagcgccucuucugccuggcagcugcgcucauugccuccuaauuauacgcucuggggccucccuugaagguaaaauauuauaucacagcuuuaggggucugcuuccaguguugcauugguuccaaaugaugaggacaggcaagagguguagggacacagggcugagagacauguuaagagacggauacaaagggauuggaaagagaaaggagaaacaggcgggugaaagaugaaauguuaagagaaagacugaggaagagggaggccaagaaagacaugaagcaagggaaguuaaaaucuggaaggcagugagugguguucuuagcacagauuugcagaggguagcgacccuugcuauuauuucaggaggagugacacgugagcacuuuuuccuuuuuguuuaaacaaguucuuuuauuuuauuuugucuuuuugagagggugucuugcucugccacccaagcuggagugcaguagugugaucauagcucacugcagccuuaauuccugggcucaagcaauccuaccaccucagccuccagaguagcugggacuacaggcgugagccacuacccuggcuaauuuuuuuauuuuuauuuuuuguagagauagguucuuguuguguuguccaggcuggucucgaacuccaaggcuuaagcuauucuccugucuuggcuucccgaagugcugggauuacaggugugagccacugugcccuccuaaacaaguucuugaguaggaacuagcagcuagacaagaugcagugacucaacagaggcaauaauaggaaguuuuggguuugcagcugcuggcugauguuuucuacccuguuucccagcaaggaaauccuggggauugugagcgugugcgcagugacucacaugaccacagccucccugguuuacagucccagcccugcauaccuguucucucaccgacacaccuauccgcucagugaccacaccucacaaucucaacucugccccagccaccaagccauggcugccacucacacagccucuuuuucacucuguugacagccaccucccuccucaaagcccauguuuccugggagcugugacuucucugccaucagcugucaaauccuccgcaggcucuugcauaaagcauuuuuccugucugcaucucagauuucugaccuguaaaaugaaccucaggcucacugcucacgccucuuugcuguguggagcagugaauuaaugucuuuaaggaacuuguugcuuguuggaugaaagaugccaaagucagcuuugcuccuccacccccaccugcacuccuaacagccaagcccuccuuucuuacuguuuaccauacagauaagcucgugaugacuagagcaagucauuuaaggucugugaaccuggguggaccucaguuccccaauccacugaucucugaacagcugccucccauucaccuggcagcauuugacacuguugaccaccuacugccuucuucuuaaaaguguaaaaguggccgggcaugguggcucacgccuguaaccccagcauuuuggguggcugagguggguggauugccugaggucaggauuucgagaccagccugaccaacauggugaaaccccgucucuaccaaaaauacaagaauuagcugggugugguggcacgcgccuguagucccagcuacuugggaagcugaggcaggagaaucacuugaaccucggagacagagguuacagugagccgagaucaugccaaggcacuccagccugggagacagagugagacucugucucaauuaaaaaaaaaaaaguguuaaaguaacacaugcucauugcuuaaaaagaaagaaaagugaaggcugaggcaggaggaucacuucagccugggaagucgaggcugcagugagcugagauugcauuacugcacuccagccugggcaacagcgagacccugucuauaaaaaaaaaacaaaaacaaaaacacaauuuuucaaaaaaaaaaaaaagaaaaugaaauccaauacuauacaccagaauuuaaguaaaauauaaagaccacuaguccucucaccucuauacaaucaugaaacgugucucaaauccagccuccucucuccaccccgcagccgcccccccgcccccgaacucuuuuuuucugagauggcgucucacucuguugcccaggcuggagugcaguggugugaucucagcucacugcaaccuccgccucccgggcccaagccauccuuccacuucagcccccaaauagcugggacuguaagcacgggcuaccauggcuggcuaauuuuuagcccgggaauuugagucugcagugagcuuuaaauugcaccccugcacuccagccugagcaacagagugagauucugucaaaaaaacaaacaaacaaaaaaaccccacauacuguuauuaauuaucaucaccauguugucaaaucuucucuuucugaacccuucugcccuuaauucccuuaacccuucugucucuuaacccuucugcccucccccacaaaaacccuugugugaaaauguagucuuaaaaagaauucaucacagguuuuuuuuuuuuugagauggaguuucgcucuuguugcccaggauggagugcaguggcgcgaucucggcucacugcaaccuccgccucuuggguucaagcgauccuccugccucagccucccgaguagcugggauuacaggugcacaccaccacgccuggcuaauguuuucuguauuuuuaguagagacaggguuucaccauauuggccaacauggucucaaucuccugaccuugugaucugccugccuuggccucccaacgugcugggaguacaggcgugaaccaccacgccuggccucaccagagguuuuaacagauguucuauacuauguaaugagugaauuaauuaguuauuugguagcucuguuuugagacaacuuggggcuucccucuccuccuagaauuaacuaacagcuggugaaagagcagagggacagugaccaccaggccaaccucgcccagagaacugacagcagcaucagcggcucuuacagcagcccccuuuccucuguucccacugcagccuccaacccuggacucccuaagcccagaggggaaaggaagggccgucugcccagccauuugaacccugauccaucuuggauuggagaauugcuuuggagaaaccugaaaucaagaauuggcgcuugcugagauuugccugggggaacauuugccccauccuugaguuuggcuuuugcauuuucuggccuuucucaugcuuuccuguccauuuucagaauguucccacugcaugaaguauugucucccugccacacuucauugucaugggggagaguguccugaagacccuuguuucauguugcuggggcccaggauugcugucugcagagagauaggggucugaauaggucuaccucucaaauuauccugcuucugggguugauaggaguugggggaggagacugaggagcuggagacaaagcucuguggaacccaccaaggauuuuaaacccucucccaugaagagcccuagaucagugacaagugggagaguugccauuugcaacuccauccaucuauuuuugucuucuuucauuugcauagaucugagccagguaagcaucagcugauacucuucuuauaaaucagauuguaacccgauuugucugucucauuuuuuuacccucuaauacagcacagguacaguaugccuauagguaugucccugaaacauucuaugcaguucagauuuuuuuuuuuuaggaacuauuuuaaauucauuaggcaggcuuuauuauuucaggcauccaugauggaucugcuagcaacaggaaaaucguucuucauuuguguguguuuauuaucaaaucauagaguguaacacuuacaaugguccuuaaauaucaucauuuuauaacuaagaaaaccaaggaucaggaggucacugggaucacaaagccagugaaagaacaaggaccaaaaccuuggucuccugacuucuagcccacugcucuuucaaucacagggacaaugaaauacagagaaguuuaaaacuguuaucuuccuauauuuucauuuccaucucuuuuuucuacuuaaaaacauuuuauuucuauuuuuuaaaauucaaagguauauaauauuaaaaggugcuuucacagaaguaagcaccauaaaaaauucaauaugccuucuaaguguuuucuaugccucugugaugccuguacacauacacauagaggcuccuauacuuacaagugcauuuuuauuuauuuuuuauuuuauuuauuuuuuuugagacagagucucacucugucacccaggcuggagugcaguggcgcggucucggcucacugcaagcuccgccucccggguucacgccauucuccugccucagccucccgaguagcugggacuacagacacauaccaccacgcccggcuaauuuuuuguaucuuuaguagagacgggguuucaccguguuagccaggauggucucgaucuccugaccucgugauccgcccgccucggccucccgaagugcugggauuacaggcgugagccaccgugcccggccaagugcauuuuuaaaugaauuuuuaauuuuagaauaguuuuucauuuacccaacauugcaaagguagucuggagagcucucacuuugcucacacccaguuuccucuauuauuggcaucuugcauuaagccccgguacauuugucaugauuaaugaaccaauaucggauguuauuauuaacucaaguucauacuguauccugaauuccuuucagauaucccuuuucuguuccuagaccucuguagucauugggucucccuaaguuccuacuggccaugacagauuuaagcguuuuuuugauagugucacuuuugugauauauauggcaaccuuuuuucacauaacuauauguuuugaacaccuuucuggguuaguguguguggccuuccacacccuuuuaacucaccacaguguucuguugaguggcuuuaccccaucauuuuacacugcccuuggcacagagcccccgucuggaagugucacugggccugggugcugucugguggauuagacagacgcuuccacugucuuggaauuuggacacugugggaacagagaacauggauguaaaugaccugacagagcucagagaaaaggagccacguggccuggggcacugcuguuguggcgacccuucaccccacgcccuccacccuacaucccucaccccacacccuacgcccugcgaguggcucuguguuuacauacaagaguuuacaucugugguggaagcacuuucucacaaaaggguagggcuuauucuaggaggcccuaccaaagaaaagcacuagguagcagcauuccagcuguagggcccgugacuguggcaugcggaacauuccugccccuggaaauccaguaguagcuugguggacgucugucccuggaaauccaguaguagcuugguggacaccugccccuggaaauccaguaguaccuugguggacaccugccccuggaaauccaguaguagcuugguggacaccugccccuggaaauccaguaguagcuugguggacaccugccccuggaaauccaguaguagcuugguggacaccugucaggagugcuugaguagagcguugauacuaaccugugaaagaaauuucucaugaucauccauuguaacuggaagagaucugaaaaaugacucggcccaaggucccacagccaguggagacagaaugucuucucuuacugucuuuuccgcuggcccugccagcccagaccugucccuagggggacauccaauucauauucguuaaugaagagaaagcuuccagauccuucaaggugucucuguuaccucagaagguccagugcauauuuugaaacaacuuacuuuuguuuuuuuuagacagggucuugcuccaucacccaggccacccaagcuggaguucagugaugcaaucauggcuuacugcagcuucgaacucccaggcuugagcaaucuucccaccucaggcucuugagugccugggacuacaggugugugccaccaugccuggcuaauuuuuaaaaauuuguuauagagauagggucuuacuacauugcccaggcuggucucaaacucauggucucaagcaauaaaacagcuuuuuaauguuuaaauuauacccgagguuugguucucugcagaugucccccagaauugggcacagccuccgaucggccuuauuccucucacuuaauauuugucacuauuccaaaccccauguucaacacuucacccauuaccuuuucccucugaccucugauuugcacaggcccuuccagcagagcuccaggcuguucuugcccaagcagagauuacaaacauacuacuuugaggacugacccucccagacuuaccacuucagccgaaguaagggagaacuagacaacucucuuugucucaugcuacaaagugccccaggaggccuuucauacacaauuauuuuucaguaaggagccagggaaccagggucuuuuccucucaugcaccuugugagguuggcaggacagcgugugacucaugccuggacagaggcgcauaccuuuaacagccuugcuggggaggugccccacuuaggagugguggagauacacucuacugguuuuuccuacccagcaggugucuaagacagacacacucagacaacacugcuuuccccaucacugccugucauccaacacuucaaagaugauggacaacgugucugaagcugauggggcggaggaccccugcacaccugcaccuacuaaccuacugcuguaccuucgccccacccccagcccccuuugagagcucagaucccgccuaggaggggauggaugggcuuguuaacagcugacaagugcucugcaaaaugcagcuguuuaaucauaaaugaacauuagaagguggccuggagccacugugcuuuaggaaacucaugcgcguggagaggacaggaggaaaggagauuuccagggcaggagaaacuugggaagcaacacugaaugggaagagagggaggcuuucuaggggauuuaaaugauacugaaacccggauacggaauaggagaaaaaauaccaacuugcucucagggugucuuuacucuccccagugcagauuucauugaccuaaaucaggucucugcuccuauuugcugguaccuaguucaagagagucuuauaaauacacaaagccggaaaugccuggguagggggguggcaagagcaugcgguuccacuccaggacaggaucugacucaaaucacacuucccuccuggauuccagacugucaggagggaugccuccgaggugguguuuggaaggaggugcugagagcggagcuggguuauucuaagcguggcccagggaagaucuugccagacuuguuaaugugugaccccacccagugccaugcucagcaaggcagagaagugugcuguggguggugggagcaagaaagagaggaggccaggacaucucuauuccacacauacccuguuucaucccuugcugcauuucacuaaaauuauccacucgccccuacgagaccugcuguguccuccuugaguccuuguuuggcauaccuuuguucccuuccauggccgagugaguucaguccacauucauugaacugaaagcucacaggucuuggagccuggagaaauaaucggaaccauucccuuucgucuccaggcaagaugagcgauggacccagguugccuaaccuaguuagcugcaugacacuccagagcauccagcucaaagcaggcauugacagggauggggcacccagagaaauggcgcuggugcugcuguagggguaagauguagcagcaaggggcgggcaagagggcuccagaugauuucugccaugcugagcuagcugccugcuggcuuuguaagcaguggaauaagaagacuauugugucaacucuuugaggggguguggccuuccuuggggugagaaagcacaaugggaagggcuagcagcucccccgauccucuuccuacugugaccugagagacacuccauggggggguuggacgcuggggggcuggucaggggaguuggcugggcugggagggaaacgggcccuuucaagagcaagucagacucuggugagcuguuuacccgccucaugcccaagggugcaaugugagucauuuaauuuaauugguuuaauaaguaaacggucuggguacaaagaggaggggguuggguaugagagggaggggcggggcaaacccugcagagcugcuuuggaaagaaaccuguugccagcccucuagggauggucacaauuaaacagggaguggagaugcuuugggaaguagggagaagggagagccccagauguugaaguggaaagaggaguagaggcuauaagucggccagccucagauucucagugcccaucugaguauucgauucacuggugcugguauauccacagggcugugcaaccauugccacuaccuaauuccagagcauuuuccucacccuagaaaggaaccucacccauuaucagucacucccaauucuccccaccuccagcacuggaaccacgacucuccuuuuggucucuauggauuugccuauucuuuuuuuuuuuuuuuuuuuuuuuuuuuuuuuuuuuuuuuuuugagacagggucuuacucuggugcccaggcuggagugcaguggcagcucacugcaauuucugccugccaagcucaagguauucucccaccucugccuccugagcagcugaacuacaggcgugugccaccacgcucggcuaauuuuuguuuuuuguuuuuuuugguaccuuccaccauccaccuuccaccuuccgccuucugccuuccgccuuccaccuucgaccuucuuccaccuucgaccuuccaccuuccaccuuccgccuucugccuuccaccuuccaccuuccuuccaccuuccaccuuccaccuucaaccuuccgccuuccgccuuccaccuucugucuuccaccuuccuuccaccuuccaccuuccaccuucuuccaccuuccaccuuccaccuucuuccaccuuccaccuucuuccaccuucuuccaccuuccaccuuccaccuuccaccuucuuccaccuuccaccuuccaccuucuaccuuccuuccaccuuccaccuuccgccuucgaccuucuuccaccuuccaccuuccgccuuccaccuucgaccuucuuccaccuucgaccuuccaccuuccaccuucuuccaccuucgagcuuccaccuuccgccuuccgccuuccaccuucugucuuccaccuuccuuccaccuuccgccuuccaccuuccuuccaccuuccaccuuccaccuucuuccaccuuccaccuuccaccuucuuccaccuuccaccuuccaccuucuuccaccuucuuccaccuuccaccuuccaccuucuuccaccuuccaccuuccaccuucuuccaccuuccaccuuccaccuucuuccaccuuccaccuuccgccuucgaccuucuuccaccuuccaccuuccaccuucuuccaccuuugaccuuccaccuuccaccuuccgccuuccgcauuccgccuuccaucuuccuuccaccuuccaccuuccgccuuccaccuucuaccuucugccuuccaccuucgaccuucuuccaccuucaaccuuccaccuucgaccuuccaccuuccaccuuccaccuucuuccaccuucgagcuuccaccuuccaccuuccaccuuccgccuuccgccuuccaccuuccgccuuccgccuuccaccuuccgccuuccaccuuccaccuuccaccuuccaccuucuuccaccuuccaccuuccaccuucuuccaccuucuuccaccuucuuccaccuuccaccuuccaccuucuuccaccuuccaccuucuuccaccuuccaccuuccaccuuccuuccaccuuccaccuuccgccuucgaccuucuuccaccuuccaccuuccaccuucuuccaccuuugaccuuccaccuuccgccuuccgccuuccgccuuccaucuuccuuccaccuuccaccuuccaccuuccgcccaccuuccaccuuccgccuuccaccuucuaccuucugccuuccaccuucgaccuucuuccaccuucaaccuuccaccuucgaccuuccaccuuccaccuuccaccuucuuccaccuucgagcuuccaccuuccaccuuccaccuuccgccuuccaccuuccgccuuccaccuuccaccuuccaccuucuuccaccuuccaccuuccaccuucgaucuuccuuccaccuuccgccuuccaccuuccaccuuccaccuucuuccaccuuugaccuuccaccuuccaccuuccgccuuccgccuucugccuuccuuccaccuuccgccuuccaccuucuuccaccuuccaccuuccgccuucugccuuccaccuuccgccuuccaccuuccuuccaccuuccaccuuccacauuccaccuucuaccuuccgccuuccgcuuuccaccuucugccuuccaccuuccaccuuccaccuucuuccaccuuccaccuuccacuuuccaccuuccaccuucgaucuuccuuccaccuuccaccuuccgccuuccaccuuccaccuuccaccuucuuccaccuuccaccuuccaccuucuuccaccuuugaccuuucaccuuccaccuuccgccuuccaccuucugccuuccuuccaccuuccgccuuccaccuuccaccuucgaccuuccaccuuccaccuuccaccuuccaccuucuuccaccuuccaccuuccaccuuccaccuuccacuaccguucuuggauuuugccaacaaagaacaaagaauugagggcaaaucuguagaguaaagugaaagcaaauuuauuaaaaaaguaaaggaguaaaacaaugacuauuccacaagcagagcagcccugaaggcugcugguugcccauuuuaugcuuauuucuugauuagaugcuaaacgguguggguuauucgugccucucauuuuuaggccauauaggguuaacuuccugaugucgcugugauguuuguaaacugucauggugcuggcgggagcauagcagcgaggacaaccagaggucacuuuuaucaccaucuugguuuugguggguuuuagccggcuucuuuccugcagucuguuuuaucagcaaggucuuuaugaccuguaucuuaugccuccuaucuuauaccuccuaucucauucugugauuaagaauggcuuaacuuacugggaaugcaguccagcaggucuuagccuuauuuuagccagccucuauucaagguggaguugcuccagcaccucugacaauagcucacuacggccucaaacauuuuuguauagacgcggucucccuauguugcccaggcugaucccuaacuccuggccucaagcaguccucugaccucaguuucccaaagcaugcggauuacaggcgugagccacugugcccaguccauuucuuuuuauugcuaaguuauauucuguuguguggauagaccacauuuugcuucuccauucauaguugaugauggacauuugcauuguuuccgcuuuuuggcuauuaggaauaaugcugcgcugaggcuuucauuucuguuggguguauaccugggaauagaacugcugggucaaauaguaacuccauguuuugagggacugucagauuuuuccaaaucggcuacaccauuuuacauucucaccagccauguaugaggguuccaauuucucuauguucuugccaacacuuguuauuguccguuuuuguuuuuuuuuuuuuuuuugagacggagucucgcucugucccccaggcuggagugcaguggcgcgaucuuggcucacugcaagcuccaccucccggguucacgccauucuccugccucagccucccaaguagcugggacuacaggugcccgccaccacgccuggcuaauuuuuuguauuuuuaguagaggcgggguuucaccguguuagccaggauggucucgaucuacugaccucgugaucugcccgccucggccucccaaagugcugggauuacaggcaugagccaccacgcccagccuauuuuuuuuaaauaaaagacuaauaaauucuauuaguaugagagcaaggaggaaggcauggaagguuguugcacugucaacauuaguuaugguggggaggcagagaaggagaagagaugcuuuuuuuucuuauuuaugucugaucacugguuguggugaauacuugggauuucuaggaaacaaaaaaggguccauguauaagaagaguuuagaauugaaucagaauagugguuaagaacacaaauucugggcugggcgugguggcuuacaccuguaaucccagcacuuuggaaggccaaggcgggcagaucaccugaggucaggagcucgagaccagccuggccaacauggugaaaccucgucuccacuaaaaauacaaaaauuagccaggcuugguggugggagccuguaaucccagcuacucgagaggcugaggcaagagaaucgcuugaaccugggagguggagucgagaucgcaccacugcacuugagccugggugacagagcaaggcucugucucaaaaagaaaagaaagaaagaacacaaauucuggaaccaaagaccuugaguuccuggcuccacaacuuacuagccauguggcaaguuacuuaaccucucugaaguucaauuuccucaucugugaaaggaaggcaauaauaguaccuaccucaaagggguuuuuuuguuguugucguuguuguuguuuuuugagacagucucacucuguugccaggcuggagugcaguggcgcaaucuuggcuuacugcaaccuccaccucccuggguucaagcgguucuccugccucagccucccgaguacugaguagcuggggcuacaggcgggcaccaccacacccagcuaauuuuuuuuuucguauuuuaguagagacgggguuucaccauguuagccaggguggucucaaucuccugaccucgugauccaccugccucagccucccaaagugcugggauuuuaggcgugagccaccgcacccagccucaaaggguuuuuaugacaauuaaaagggauaaauuuguaagauguuuaagacacugccuggcauauuguaaaugcuaaauguguuagcucuuauuguuuuuaucaucucguauuuaucgaauauuuaccguaugccacucucauuugauccucauaaccccguuugggaaauacuacuaauauagcuguuucacagagaugaaaaccaaggcuuagagauuaagcuagaugucuuagcgccugacucugaaguucuuccccuacugccuauagggauacuauugucaguaacauuguuuguugaacaaguaccuaugugcugggcauaaugaaaaaaguagacaaaaauccugcuuucagccgggcacaguggcucaugccuguaaucccagcacuuugggaggcugagacugguggaucacgaggucaggagaucgagaccauccuggcuaacguggugaaaccccaucucuacuaaaaacacacacacacacaaaaauuagccaggcgugguggcgggugccuguagucccagcuacucgggaggcuaaggcaggagaauggcaugaacccgggaggcagagcuugcagugagccgagauagugccacugcacuccagccugggcgacagagcgagacuccgucucaaaaaaaaaaaaaaaaauccugcuuucauggaacauacauucaaaguauauguguggggagaagauagauuuuauacacaugcacacauaauaugucaagugguaauaaaugcuauugagaaaaauaauacagaguuagaaagagagugauaggcuggagguagcguguuauuauagauaggaugaucaggaaaggcuucugauauuugagcagagaucugaguaaaaagggcaagaaaccuucgcagggaaguguguuuuagguagaggacaugcaaaggcccgggguacagcaugccuggcauauuggaaggacagcaaggagaucaggguagcuggaaugaaauggugguaaagagauaggagacaaggucggagauuuaaucugcaaggccuuacucguugagcaaccauauaauugauuguuuaaauuggaauauuuuugagagugaaagcagguaccauuaauaauugucaggguaacaaguguaaacugggucuuuccccaauaaacguuacucauuggccaucagaaggaucuuggauuguauuugagugauuugggaagucacuggaagguuccaagcaaggacuggcauggccugacuuacauuuugguggaguuccucuggcuacuagaccauaggugcagggguggauacaaggggacuggaagagcgaugaugucuaggacuggagugguggagacggaggagggagaagucaucagauuuuggauggcuuuugaaaguauggcugaugagacuugcugagggauuggauauggggagaggaaucaaugagggauuggauauggggagaggaaucaaguaguuugaagauuuuugaccugggugguuggaaggcuggaguugucauuuacaggauggagaggugcagguuugggaggaaaaaucaagaguuagguuaaguuucagaugccuuugguauccaagugagagagugaguaagaaaauucacuguauaagcggggaguucaggcuaaggcuagggaagucaucaauguacagauggugucccaaaaaaccugcugagaucagcaaggcagcaguguugauggcaaagacaaauaucggggacugacccuaagguaagcaauccaguguuuaaagguuaaaggaaaaaugaggagcauuuagcaaaaggauaaggaguagcccaugggagaagaucagggauuacaggggaaucauaaccuucugcuugacacacuucuguacucugugauuuagggggagggagguaaacauauguuacuuguauuuuagaaacaaagcuucuggguuccagucagggacccaagacaggugucuugugggaggcgaggggguuggagguggcccuguaaaaucuaggucucuuuagggacagugauguuauuuccguuuuauuuuauuucagugauuuauuuacauucccagacccagcaauuccaccuuccccaaaaugccuauucaugaccuacuuccccaugaugucuucccugaccaccaggauccuccucucuggauuccaggagacuuugcucagugcucaguuauguacuugucauguuaucaaacccauccuuccugcaugaagcagggcugugccauggggaaagcauaggagaggcaggcugggugugaacuccaguccagccaugcauuagcggccguggcaggaccaucagccaugacuuaucaauuccucaccaguggggcuccacaauacuggcuucacaggauuggaaugagaauuaaccaggcaguagugggaagagugaggucuuugaaaccaaacagaauuaguuugaaucccaguuuagcuacuuuuaagaucuggggcaaaucauguaaacucuuuaaaccucaguuuuaucguuaggaaaauggggagaauaguaccuuacagggcuguugugcauuggaaauuaauucauucauuuaccuaauucaucuuuccagcugaauuaugaggguagaggggugaaacaacugggcuuuaagauauuaaggaacuugccaaaggucacaagcuaaaaaguggcagggugggaauucaguuccagaucuuucugcucugaaagugguucuuacccaucuucaaucauccacucagagccaaacaaggcagcuaugcgcaguugucucuugguauccacgacggauugauuccagaauuccccauggauaccaaaauccgaggauacucaggucccuuauauaaaauauggugcaguauuugcauauaaccuacauacauccuuccauaugauuuuuuuaagacucugggucucacucuguuccccaggcuggagugcaguggugaucauagcucacugcagacuccaacucagggacucaagcaguccucccuccucagccucuaggaccacaggcgugugccaccaugcccggcuaauuguuguuguuguaaagauggggucuguuguguugcucagccuggucuccaacuccugggcucuaagcuauccucccaccucagccucucagaguacuagaauuacaggcaugaggcacugugcccagccccucccauauacuuuaaaucaucuguagauuacuucuaauacuuaauacaaugcaauagcauuugcaguuacauagcauuguaaauaguugucaugcuguguauuuuuaacuuguauuuucuauuaucguauuuuuuauuuuuauuuuucugaauauuuucaaucgcuauugguugaauccacggauaugaaaccugcgggaccuguguauaccaaggacugacgauauacauaauagaugcucagaaaaucuagcuuguugucugcccacguggcuucuucuuuaaagucucuuuuaaagcuuccuucccacuguaagccauuucgugcaaccaucagaauucuaauaaacugauccaagaagccaauucaaaauaaaugucagacugugcagucuuugugagaagccuguaucuguuuuuacaugcuggugaacuccagggaaaccuagcucagugccucagcccacucaagggaauauuugcaucuuacccuacaaauugccuacaacaggcucuuugaaagauggaaaacauauuccccuaagaccugggaaggcuaaacaguuaauagcuucucaaggguuuuauguauuacuaggauaccggcagcuaucacaggucauuaaauaucaaaguuuaugcucaagaagccaaaagaaaaacaauccagcuucucugugccucaguugucuucacaaauaccccaacuaggagaauguuccagaaaccauuuaagcaucaugcagguaaaaugagagucgcacagaucugaaggguucaaauguucaccgcuggcagaacgcggcucaguggcaauaaggcucccuccccuuucauccuggagcuuucuccuaguauuggcuccuuccccaaagcgucucucuuuuccuuucugcuuuuuuuuuuuuuuuuccgguaaggaucagagucauccaucccaucccaagcaguuuuuaucagcucaucuucugagauauccuugauuuucucuuugauucccaccagaccuuguugauguguugguucacugaggcucuuucagccgaaucagggacacaaauuuagguugagcgacugcuguuucuuagcaacuuagcaacugcagucucaucagcaaaaggugaguagaggugagcuccucacucagcccucaacagcgcucgccauaacccuuggguuguuuccauggaaaguacucucucauuggccggguuagucccuuucauauucucagcuuucuacccucuuguuauguccucuguguaggggaauuucaacauauauuugaccuagcauugguucuauugcugucuccacuucauacuucacuguuuaugguucgggccagcugucaugucccuccagcauggaguuagaccuggaucgacgcgcuggcucagggaaaagggaguggugggagaaauugcuggggguuaggggcaagacaggacaugggauagaggguuuuggaguaaacuuuuauccucuaaagcuauccaugcgucuuagcaacaucucuguugacccagcuauacauggguuagauagaguuguauagagcaguucccucugguccuuugacccgugauuuuagcaaaugugugaggcugaggacuauagagaucuuugaaacugauaacagugucaaacaauguaacuggccugguuuuccaggagagaugaacuauuucagacauucuauugccauagccagaccacauauccugauuuugaguucagaaaauaugguuauuaacacaucaaauaaccaguugauuuaguaagguccucacuuuucuauuaucauacuuuucccuguagacauagagcuguaugggauguaaaaauccugcucaguaguuuaauuggccaucauaacggccgaugucucauugcauugcugaaagguaagaguagaucaguagaaauuaucuuaugggauugugacuaauaguaucugaacuaaaguagguauuuugacaauuuuccugaggcaggagaaucucuugaaccugggaggcggagguugcacugagccgagaucgugccacugcgcuccagccugggugacagagcgagacuccgucucaaauagauauauacauauaugaauuggaguguugcuuucaaaggcucugacuguuuuaucucaacuuuccaagaaauacuugcacauugucugccugcaugggaacucacuuuucccugggaacucacuuuuccaggggauauucugaauagucagcucuuccauccuguaaaguuucuuaaguauuguaaaacuaacuccauauguuuguaucuuugauaccuucagcugcauuuuaggugccuuugcauuaaaaacguaaugacucucggagaagucacacccccgguucaggaagaacagucaguuauucagaguuaagcuguuuucacagggaagauucagaacaucgcccucuccccaccccugagucuaauggcguuagaaggaugugcgguccuucugccagcaggacucucgucaucacccuccugauguagcccacccuccaccaccacgggacaccuggggauuugaauccuggggucacuuagacccucuuucccaggaauuuaaauccuaagucacuuagacuguccugggaauuugaauccuaagcagagacacacugaggugucuggagccgggucacuggguggcuguugagaucuaaucacugccgugguuccuggccuuuccggggcccagucgugugguucugucuuugauucugugagcuacucuguggucuuucccagaauuacucuuggccugaauuaggaaggaagagagggcggagaggcaggccaugaugguaacuggaagaaacuacagugaaggaccguucuuacccgccucuguuuuuaguuccugggccgucacugagugacaugguccugccacacaaucccgguaugcggcuugcucaccacgggguucagaacauccaaaaugccacguucagugggacgauuccacugacacguugauguugccgcagcguccgauugcacuaauucuacgugcucgcucuaaguuccuguaccggccucacugaggacaggcaaccaacaguucgcagaccucuaucggcacugagcuggagcuuccaugggagcagguaacuuagccucucucugaagcugggauguguuggaacugcugauuuccacacaggcuaguggacuaggaccucccugucccuggggagagcccuacuccaggcccgcucagaaguucuuuuuuuuuuuuuaacuuauuggcugggauugccccaaccugacucuacucaccugccaccccuccucuuuccacccaaggcuucccagacuuucugcuuucuccaucaaacaugagcuuugccaccaaagaagagagcagccuggccucccuuggccugcagcaccugcuccuugugugcaguuuaaaaaaaugugccuuccaagagcauggcaagcaagggcucugagagauauuugcacacucuuguucacagcagcauuuuccacaguagcaagagguggaaacagcccaagugucuaagacagacgaauggauaaccaaaauguggucuguccauacaauaggauauucagccuuaaaaaaggaaggaaauucugacacaugccacaacaugggugaaccuugagaacacgugaagugagaaaagccagacacaaaaggaaaaauauuguaugauuccacuucugugaggucaaauucugugaguagucaaauucauagagacagaaaguagaguggugguugccaggcccuggggggaagggaaaguggcaguucguguuuaauggguacggaguuucaguucggcaugauggggagguuccagagguggaugguggugaacaacaguuugaauguucuuaaugccauuaaguguacacuuuaaaaugguugacaugggccaggcgugguggcucacgucugucaucucagcaguuugagaggccacgaagggaggaucacuugagccuaggaguucaagaccagccugggcaacagagagaccccugucuguaccaaaaaagaaaaaaaaaauuagccaggcaugguggcacacgccuguggucccagcuaccugggagcugaggugggaugaucgcuugaaccugggaggucaaggcugcagugagccgagauugcaccacuguacucugcacuccagcugggugacagagggagacucuguuuaaaaaaaaaaaaaaaaaaaaaaagguuaaagugguaacuuuuauguuauagguauuuuacuaaauacacacucccccuaaaaauuaaauuuaaaaaagagagaaagcauucccuaaagaaagcacuuccuucgaggcaccuuuggacugugccuuugacaucugugccauugugaguguccacagggugcuggggcagucuucagcugguuguuaauuuaucaaugucagggccagugucugucacuucacucagucccuagcccagaaucgugaccagcagaugccuaaucgguucuagcaugauaaauaugccaggccucucacuaaacccuccuuguccuuccuucauucauucauucacuccacaugcaucaaaugccugauuucuauagugagaauauaaaaucaggcccaggcaauuuaauccuuuucugaagcguggauguguugaaacuacuaacuuuaacucauuuauacagcgagaaucuaauaacaaacaagaccugguuucugccugcauugugcucauuuucagcccuuuccuagauuaggcucagccagcguccuccccggaauacucuaccugcagcucacuuaacuccagcagcuauggcuaaguacugagcuguggugcacgaagucuugggccaagaaucaaaggccuaggcucuaguccggucccuagcacaggcuucccuuugacauuaaacaaauuaauuaacuuuucugcaggucucuaugucuccaucggcaaaauggaaaugauuuuuggcauugggauaaaaauaagaauaaacuaagaaugugaaucaacuccgauagaaaacaucagauauaggccgggcgcaguggcucaugccuguaaucccagcacuuugggaggcugagacaggcggcucacgaggucaggaguucgagaccagccuggccaaauagugaaaccccgucucuacuaaaaacacaaaaaauuagcugagugugguggcaggcgccuguaaucccagcuccucgggagacugaggcaggagaauugcuugaauccaggagggggagguugcagugagccaagaucaugccauugcacucuagcccaggcgacggugagagacuccaucucaaaaacaaaaacaaaaaaacacacaucggauagacugauccguggugggaugguugacuaaaccauacaacccauuccuccaccccgauauggucuaaccugaaguuccauuaaaaugauguuucauggggagcaggaaagcagauccccauauuccuuucuugaagaacaaaguuacugucauacaugccuucuccguccuauuuaucacuaccaaggacagguuacaacaaccucaguuugacuuuggcaaguuauaaucaucagaccucgcagaucuagcagcuggcagcccuccagaucagauaauguaccuuauuuguuuucaagcuugaugcagaaaagagaaagggcuuaauaagauccuuaaaagaguguguuuuuccaaaaggagccgucagguggggagagggcaggguggccguggcuccuggcugcuggucccaaacccagucccugugugggccuggaaaacuuuuuuggccucagggccauaccucuuucugcuuuccuuggauuccauugcuuuugcauucaacaaacaaaagggucugugugagauacuuguuaagacauguuaaaaaaaaaaaaaaagaaaaaagaaaagaaaacaaacgaguuaaaucucagcuccauuaucuagauguuguaguucuugggcagauaugcacucuccuuaccagucaggaccucaguuuucucaucuguaaaaugggaauaauaauaccuaccguaaggauuguuaggaagauuaaaugagaccauuuaugucaagugcuuagcgugaugacuggccugcgcaaacgcacauucguuagcuguuguguuuguccucuguuaaaugcaugugguggguuaaacuuguuguguuaaaccugccacuaucuucuguugaacuuguugguggguuaaguggguuaauguacagaggagggcuuuguaaacaguguuguuucccacccaggucccuuuugacaucuuacuguagucagcguacaagucuagccucuucauaaauaacacaauuuuauuuauuuauuuauuuauuuauuuauuuauuguuguugagacggagucucgcucugucgcccgggcuggagugcaguggugugaucucggcucacugcaaucuccaccuccuggguucaagcaguucuccugccucagccucccgaauagcugggauuacagguaagcaccaccacaccccacuaauuuuuguauuuuuagcagagaugggguuucaccauguuggucaggcuggucucgaacuccugaccucaggucauccgccugccucgaccucccaaagugcugggaugacaggcgugagccacugcgcucggccaauaacacaauugucaucaaguauuucccaugucucuccuccugucuccguugcuggugaggugaugcucucuuuucuccuuuccaaagccacacuccugacuguauucuucucucccacucuuuuuccaaucuucaguuuuuucauucugguuccuucucuuuguuucuguaagucgugugucccugaaggcccuccaacuauggaaaccgccucccuccucaagucagggcggagucacuuccgccaagcugggaagaguuccugcucccuccuuccaccuggaaaggaauaggaggaagagcacaggcuuuugaccagcuacggggcuccugucccacuguggcccuaaaccguucagagcauccaugggcaaugguaaacauugaggugaguucuggagauguuucugcugaaacuacuccauugccaucuuacagagucaggguuuuccuguagcucuguugcuuuuccuggacucuuuaggacacugaagaccaguuuuccaaucccggaaaacgugugcagaacauucugccugagguuccugcggccugagaaauggaaacuuauugagcaaugucaugucaucagcauccaguuagcccugaugucuaaugagugucugcuuguuugcauaaugcagaacuggccugugugugcccugcaugugggcauggguaugugugccagagcgcauccucaaguccauggauguccguccuaacugcaccuagggaaggguggagcugaaugucuccauuggugcuuuucuauguaucacagcggguagcagaggacuaaguacagcacacaacaggugcucaguaaaugccugcugaugguugguucacugacucauuugcucauucuuucucagccugcugaucgcuuacuccugaccaccacuaaacuuccucuuugaaagacuccagggaggaaaaggauugccccacaucuuccgucugcaugcagaaacuuauccugucccaggccagaaagaagauaggaaaagacaagccuagcggguucagaaaagucaguacugaccugagggauccuggaagcaccucuguggcccuucgcuagguccaugggcuccggccagucuuagaggucccggagccuauuacgucuagauuuuccuaaaucaccccauuguaucaagggucuuaagucaaaauuccccuucacaggacuguguuugucgcuguaauugucacaacacuuacuacuaaaugggcccuuaaauguuauagguguuuguuuguuuguuuguuuguaaugaugaugaugauaaugaugauaucuuagaggugaccccauggccuggcuaaaccuucuguggccucuucugaucaaauucguggcuuggaaaauggauauuuacugagcugggcuggguccagacagacuccauauucccagagcagcgacagcagaauagaaagggcgucugcccccucuucuuaccuccucuccuuaucugcccccuugguuuuagacuuuguguuuuuguuuuuuguuuguuuguuuuugugauagagucucccucugucacccaggcuggagugcaguuguacacuuguggcucauugcagccucuaccuccuagguucaauccucccgaguagcugggaacacaggugcgcaccaccacgcccagcuaguuuuuuguuuuguuuuguuuuguuuuuuuuaaagaaacgagguuucaccauguuguccaggcuggucucgaacucuugaacucgagcaauccuucacccuccaccugcuaaagugcugggauuacaggcgugagccaccacacccggcugguuuuaugcuuuaauguggauguuugggccaagcagggauguuugggugaggaggaagcacugucagcagggcagaaguucccaggcaaacaccuggcaugggcucagaugcccucucuugggcccccuuagggggcacccaguggggcaguagguacagucccuugugccuguagcucgcaaaccucagccugccugcagccacagccguuucaguagcucaggugcuagcuuggcaggaagcugggggaaaggacagcugguuguucuucaggugccugcccuggccgugagcaucagcaggcucaggguagcgucggggaagagacuuaucauggccccacccauauccaucugcucaucuagaggaacggguaggccuuaggauuccaccuuucugcggcuccucacuugcccccccaccaugcacaccugugcugggagggagcaugagauggggccaggggcagugucugcuugcagacacacagcuggguggcuuacguugagaaggaagagcuugggagccaggaagaggggagcaggcucacacucaaaugcucucauguccaauucuccagcuguuugggaccgugggacaauagaguugggucuccacacucuuccuugcauuuugggggcuuacauggagagauguuagucaaaugagagauaauaaggaaauggucugggggugugugugugugugugaagugugggugggugggugaguaggaggucauuggagaggggauaggggaacagggguagcuggugacucaguggguaccugacaccgggugauaagauggcaauaguggaggcagacacaaauucucaagcacguucaauguagaguaguggaauuugguacacagguuuuuguccuggguucaaauacuggcucggucaccuacugccuaugugacuuuuggcaagaauuuuaaccucuaagccuucuuuuccggcuuauucuauuaauuuuuaauuuuuaaauguuuuuuagagacggggucucaucauauggcccaggcuggaguucaguggcaauucacaggugcagucaugacacacuacagcccgaaccccugggcucaagccauccucccaccucagccuccugaguagcugagauuacaggugugagccacugcacccagcugguuuauuauauuaaauaaaacacccgauguuucacuuaauauacauauaacaggcauauguauguguauauaaaugccuaacacguaaguguuaaccguuacuguuguauuacuaauaauuuuucucgcaucaaguucccuggcgcaucguguacuagaaaggauagguuuagccacacagccuggcucugccauuggagcauuggguuugccuuagggacucccucccagguggcaggccccuggcuucaccccugacucucugugccacuucagguuucuggcgggguucaggcccugcuggcuucuagccuuagcagcuuuguccugcugaggaugugugacuggucccacaugcucuccaaggacagagccacagccccugcuuuuccaucccaggacucagugcugguuccuggcauuuguggaacugcgcccuggaugucauggccucauguucauucccuugacaaccuccugcucucuagugggagaagggcucuguuuccguucagcuccucuggauuucaucaccuuuucucauuccaguuugagugucuggugacaguucugucuacagaccccggggcuucuuagccaaucauguacguucacccuggauccucagguccuuugcauguggugguguacauggaaccagcccucccaggccucuccuucucccucgcuuuccuagggcccugguagggcccguccuuccccucuugcauacccuugcccagggacaagcccuuucuaauggagcccugccccaaaagagcuucagaaagaccuuuccgcaucucccccuguaggugucacccccacacccacugcuuccacuucuuucucgggcuuacucucagccccaccucuccuguuggcauucaugaguugccuccaggcucccuacugauggagggagcuugcuuuugguuggggucgggguuaacccuuuagcucccugucuacccccuugugauggacuugcgccauccgcuggguugagcagucuccacccaguuacaucuguaggcgggcaacguucguuuccacacgagcaagcaguaagauguggagugaugggugaggugaaucuaacucauuuggggccgacgauacuacucccagcguagaucagcagaugauuggaacagauucuggagauauauaucgggcucccuugccauuuaccaugaagugaugugugugcacguggcacauuaucugcaauuuuacucagugaaauaaaacucuuagcauagugccuuguauaugauaagcacucgguaaaggugagcugcuaugaauauugccauuauuacaacuacuuaggagcaaaagcaauacauccugccguguaccuucgguaaaggugagcugcuaugaauauugccauuauuacaacuacuuaggagcaaaagcaauacauccugccguguaccuucgguaaaggugagcugcuaugaauauugccauuauuacaacuacuuaggagcaaaagcaauacauccugccguguaccuucgguaaaggugagcugcuaugaauauugccauuauuacaacuacuuaggagcaaaagcaauacauccugccguguaccuucgguaaaggugagcugcuaugaauauugccauuauuacaacuacuuaggagcaaaaacaauacauccugccguguaccuucgguaaaggugagcugcuaugaauauugccauuauuacaacuacuuaggagcaaaagcaauacauccugccguguaccuuguaaaaugcccuguugggcauuggcagaaguuugagcguugcuaugucuuaggcugauuuagggaagauuuuccugucgugagccauggcccuggcgugugaugggucagcuaguuaguccugggccuuuauuaacaggguuuaggauuuauacuuacgugagaacuuagucugaauuuuuugucugcuaaguugaaagugcuuugaaggguuuuagcccuggaguggaguugggaggcucaggccugcagucccagcacagaaucuguaacaccaaugccagccugggcagcgagagacuuccuuucucuuggguaugaaucacaccaggcgucaggagaaauaauugugaguuccagaucugcagcaucaugacuaaugcaaauaacaagcugccauguguuaagggcuuauuauguucuggguaauaaauccuugacacggauuaucccguucacuguguggccuugagcggaugacuuugccuuucuguuucuguuucuucaucucuaaaauggagaagacaacacuuaacagggagguugagaagagcuaaugaaauaacauaugcgagagucuuagaaaaaagcacaaggggauauaugcaugccuuauuuuuaccaaugaggaagaugguaaucuucaggccuuugaagagucugcauugcacagaggagggauguuggcaaagcuccggcugauggugaauuugauagcccagcuuugugagggcagaauaugaggcccacgguggugcuuuaucugucaccugagauuggggugucugucuccuggcacaaaugugacaccuguuguagcagaaacaggcccuggcagcuggugcucugggagaagaggucuggcuaggagcaggaggaguucgcuuaccagaggguaagcgacaaaugucaguaguuaaaucagcacauuuuucagcuccacauucccccaggggggcuaagcaaugccugguuauucacuggcaggauuaacacagaggcaaggauacaggaagaggaaauaucccaaugcacagcacagcgccugacaccugagacgcacuuggugaauauuuaugggggaugcgggaggguggggggcaaagagcaacacugugaaacaaagaggggguguuaccuauugccauacugccacugcuggcccacugcuggcccacugcuuacuacucuggucaauaacauggagaaggcugagcacgguggcucacaucuguaaucccagcacuuugggaggcugaagugggagaaucacuugaucccaggaguucaagaccaaccuggacaacauagaaagaccccaucucuaaaauuuuuuuuuuuaauuaaccaacuaugguggcaugcaccuguaguccuagcuacucaggaggcuaaggugggaggauuucuugagcuuaggaggucaaggcuucaguaagcuaugauuguaccacugcauuccagccugggggauccugucucuuaaaaaaagaaaaauaagaaaagaagcauagagggaaaagagucagagagauacugaguauuuuuuaaaggaguugaaacucauaucuuccgacucccaaauccaaaaccucaaacuuggaaauuuuuaggaagaaaacauuuauuggguacuaagaccccacgcuaggucuggcccacauaauuuaaucuucacagcagucccuguggggcagguguuuuuauuuccaccauucagaugaagaaaccagggccaaagaaguuaaauuguucaagcagucacaguuuauaauugguagauauacaauuagaucuuuauuuuuuauuauuuuucuuuaaaaaaaaaagggagggucuuguuauguugcccauauguugcuagucucaaacuccugggcucaagugauccugcugccuuggccucccaaaguccugggauuccaggcaugagccaccacgccaggccacaauuagaucuuucugacucagaaggcuugcuugucuuccuacucuaucaugaggacugcaaaggaauuuuccuacuccuuaaauccaugaggguugggcuguugacuagcccaaguuuuagguaucucacagccaccuagacucaccuguuacccaggggcaagaccugacuggguuuaacuucacugaauuuccuaccuguaauccacucaccucccuaaauggauuugucuuuugucacugagagagcugccucuuaccuucuguuaaagagaaauagaacugcacacuaguuacaggucgugaagauggauuuuaucaaguacugcugcaacaugggagagaggcuucaggacaggacugagcucaacucugaauacagcagcaaugacugcugauuuauagccagccagcagaguuaaggggucagugguuggaaaacgacugagacaucaagaauggagggauucuugcugaacuggccuaaugggacucuugcuaaaggcaagggugggagaugagaagcuuggucagauguuagggggcgggggguucuacuaaacugaccuagaagaauucuugcugaaaacuggacuagguaggcccaggacagggcccaaggaugaggucuuguaaaaaagagugcucagaggagcaucuaagguuuggucaaggagagaguccuugucacuucccagcagaugccaggacaagggcagcugaagacccacaaugcuaguucauugugaggguuagucaucuccccuuggugugacucccaacagucaaggacuuuggcugagcugaagaccgucuucgagaaggaaugugcaccugagacgcacuguaacucccacugauggggcaggcagcauuucguggguauuuccccacaagcuucucuugaguaagaaguuuuuagucauaagaaugaagaugacccagucauucagaugcaggagcaaggcagggcccauccuccuccuccccacaguguaacucaugugucacccaggcacgccugaacccacaacugcuagccagcagauccucagggcugggaagggaugagcucuugcuuuagaucauguguuuggguugggauuagcagaugaacaagcaguuuuccccugagcucauccagaaauggaggguauagucugggagcauucuuucucuuucucccucacuccucauauuuucacaucacuucaguggccccagcauccugcuuccccagaacacaccccugcccugaacucgccagaccucuuccugccagcugggccagccuggaaacaggagagaccuugauggcagagggauaaagcugcagaagucccugcaaccauaacacgaguggagggugaacaucugcagaaacccagagacagauccccugcugaggccucugcgccggcacuccucaaagucuaugccagaaagugacuacaggagaaaugugggcagaaugagaaaaccugggccugugagacaggggagcucucuguucugauccugccugcggaacaaccagcucugugacuucagacucggagcgcucuuucccuaucugugaaauggggucauggagcuggccucucaggagguucuuagaagguucagaugaaaucacgccugugggacacucaguaagccgaaagggcccacacaaagcauaaucauguaagaaaagcacucucaccccacaccugcauuucagcgugcagccccugaucccaccccuccccaggccuguuacagaaacacucgugcauagcguggguggccaccuucggugaagcccauauucguggguggugcucuguguucugugucugcguggcugucugugucucugcuggugcucacguagggguuccucugugacacuucugccuacugucgacucuuggcucccaggggucggggacugucaggcuaauuccgucuaagcagugcccagcgcagcauccuggggacaucguggugaagcuguugagggaaaggggagcucaguggaaauccguggcacacugggguccuagucuuagccuugccacuacuugcuaagugagccuugaucagccauuugaccagugugggucccauuuuccucacuugaagggaggaugaggugaucucaaaagccucuuucgcuuccaguggucuacgguucugguuugugacuaacagugguuugguuccacuuauccaaagcccagcaaucuccucugagaugggagucccagcccucgggagugucagcaguggccggccgccggacugauucuccccggcccucacccuggugcagccccuugccuccugacuugugaaugcgcgugcaccccccaguuuccuguucccucccucccucucgccaugguuuggcuuuuugccuucccaggugcguguaagccaaccugguccagagccuucaggguacagacagcgucagccacacgcagccucccggugacuccaguaauagcagggccucugaucuuguaucuccagugguuuauaccuuuguuugacagacaucacaucccaggcccacucuuuccugccucucucagcuccggcucuauccagcaacccagugaucagugguaggggguccccacccauuaguaagccucugcuguuccccgggcucagggcacagaaacugagcaggaagggaagaguguaccgccugucacgaccaucucuccacggcagcucucgggauaaauuggccuccagaggcagccgggggagaacgagcugguagugggaggcccgugguccaggcucaccuggacuggcuccuucucugguuucuggaaggcggugacugcugaugggauguaagcucaucuccucucucugcccugugggccuuggccagucugcagcuaucuccugcccccagcccagcccucuucccacccacccucugaagagaggugagaagggaagacgguucccuccauuaaccucccaaaucuuuuagguguaugagguuuccagguuacgcugaccugagggcuccucucuuccccuuccacaggguacggcagcuggagagaacuggccaaggcucuggccagcaggaacauuccagcuguggauccacaccuccaguucuaccauccccagaggcugagccucgagguaggugaccagccaguccauugucccugcugaugccuuaacaaagguccgcaggugcucugcccaguugccuuaaggguaaccucugcuacucugggaggagaggcagaggauaaacagcccccagaguccuagucuggccucaggaccuccuagcugagccuuagagauguccauccagccuccucaaagccaguaaaaggaaacuuuuacuggggcugccacugggccugguuuucuggugucugcccucguucccuaguucaguuugcccgugccggaaccacuccgggccugcgaccuccaucaccaguggcauguggugccucucacuagggugagggcugggcugugcugugcuugcugcugagaucagaggugacgagguggauggacaccccucccugcccguagcugggaguacagacuugugguggagcauuugccugcagugcuucuugaaccaauggucccuaaggaggcagauuagagaaacuggggucuaauucauucaggagccccaaggcugagccuagaacagacauggauuccagagcuggaccagagccaaacugaaccuguggaccugcacaauagggaggguuugguggugucccugaggggcucccacuuguuggaacccaaaucuauacagcugggggauaaggaggaagagggagccgaggucccugcccucaagagguccugaccuaaagaggguaaacugcuuucccauauggggaggacagaaaauucagaaaagugaaggaacccgaggagcaggcgcugaugaaacuauggagauguauucccaggacauggugugaaugacagacggcagcgugcuccgagccgacgccuccugggagcaggcacugugccuccuguccugcccguagcuucucauccuaauauuccuaccaacuucguucuucauucuuccccuaggaccacgacauugaccaaggggugagcaguaacagcagcuacuugaaguggaacaagccuguccccuggcucucagaggugagggacuuucuauuguaccugcccuuugagagagcuaaaaaauaauguuuacagauaauuccagagaucacagaaaacuuucuacuagggaccuucuaccguaccuacucuuugagagagcuaaaaaauaauguuuauggauaauuccagagaucacagaaaacuuucuacuagugaauuaaaaaaauuuuuaaauuauuuauucaguuaguuuuuuguuguuguuguuuuuagagaaggggucucacuaugucggccaggcuagucucaaacuucugggcucaagcgauccuccagcuucagccuccugacuagcugggauuacaggugggcauuacuacaccuaguuuagugauuucaugaaaauuuuucacuccacgcguuccagguugauucaauuucucucuuuagagaaggaacaaucacauuugccaaaggccuacuguguggcaggcuuuguggaucaugucaucucagcuuugcgacccuguggaauaguaucauuauccucauuuuauagguggaaaaacaaggcucaggaaagcuacaagacuuucauggccaugccaauccccagucuuaaagauaagcaucccaaacugucuuucuugggccacuaucuuaaaucccauaagauauuccaggaagaaaagaguccauuguuaaauaagcuuuuaaaacuauaauauacuaccuugccuuccuggaaauguacauuagcauaugaaagaguaugagaaguucugcagccaucuguuuaacuugguuuagcucagcaugucucaaacugaauugcuuuuuuccaugaaaugccuauuauacucuaugaaacuagugcucgaggauccauagaaaugcuguaacgaacaugcacugggaaacucugcuuuagaaaacuuacaggaagcaguuaaaugaauaaaaguuaucagaaccaucauaauaucuuucauuuuuacaggcuuugauagauugugugucaucuuuugguuuuuuauuuuuuagagacagggucuugcuuuguuucccaggcuggaguacagugacacaaucauaguucacuguaucuuuaacuucugaguagcuaggacuacagggauguaccaccguugccuggcuaauuuuuaaaauuaauuuuuauagagacagggucucacuauauugcccaggcugaccucaaacuccuggccucaagcgauccuccugccuuggccucccaaagugcugagauuacaggcaugaaccaccauacuuggccccagauucuuuuucuuuuggugaagaaacugaggcucaaggaaguuaauuaacauacacaagauuaccuugaguaaauaaaucguuaugucaagauuuccgaguagcacggugcuuuggggaugaaaauuuuaaauuugaguuuccuauuuuacaacuuguuuagaacccagcgucuuuagucucgaggcccugcggacacagauuacuuuucuuggcugggugguacgggcuagcucauugucuucauccauaccuaucauagguggagcucuucagccugggugguuuuauuuggaauccacccacuugcucuggggcaggagugaaggaggcaguauuguacugaaugugacguuaguuauccacacugugaaacuaccuccuuuuaaagcccugggagaggauggauuacaaugcuggcacaccugcacuagaugacaucaccagguaauuaugccccgcccuaccuggagauaguacuuugaaaagaacuugcuuuacagaucauuuggucuggugauccagccuucucuccuuuaaggauagcauggaaccuuuuucuuaauaaaccaauuauuuugaaagcuuauagcgccauaacauucuacauuuauuaauaauuaauuuauccacuuguuuuugccaaucaaggccauauguauaaacauauaaugaaacaaaaacagugaacaaauaguaaacagugaucaaaauugggcugggcuugguggcucaagccuggaauccuagaacuuugggaagccgaggugggaggauugcuugagcccaggaguuccagaccagccugggcaacauggugagaccuugucucuacaaauaauaaaaaaaaaauagcuagccguggugaugcacgccuguggucccagcuacuuggggggcugaggcgggaggauugcuugaguguaggcaguuaaggcuucagugagccgagauugugccacugcacuccagccugagugacagaguugagaaccccaucucaaaaaaaaaaaaaaaaaaaaagaaauauuggcuauuuuaguaaguguguauggccuuuuggugguaaaugacugauuuccauuuuuaaauacuaaaaauagcuuacaaaauauucauuacagucuucauggauguucagggguucacugauccaauccucuuauuuuaucaaugaggagaauaaggaaggaagguccuggagaggccaaaccacacgcagucacacagcugcauuauggugccagcuggcauccagcccagccuugcagucucgccacauucuggggacuucuguucccauccccuugccuguccuuggccagcaggaaguucccagguuaauaauacacaucguuuauugagcaucuacuacuguccgggagcugucagguuguucuguuaucccucuuccagauaauggcucagagaggucagcucagggucacagaguuagugcagggcccugcuaaaggugagcaagggcaggagaugagaaagaugacgauggccuccucuuucacuguuucccugccccgagcuuuggcuggcagcccagggucucugaggccagaagucacuccggagacucagcagccucagacguuuuacuuggugcaccagaggcugacugaucagauuggauggcuaggggccugggcuucauggagugacuguuucaaaacuuguucacaccaacacugaucacaagacgcucauuaacaaaccccagugccaaucuguucauguguugguaaauacacugcuccauucaccaaaaugcuaugucugccagccaggccacuccccaaacccaagauaguuacaagaaagaaauuuggugaguacaaagucagaucaaagcaagugagaucagaguucucguggguuguucacacaggcuuugagaaggcagugucucucuuuuguggacagagcugugacacagacuccuuccuguucucagccuuuccuuuaaaaaaaaaaaaaaaaagaaagaaacagcuuuauugaacuguaauucacauaccauacacuucacccauacacuucguuuaaaguguacaauucaaggcugggugugguggcucacaccuguaaugcuagcacuuugggaggccaagaugagaggaucgcuugaggccagaaguuugagaccacccuggacagcauagggagaccccauuuccacuaaauagaaaaaugagccagcuguagugccguguaccuguaguuacagcuacuugggcagcuaaggaaaaaggauugcuugaggccaggaguuugaggcugcagagaaccaugauugugccacugcacuccagccugggcagcggagugagacccugaccuuaaaaauaaaauaaaauaaaauagaucgaguaccucgaaacucugaacaggacauaggaguuccugguguguaggaaccggugaccugaucacccugcuguguuccuccgggggaggccccacugccgcaugaguuagaacugaaccacuagccagguacccuuggucuugcgaguuugacucugguugaguagcagaggguauagcggaagcagagggccagucagcacucauguccugcgaugggcuuccgagugcuccuggaggaggcugacggugccugccuucgugcgccucugaaccucguaccucugccagagccccuggcgcaggugacacccuuuuguuuacaugucugccuccuuugaggaccaaccucucuuucaucuuuaagggguacagugcagacacucagugcuaauagaauggaggaagauacuguucugggcuuagcuccuccaagcguuuguucauuuaaauaauuaggaugugcagggaacacaggggagggagcuguucccucugccuggggacgucauagaaggccucggagagaacuauuugagaagagcuuugaaggaugagcaggaguuugccacguaaggaagaaaugaaugggccuucuaaucaggaaauugcauuuguaaaagcauggagaagggaaacagcaugacgauuuuggcaaagacaggguuuugauguggguggagcaaagguguauggcagggaguggugugaggugaggcuggaaaagguaggucagacuccgugugcugggugaggcucuguucugaagccuucugggaagcuucagagguuuuuuuucuucuuuuuuucuuuucuuuuuuuuugagacggagucucgcucugucgcccaggauggagugcaguggucggaucucggcucacugcaaccuccgccuuccggguucacaccauucuccugccucagccucccgagcagcugggacuacaggcacccaccaccgcgcccagcuaauuuuuuguauuuuuaguagagaugggguuucaccauguuagccaggauggucucgaucuccugaccucgugauccgcccgccucagccucccaaagugcugggauuacaggcgugagccaccgugcccggcagcuucggagguuuuaagcagcagagugacuuggucagauccgagcuuuagaacgagaguucuggaagcggugaggacuccgugugggggagaagcugagauccaguuggaggcucugcugcggcccagugagggcccggcagggccgguggauauuccugugugacccacaccccugcacgaugcccuccccucucccaaggguuacuugcuguguguccuuggggagucaguuuaccucucugagcuucaauguccucacccuuaaaaugagaggguuccaacagauaucuucuccagcacuucugacuuuggaaguuucaaaaccaccauuggccauagacaugcucuggugcuuggagugaccagugccccucccugggccuuagucacugcuggacaauggagcgagugggcagagggcagggcuggugugcuggagucccacgucccugccagauacaaagucuccaagacucagagggacacaaauccuugggggacggggugguucucaucccaggcccagggaggaagagggugccuucuggccccucagagacccccaccuacagccugagaguggggugaagcaugguuugagggcuagccuagugcugcacaagggccugggcuuagccagguagcuccucuucccacacugccagccucucugccuggggcugccugcaucaucugaugaucccuuugcucaggcaagaaaggcccugagggugaggcaggaguggccagccagugccucccucggcccuccucucccugcccaguccccccccucacccccccccacccccccccaccccccggccucuggccuccaggcugaacacaacaggcuucucugguggcaugcccucccccacugcccucccuccugggaucuguaucuccuagggagggggcagaaagaagccuuuggaggagacagcugagucuuauaaacugaacuugaggauuuucccccaaaguagcacaauguccccauucuuuccuuccuugaagccuuaacccgccacccaccuacccagccuacuuucccucucccauccguuccagucucccacuucuguuucugugaguaacggcugcuucccaaggcccacauuccuggcauugaccaggccagugugccccauuagcgccacacucugcugcagggcagggagagacagguucuccugcgucuuucuggauccagcauugaggcaguguuccccagaggcugcgcccaccccaccagccacaccugggaccucgggcacuccuguugaggaguuauucccugcccccuccucucccugccugcccauccucccuccuacagaucucuuguagaacuugugccacuucuucuuaucuggguguccccucagagcuccuaagggcagcccagauuuugcuaucucgugggcauggcggggaggccagggcaggcugcugguagggagucaccaggccccaccucccacaaccuggacagaagcccugggggaggggaggacauggggugauccgaggcccacugucaggaugauuggcacaaaguccccacacuuccccucuccucucaaauuuccagcccugccacccacucagagugcuggcuccugccuucccccuuucuggggaagggagcccucugcucagggccuccaagcccaguccugcagaggagaaagggguuccaacccaacuggcacugccccgaggcugucccaggagcagcuugcucagaaugagucuaggaggccucagagagcugugggagaccaagaugcugggaagcccagaugggccccagcucacuccugcagugccucccagcugcuucccaaggggagccagaagcauggagaccacuggguagauaagguuucaccggcagacagcuguggcgcuuuccucuccucaggaucagggauggggaggggaggagagcaagucuuuccugaaaccccagccggcuccuccuaguucccuguccucucagcuauucugucacaaccauuguccccguugccuggggaaugaacaccagcccccuuccugcaugggagguccagggagaguaugugugugugugugcauggccagagcagaccuuguccccaaggccaggccauggggugaacaucagcaccagguuccugaaagaagugcugggugcugggcugggaaugggauagagugggccggacccgcacagugagaggagcaccggccccuuucugcccagccucccggagcugaggagcugggaugggcaugggguggucacgcucccggagcugaggagcuggggcaggcauggggugcucauccuccuggagcugaggagcuggggcgggcauggggugcucaucuucccggagcugaggagcuggggcgggcauggggugcucaucuuccuggagcugaggagcugggacgggcauggggugcucauccuccuggaacugaggagcugggacgggcauggggugcucauccuccuggaacugaggagcugggaugggcauggggugcucauccuccuggagcugaggagcuggggcgggcauggggugcucaucuucccggagcugaggagcuggggcgggcauggggugcucaucuuccuggagcugaggagcugggacgggcauggggugcucauccuccuggaacugaggagcugggaugggcauggggugcucauccucccagagcugaggagcuggggcaggcauggggugcucaucuucccggagcugaggagcugggaugggcauggggugcucaucuucccggagcugaggagcuggggcgggcauggggugcucaucuuccuggagcugaggagcugggacgggcauggggugcucauccuccuggagcugaggaucuggggcgggugugggaugcucauccuccuggagcugaggagcuggggcgggcauggggugcucaucuucccggagcugaggagcuggggcgggcauggggugcucaucuucccagagcugaggagcuggggcgggcauggggugcucaucuuccuggagcugaggagcugggacgggcauggggugcucauccuccuggagcugaggaucuggggcgggugugggaugcucauccuccuggagcugaggcucuggggagggcauggggugcucauccuccuggagcugagggucuggggcgggcaugggaugcucaucccccuggagcugaggaucuggggcgggcauggggugcucacgcucacucaccacuggcgucuccgcccugcaguuccggggccgugccaaccugcauguguuugaagacugguguggcagcucuauccagcagcucaggaggaaccugcauuucccacuguacccccaugugagugccugagggcugccuugcccaccucccuccacaccugccuccucugcccacuucugucucucaucuuuccuuacaucuuuucugguccauauuuucuccuuuaucucuugagcucucuuuuugucugcccauaauaguucccuuguuuccuuccuagggauccuuucaauuucauccccugcaucauuucaguuucaggcucucuggcucacaauauaguguacccagggccaccauguacaguugugcugguugugcacuguacaaggucuccuggacaaagaggcaaaugggaacugaaauugagccugcacuccacucacaaagccacagcccuggucccuccugucauaguccccuccuggucuucccgccaauccuggcgggaaguuuccuuuucccucuucuggguaacuguuuccuuccccuuucuuggcauagauucgcacaacccugaggaagcuugcugugucccccaaauggaccaacuauggccuccgcaucuuuggcuaccugcaccccuuuacugauggugaggccagccccaaaaccccauccuucuuccugcucuagaguucugcaucggacccaaagaacauaagauaagguuauagguagacuggacuaacuuccuguuaguccacccucaggaagagaggggaaauugagucauauugcggucuuguccaacucccacaggcugcugcuuugcucccugguuugcagccuggaaccagcucaucucuccauauaagucuucuccaucuucacacugucucccaggauguagaaacccccacuuuacagagagggaagccacagcaucaagcacugaagggaauuuaaucgcuaagacacucacaaaagccuccagcuuuuaugcugaugcccuccuugcccucaucuggaaacucuccccgcugcccagggaaaauccaguuugccauugcugcagaugacaacgcggaguucuggcugagccucgaugaccaggucucaggccuccagcugcuggccagugugggcaagguaaggccagcucaaccccggucccucccaucugcuccuggagccuguucauugaguccuccagcagcugcucauuacuguuagcaucucuggugugacagcggggaagaagggguggaaaagaagucuccucccucaccccuaccccucuacaaagggauaaacugaggauggggaggagugaggaguggggaggagcgagguguggggaggagcgagguguggggaggagugaggaauggggaggagcgagguguggggaggagcgaggaguggggaggagugaggaguggggaggugagaggaguggggagguaagaggaauggggaggagcgaggaguggggaggagcgaggaguggggaggugaggaguggggaggagcgaggaguggggaggugagaggaguggggaggugcgaggaguggggaggugaggaguggggaggugcgaggaguggggaggugagaggaguggggaggugcgaggaguggggaggugagaggaguggggagaugagaggaguggggaggugagaggaguggggaagagugaggaauggggaggagugaggaguagggaggagugaagaguggggaggaguugggaguuaggguggggaguugugggaaaguggggagugagaaggagggaaaagcgggaaggagucgggaagagggaagaggaggggggaaugagaaagagggagcagugagaagugggcagggggugugagaggagggaggggggugugggaggaggggaguggggagguggggagaggaguaaggaguggggaggugggaggaguggggcagagagugcggacagggaggaguggggagcgagucugaggcuggggaaggaccacagcgauucggcuugggacacccagcgcagcaucucuggggcccucuggccuuggccgggugcugacucgcgcugcaggucauccggcugcuccgggcuccuggcaaggcgggcugccuccugcgugggcaacgcucacuccuucacucccuucuguuuucucuccuaccucucucaccuucauuccgcccgucuuccucccuuuuucucucacuucuugguucuccuuccuggucucgcacucaccgccucgcgugcuuccuguuuucucuguuccucccuccucuucucucuuccacaccucuagacuggaaaggaguggaccgccccgggagaguuugggaaauuucggagccaaauuuccaagccggugaggugagugagggucaggacaggcgcugugggcgccucggugccucgguggagcccggcugcgccccuguccgccagcccagcugccgacuccagagcuuccguguguccggcacccacacgcucccggcaaccgggucuuuggcucagaagccgcgagcccauccguccucguuucacagauggggaaacugaggcccagaaggccgugacuuauugcaggucacgcagcucuuuagugacacgcgggacuggaaaauaggucuccuuccucccaguccuugcccucccccguuucuccacacccacaacagccuggaccccggaccgaggucccccucggucgucuggggacacgagucccuuucccuugcggggagggagcguagcgcggccucagagcgcccccugguggcccacgcgcgcucacgcaggcgggaagagcgggcguugcugggcguugcuggacguugcuggaaacgcugggaaggacgggcgugggggugaggagagguggggugcagacacagcuagauggaaggaauacguucugaugcucgacagcacaguagggugacuguaguaacaacaauggauuguguauuuucaaacaacuagagaaaaagauuuggaauauucccaaaacauagaaugccaagugcuccaggugggugaagggauccuaaauccccuagcuugauccucacucauccuacgcaugcaacagaaggccgugugcaccccauaaauaugcacaaggguuacguaucaauaaaaauaaauuuuaaaauuuuaaggagacaaucuugcuugcaaagagcacucgcgugccagcugccgugguggguacgccgugugcagcuccgcagagcagcuggugcguggucccuggggcaagucggccggcggaaucccaccuccaccccucaucacucuggcagacuacccaagccuucugugccucuguguucuccucuacgaacaaggauuacaugaggucacauauugaaagcauuuagaacagugucugccacagucucugagcucuaacggcuucuguuacuguucuuuggguucuuccgaucauccuguggaggagguacucugauuaugcccaucucaccaagagaaaacagcucacacuguuagcaagugauagagugggggcucgaaccuaggcaguuaacuccuggcauucuaagagcaaggagaagggaugagggaguguaaggugcuggaagggggugggacagagccgcgaccccagggcccauggagauggcgcucugcuucccugcccucucucccgccagccugucagccucccacagguacuacuucgaggugcugcacaagcagaaugaggagggcaccgaccacguggaaguugcagugaguuuccugcugcucccgccucucccagcucaguuccuggcacucaucuccccuugucccuugaccccuguuggaaauccagcuaccucccaccuucugcaucuacccucucucuccucuuccaguggcgacggaacgacccuggagccaaguucaccaucauugacucccucucccugucccucuucacaagugaguaggcucuggcccugcccuggagauggaggccagguggggacagccuacccugggggauuuggcaggggaggaggggaggaggggaggaaggaagcucgagaugcuugggacacggguaugaagggguccagaacaagagugggaccuuaugaccaggaguccuuaacuccccagggucagugaccccuuugagaaccugcuagaagcucucugagcccuugccucagaaaaaugcccuugucuacccacccacacacaacauuuugaauacaacuucaagggaguccagagacugugagcucacaccagaucuaaaaacucugaggcugggugcgguggcucauaccuguaaucccagcacuuugggaggccgagguaggaggauugcuugagcccaggaguucgagaccagcccaggccacauagcgacaccucaucucuacaaaaaauuaaaaaauuaacugggugugguggcgcaugccuguagucacagcuacugggaaggaucgcuugagcccaggaguucgaagcugaagcuacagugagcuguaauugggucacugugcuccagccugggcaacagagcaagacgcugccucaaaagcaaaacaaaacaacacaaaaaaacccucugagcgaguccaauccccuauuuuccagaugagguaaccacgguucuugcaaagccauggccagggcagaggaaaccuguucaccugccuucagugcacaggaagcgaccucuuucuucaauggcauuuuccauuucauaucauuuccucagugagacucccauccucaggccccguugaaaaacaugccauccauaggccuccguggcagguguagacagaugcaugaacccgggagacagagagcaaagaagcagccagccccccaccccccuucucuguggcugcuuuaaccuggaugcugaaacuagaucaccuggcuucaaacucagcuuggccacccgucuguuguaugauguugggcaaaugacuuagauucucuaugccaaaguuccuuaucuguaaacugggaaugaucguaguacagaaggcauguggugcuuuuggagauuagaaggguucauauuugggauauucuuagagcagggccuggcuuauuauuaagugcucuguaagcguucaauaaauuaggcguacuuaaugccacauuucuagcaguccgcaguaacacauuuugagaaagaggugucuuuuuccgaguacgcaacacagucgugugggucagccguggggcuggcagagggggccgaaggcagaugaaucgugaagccaccgcuguggcgggggccagagggaguguggcugcgcacauccuacaccgucgccgcuggagucaggagccccuucugcgucucuucccuccccuucaagggcagugggcugcugcgcuccaggccacacagccuccugcuuucuuuccucccugcgcccagaugagacguuccuacagauggaugaggugggccacaucccacagacagcagccagccacguggacuccuccaacgcucuucccagggaugagcagccgcccgcugacaugcuucggccugacccccgggacacccucuaucgagguaaggccucggccagcgcuuggcguccuuucuggggacacugcacugccagguccacugcugaugguggagaaggcuugagagaccugccaaguaucccaaucaccguagaacuuuuuaucguccuuguaacauagaacaugcauacagaaaagagagcauguaaauaaguauaaaauauuuacguguaauuuuacaauucugcauaucauuacagagugaacguuuguggaaccaccacccacaacaagaaauagaguuagaacccggaagucccccacacaucccuucccaaucucacacguccccgccucuuacugcauuccaacucuugucauccaaggagagaaauacguggacaccacaguguuagagucuuaaugcaugauuccucuugggaguguuuacauuuuaaaagacggccaagauggccaggcaugguggcucauuccugucauccuggcacuuugggaugcugaggugggaggaucgcuugagcccaggagguugaggcugcagugagcugugauugaaccacugcacuccagccugggugacagagugagauccugucaaaaaaaacaaacaaacaaaaaaaacaacaaaguuucuuuacuccucaccccucucaaaaaaaugacaacugacgcuaaggggauguucagcccaugguaggaaauccaguuaucgguacuguacgagggaggggaccuucuggccucuuagaaguuucuagaccuuauugaggcuaucccugcacagugacucuaagaucaaacggugccuuguaccuggggcugugugcugaguccucugcugccagggugcuccucaaauggcccugcuccaggugcguggggcagccuccagcuggcagccucagccacagacgucggcagaacacagcugccgcuugcgaauacagaaagggcccugcucagggcagaggacuucagccccaguuucgugcucacccucacccucacuccuccuccuccacuguccucagugccucugauccccaagucgcaucuccgccacguccugccugacugucccuacaaacccagcuaucugguggaugggcuuccucugcagcgcuaccagggacuccgguuuguaagucuugggccugggucauggagagcagggcuggcagagggauugcugccugugacugggaugggagguggugaggcugacuuucccaucuucccaacaucccaucccagcagacaggacguccucacaggucccugggcugggaagaacuugcacucccagauggaccgcccugaauagacuguccagcagagccugcacgugggugcucugccucagggccccccaacacacaccaacucagcccagccccgugaugauaucagguggccuggcugaggcuucuuaagcucccugcuccaagggccacacaacccuacccugccuggucagucccgccagcuagugagccagcaggacuuacuaaacccagagaccaggcacugggggaaaaagagcuauggaggggaaguuagcuuuaaagaacccagaacccaugcggaagccagacaggcagcguggccacucuccugugcauccagaucuagagaugauuauaaggaagagcuggagggcagaagaaagaggucaggaggcaucaccaggucagagaauggcugggguguaauugagaaguucuuuggugguggugaccacgagcuauguuuaagggggcaaaggaagcagugaaguaaauaggaagagggguuguucuagggcugugggagguugcagguaaagguucagagguuucaggagaggaucagguggcagagggaggaaggagugguuuuggcugaagcugagggacgggagcugguucaggaggggagauguggaccaggggcuugacucaggguugcauuugguccauagggccugggaucacuagcauaacaaggggaaugagagccccaucugcaucaccacguuucauucggcgcucagagcaacccuucucucccugccaagggcgggucccuagcagcccuaugugaucccagccaggggcaggcuuaacccuggcuggcugauuucuuaccaagaucucacucucuuacuccugcugcugauuuuuccacuuccagguucaucugucuuuuguuuaccccaaugacuauacccgccugagccacauggagacccacaauaaauguuucuaccaggaaaacgccuacuaccaagaccggugagagacacugaguggggcaggaaggugaccuugcagagggcucugcgggagccaggagagcugccuggaccagggugaugguggcaccccagcccaaagucuuugcucuugcucuuccugaguacuacacacacacacacacacacacacacacacacacacacacacacccgcucaccagccuccuuccuccacucuagucuggggcaaaacgucagacuccugcugagacuuccagcagagccagggcugagcccgccaugcaccgggugccaaugcacaccucccuuccuccugcagguucagcuuucaggaguacaucaagauugaccagccugagaagcaggggcuggagcagccagguacagagugacagcugaggcuuccaggucaggcugagaggggcgaccauggucuguuuccaggggauguucagaccgugccagccccgccccugaggagcucaagauccaaaucacgugaccucucccuucacacccaagggaguggagagcaugacuccugccuuuuccauauccaggcacauguggaaaaugacacuauuuuuagcagcaugcuggggucagcuggaggagagugagagcccgggggagguuacuuggacugcuggaggggcuugcugucccuggcgcaccauuugggagguucugguuuagagaagcacugucuucuggggccuuucuugggggauuagggcguggcugggaccaucugcugggucccucaggugcuaugcaccugccgggcaugugaugccguuuaucucacucagucuucacaaacccaugagagaugcaguauuauucccuuuaugcagaugaagaaacugggguuaauugagguugaguaccuugcccagggucacacaguaagcgauagaaccuggauucaaccccagucuggagccccauggugcgucacacguaugaucauccucugucuuguaugucuuguuuggaaaggguuggaaacucuugacaugaggaaugguuguuauuaauagcagguuuugaggaaaaccuucuagaagagucccaguauggggaaguggcagaggagaccccugccuccaacaaccagaaugccaggaugcuugagggaagacagacaccugccuccacccuggagcaagaugccacugacuaccgccuccgaagccugcggaaacuccuggcucagccccgggagggccugcuggcccccuucuccaagcggaacuccacagcguccuucccagggaggaccagccacauuccagugcagcagccagagaagaggaagcaaaaacccagcccugagcccagccaagauucaccucauuccgacaaguggccuccugggcacccugugaagaaccugccucagaugagggggcccaggcccaggcccgcuggugacagccccaggaagacucaguggcugaaccagguggagucguacaucgcagagcagagacggggugacaggaugcggccucaggccccuggaaggggcuggcauggggaggaggaagugguggcggccgcaggccaggaaggacaaguggagggagaggaagagggggaagaagaggaggaggaagaggauaugagugagguguucgaguacguaccuguguuugacccgguaguaaacugggaccagaccuucagugcccggaaucucgacuuccaagcccugaggacugacuggaucgaucugagcuguaacacaucuggcaaccugcugcuuccagagcaggaagcucuggaggucacgcgagucuucuugaagaagcucaaccagaggagccggggguaagguaaagggcucuccuggggccagggacuggggcacguggcagccagcuggccuggaaggcaggggccuaagggcugguaguggguucccccagccgcggaaauagcuggaacuuugcccccgacucaggcuccugggaaggacaagugcccggggccccugucccuggagaggaucuugaccaggcagguguuugucccgccauuaggcaagguucugaaaucccugggugccuggcccaguacguguguugaggacuggaaggacucaguagaugagguccccuccuccgaggaaagagcuaguaaauagacaaacaggcaaaacagaggcuagaaaaauacaaauuaagacccugcaugugggcuggaaggguuagggcgugaugcaugacuggaguucuuuguguuuucauucauccauucauucaaccagucaacauuuuuuacgauaaaauuuauauaacauuaaaaucaccauuuuaagguguaccuuucagugguuuuaaaaguauauuuacaggcugggcgcgguggcucacgccuguaaucccagcacuuugggaggccgaggcgggcggaucacgaggucaggagaucgagaccauccuggcuaacacggugaaaccccgucucuacuaaaaauacaaaaaauuagccaggcauaguggcgggcgccuguagucccagcuacucgggaggcugaggcaggagaauggcgugaacccgggaggcggagcuugcagugagcugagauugcgccacugcacuccagccugggcgacagagcaagacuccgucucaaaaaaaaaaaaaaaaaaaaaaaaaaaaguauauuuacaguguugugcaagcaucaccauugucaaauuccagaacguuuucaucaucuuugaaacaaauuauacuggccagacgcaguggcucacgccucuaaucccaacacuuugggagaccgggguagguggaucacuugaggucaggaguuugagaccagcuugaccaacacagugaaaccccaucucuaauaaaaauacaaaaauuagcagggcuugauggcaugcaccuguauccccagcuacuugggaggcugaagcaggagaaucacuugaacccgggagguggagguuguagugagcagaggucgcaccauugcacuccagccugggcgacagagugagacucugucucaaaaaaaaagaaaaagaaagaaaaaaaaaaagaaaccguauguguuagugguuacuucccauuccuccuccuacccccaguagugucuggcaauaacuacuuuccuuucuagcucuguggauuuuccuauuccggacaucuuaugcaaauggaaccauguaauguguggccuuuauaucgggcuuuuugcagaauauucacuuagcacaaguuucauucguguuguagaaucuauuaaacacuucauuccucgauauugcugaguaauauucuauuguguggauauaccacauuuuuccauucauccguugaaggacauguggguuguuucuacuuuuugacuauuacaaauaaaaugcugcaaugaacauucaugcacaagcuuuuaugugaacauacuuucaguugucuuggguauauaucuaggaguagaacuucugggucauaugguaacucuguuuagcauguugaggagcugccacucugcuuuuuaaaucaacugcaucauuucacauucccaucagcaggguaugaagauuccaauuuuucuacauccuuaucaacacuuguuacuuuucauuucauuguguuuuauuuauuuuuauuuuuauuuauuuuuuuuuuugagacggagucucgcucugucgcccaggcuggagugcaguggcgcgaucucgacucaugcaagcuccgccucccggguucacgccauucuccugccucagccuccugaguagcuggaacuacaggugcccaccaccacaccuggcuaauuuuuuauauuuuuaguagagacaggguuucaccauauuagccaggcuggucuugaucuccugaccuugugauccaccugccuuggccucccaaaaugcugggauuacaggugugagccacugcaccuggcauuguguuuuguuuuaaauagccauccuggugagugugaaaugguaucacacugugguuuugauuuuuauuucucuagugacuaaugauuuugagccaaccaauugacaucugucuuauaacucauuuugucuuauggaauguugauucgaccguuuuuauugagggucaguuucucagggaaccucuucagugugaccccucuuauucagcucauguacuuagaaucuuggagcuguaaaagaccuucaggaucaucacagcucaacagguacauuuucaaagagggaggcagcgaacccuagagagauugcgaaucuugccugaggcccuauagccagccaguggcaaagcuaggacaaaaaccagggucucccaacaacuagcuuugcaggcuucucacacaccgugcuacccucccaguguggaaaggaaccacucagccuccccacacuuucugccauaggagguaccagcuacagcgcauugugaacguggaaaagcgucaggaccagcuacgugggggucgcuaccuccuggagcuugaacuguuggaacaaggccagcgcguggugcggcucucggaguaugugucugcacgaggcuggcagggcaucgauccagcugguggggaggaggucgaggcccggaaccugcaaggccuggucugggacccacacaaccguaggagacagguccugaauacccgggcccaagagcccaagcugugcuggccucaggguuucuccuggagucaccgagccgugguccacuucgucgugccuggugagccucaagcugagccucggcauucucaggggcgggguccucacacugucaggagcacccacaucugcuugcacugauuugaucccauaagcacuucugagaaagaccaccuuauaguugaggaaacugaggcucacaaaaggaaagucacugguuuaagguuauguggcuaguaaauguugccgcuaaaaacaaacacugccucauaggccagugcucuuucuuucguacuagguuucaggauugggugugauaacugggguugcuaacacuggggaugaucauuggucuggggaaguaagacgggcagcguacuuaaugaagugaugagcaggguuuuauaugagaaggaggaacacacaacaggcagaaguguaacaacagagguaggaugauggggauaggacgacgauacuaagagggacagauaacaggguuucacuaguagagcguggcagggcuacugacaaugagccccagccaaggccuucucguggguccccugccugggaggagggaacguggggagcaggaugcagaggcccccuuaacuggugagcacucccucugccucaugucucugugcugcacugcuaaugguuuugcagaguugcacuguccccucagccgagguccgaugggcacuccugacucaccugggagcuggggguggaggcgcucauccgcucaucuuugccuugucuguguuuccuucuccugccugacccccugggguagugaagaaccaggcacgcuggguacagcaauucaucaaagacauggaaaaccuguuccaggucaccggugacccacacuucaacaucgucaucacugacuauagcagugaggacauggauguugagauggcacugaagagguccaagcugcggaggugagggggaccaccagccaggggguggcaugggccacguccauccuaaaguccuagggcugcuggguccaggguagagccaggaguccugcccagccuuccugauuccuagucuccaacuuuucccagagggcucaccugcccauaaucccaucccaggagcacacaucaucucucuucuaugccugccaacuuccuccaggggaccaccgcagcugaguccugauacgcagcccucucuccccuuccugcagcuaccaguacgugaagcuaaguggaaacuuugaacgcucagcuggacuucaggcuggcauagaccucgugaagguaaagggccuggauggggccugcgagauggaauucaaggcugguuaagagguagagagacauuugggguaaaugagguggugagccccucagggaggacgggaaugaggacacaggagguccucucugcugugcugcaggccagugcuagggugggaccagcaaaucacaguggagcauuugcccaguuguccaggguccuuggagccuauaaagaguggggaggagucagaauucacucugaugguuaagaccugugcuccaauguucagcacuguggaacucugcccagcagcugguuuugugggaguuugugaaucacuccaauagggaagacuccgaggcuucuccuagacggcgaccugaccuccuagcucuggucugcagggucugcugacccugcccacaucuguccccaggacccgcacagcaucaucuuccucugugaccuccacauccacuucccagcuggagucaucgaugccauucggaagcacuguguggagggaaagauggccuuugcccccauggugaugaggcugcauuguggggccaccccccaguggccugagggugagcccugcucagacuggggagggaggaaagacuucucugaucuuggcucuuaacuccagagcugggaacagucauaucuaugagcgucagcauccuccuccccugccccacccugcccuccuguggccuucacuccccggaaaacucaccagacaagguccccuugggcugagcugacagccacagcagcaggugcagcagugcacaccuccugcgccgucuucuccuugauucauucaucacacacuuacuaagcacugcugugugccagaugcucugcccuguggggauucaaagaugggaaagguagccucccugccuguggaaagggaaacggacauguaaacugacacacagcugugucuucuguggcugccgcuguccgauccauuuguaggguuguuaucagcccaugggcacagccugguagcacugcugagcccugaaccuuaguuaggggucuuuccuccaaaacaggcaaaguacuuguucagcuaagacaguuuucagccucccucaaccccagccucugacuuucagaagagccucuaggcacacagccuggaagccuccuuccuuccuccuccuggccucuggcucaucucacccgaagcuccugucuguccacaggcuacugggaggugaauggguucgggcugcuuggcaucuacaagucugaccuggacaggauugggggcaugaacaccaaggaguuccgagaccgcuggggcggggaagacugggagcugcuggacaggugacugggaagaggagggcauccacgaggccugggaauuccauggcgcuccaggcagggagccaggcuacagcagccuagcugucccccucggccgcagagucccaaagcacaguaaagagcacuggacucggaggacgcccucaaaucaccggccucgcugggacucaguuucucuauuagaggggugugacucgcccucugucugugucacaggguuggugugaaaauuaacaugccugguacaccguguaccagguacaccaagcuguguagacauaaaccaugauguucucagcaccaagcagggcaccgugggagagacugcauccuccccagcccgaggguagugcgccucccgucagcugccgagcggggagcccagaguugugggaauggauaaguagaccuggcaaaggucaggaaagacuuuggggccagcagaagagacaguguagaccacugaagggcaagaggacauccaggaggugccgggucaugagacaccaagggaccuggggguuuggagcaggaggaaagggucaaugagaugaaaagccucagagaagaacacaguacaagcugcugccuuggcagguggacaaggagagcaagauugggcagggacaccaggccauggguggugaggaggcggaggcuguuccgugugagguuccucuuucaagaaaugugcugccaagagaaggggcagagagaggauggugccuugagaucugagccuauggugagggagcaaaggagaggggaggguacccuucagaagggcauaagcgcuguaacagcguccacaggagguggacagggcaaggucaggagcacugggggcgggaccucgacacgaagacacgcucacuucuucccgagaggcaggacaaaaugcauccaccagucacugggucccuauacauggccggccauccacauccguuaccucguuuauuucuccccagaccucagugaggucggcaucaugaucuccauuuuccagaugagaagacugagucuugaagagaaguuaauaacuugccccaaaucucacucacuuaagcguuagaggcuugaaaacuaggucuauugguguuuuuucccguugagggaagaaagaaaaggaaggugacacacuaagagaauucgagugaaaagggggaagguaaaggaacguagauaacugggagcucauaaaaagggucugagaucaaaggagcccccagggcagcuggaagccuugauuugggaagccggguccagcagucaccuccaccuugaucucugugcugggcuuuugcugccaugcacggcuccuguacagcccugaaccuccugccuccucggaggcucaggcauccaguucggccacucucagcccugccagaagugcagccucccugugagagggacacccugcaggcugcacaugcacaaaaggccuggggagggccuaggcgccaggugucucagugcagcagcccugccuuccuccgucuaugacgugugcccuggaggcugggcgccaguuauggggcacucagagugugccaggagccgugcugagcccucagcauccauccuucucgucuuccccaccucugauguguauauaguaugucuacucuaauauuagauagauagaauucuauaucacacauuauccucucauuacacguaugugauaaucguccuccuagagaugagcagacaggcucugaaagaaggcgugacauacccagucaugcagcugggauccaaacccaggcugccuggcuucaaagcccacagccguccacugcaccugccuucccugccccguggggagcgaacagagggucuguggucgauggggaggggccccccagcugccuucugugcuucuguuggcucaucuguguuucuccuccuccaggauacuccaagcgggccuggacguggagcgucucucccucaggaauuucuuccaucauuuccauuccaagcgaggcauguggagccgucgccagaugaagacgcuguagccggaggguguccgcggggcccagcacuccccgcucuggacuagcaguggcuccccagggcccugcuacuguucagggauggggaguggggugacggcuggaccccaagaggccucgaagcugacggcccacuccaccuggagcuguccccucacagaggcagguuccggggcuccugucucugccuccugggccuucagaagggaggacuuugagagagaggccaggagggaccacuugcucagucgagaacgggaagagcuccugagaaggacgggucaggaaggagagaucugacugagcgacaccauccucauccaugaaggugcacgcccacaucccccaagcgcuccucacgccaagcgcugaccaccagacccucuucuaguggacauauuuuauuggggggcggggauuuuaaaaacagaaaaccgaaacugc

SEQ ID NO: 191686 - RNA, 41066 nt, Homo sapiens
aaacuucuucgcgauugcacggauucagggacgcucaguggcgccgcgccgcuccuugguuugacuuuuguuuuucaguugcguucccugacucggagucuuagugugucgugaguauagaguuucggguuuggggugaagggguuagguaagaagccuugggaagaaaaucugguuagggagaaguaacugcggaagcagugcggaggagaggacgugagccugaaugugguguccguggaggggcuggggaccggaggaggaaagcuccaaugugcaaagggagagaccucaggagugcuggagcguugggaccuggagcagugaggcggucgagaaugggaugaagugggaaaaggaguacgggauucgggcgcccuggagaugcguuccgguguacucuaaccccacgcuggucuagcucucaguuuccucauuugugaaauaagggauagugaaaauacugaacgguuguugggauaauaaauuguacagauuugucacguggcuaaaagaaaaaaauucaaagugcuacacaaauguuaauuguuaguagacaagcuauaagaauauaucuaagcaaggguauuggagauaggugcagagacccuagcugaaacccguuaauuuaccuauaaacaaaggcauuguuccuuuggaagaggcaaugaagaguaagacgcgauuucugucuguagggagcgcacgcuagcaugggagaaacgauagcaauaaagcacucuaauauguugacuuguagauaauuucaaaggcaguucuuuugcacuuagaucauuuuugcuaaaucauuuuggauggggagacucaggaaagagaaaaaggaggugguauuuaagaugaguuuucauguacagacuagauuuuguuaagugaaauuaugaggguuguggagggaguuguguuccagcuagagggaagcucaugaacaaagguauggaggcaggaaaguuaucuggaaacgguacauuuaggagaguagagagaaauaaggcaggaaaguuagguuuggcccuuauguagaaagccaugaauucuaggcuaacaaauuggauuuaaugcuuuaggcuaugaggugcuacugauguauuuuauuaaagaaaaugguccaggagacgcaaggaguagguagaaccguuaagguguuguaaugguguggguaagaaguauugagacucugaauuaacauggucauuguggagauaaaauauacaagauauucauaugguuagacaggagguucagaagaaugagugaucaaaugaugaauuuaaguugccaacucccgguugcuuggaaacgcugaauuaguaacuaaaauaggaaagucagaaggggcauguuuggauaaaaagaugauguguuagguuuaggaaauguuagcuuugagaugcuaaaaaaauaccuaacuugagugauuucuuuuuuaaguuaaacguuucaagugccagugggacuaugggugaaaauguccacuacauuuuuguuaauucaaaucaagagguugaaagagaugucguuuauuuauucaacauguaauuguuacuuacuguaugccauguaguguuuuagaugacagaguuaauaauaaaaacaggaggaauaaugauguucccaaagaaaugguuagaggaaaugauaaagaaacuugaagacagaaccucugagccaagggaguaaaauugucaauaauaauaauaguccacauuuacugagugcuuauauaugugucaaacacugucccucggccuuauauccguacaccaaccuaugacauagaaguaacugaaauuuagagaggauaacuugccugagguacacagcuaauaagaggcagggcuuugacucaaacccaagucugauaucagagcccacauucucaacuacaaagcaauauuuauuuuuauuauuauuuuuuccagguaaggucucacucugucaccuaggcuggagagcaguggggcaaucucagcucagugcagccucugccucccaagcucaagcaauccucugccucagccuccugaauagcugggacuacaggcacgugccaccacucccagcuaauucuguaauuuuuguagagacaggguuucaccauguugcccaggcuggucucaaacuccugaccuccagcaguccauucaccuuggccucccaaagugcuggcauuacaggcaugagccacugugcccagccuauuuuaauuguuuuuugagacagggucuugcgcuguuguccaggcuagagugcaguggcacgaucacugcucgcugcagccuugaacccucaggcugaagugauccucgcaccaagcaggugggacuacauugccacugugcccagcuaauuuuuaaaauuuugguaaagacagggucuugccauggccuggccaugccaagguccggucccaaagugauauauuuuuaaaggguaguuggcacuaccaggcacaguggcucacgccuguaaucccaacacuggcaggcagagguggguggaucaucugaggucaggaguucgagaccagccuggccaacauggcgaaacccugucuuuacuaaaaauacaaaaaaaauuagccacaguggcaggugccuguaaucccagccacuggggaggcugaggcaggagaaucacuugaacccaggagguggagguugcagugagccaagaucgugccacugcacuccagccugggcugaacagagugagacucugucucaaaaaauaaauaaauaaauagguaguuggcacuaucuaauuaagaauacaagugaaggaguaacuauuggauggaggaggauagaaacagaaaagagcaauugaauuuauuaauuuggaugucugcugaccaauaagagcuugguuagaugucauaguagaagcccgaggccuggcucaguggcucaugccuguaaucucagcacuuuggaaggccaagggaggaggauuguuugaguccgggaguucaaggccagccugggcaacauagcaaggccccgucuugcagccagagaggugaguguagacaacuuuucguagacaugugcaacagugaggacagucacuaugaaggagaagagggauugcagguuguuagaagggucuuucaaagcuucaaauuacuuuuuuuuuuuuuuuuuugagacggaguuucgcucuuguugcccaggcuggaguguaauggcgcgaucuuggcucaccacaaccuccgccucccagguucaagcaauucuccugccucagucuccugaguaggugggauuauagggaugcaccaccaugcccagcuaacuuuguauuuuuaguagagaugggguuucuccagguuggucaggcuggucuugaauuccugaccucaggugauccgccuuccucggccucccaaagugcugggauuacaggcaggagccacugugcccagccgcuucaaauuacucuuaaauggcuuugaaacagugaaauuuaacuuuaaguugucacccauauccguacaauggaauuuuauucagccacaaaaaggaaugaaguacugauacaugguaccacauaggugaaccuugaaaacauuaugcuaagugaaacaagacagucacaaaagaccauauacuaugugauuccauuuauaggaaaguccagaauagggaaaucuguagagacaguagguuagugguugcuuaggacugggagacagggauaauagcugaaggacacaggguuuuuuucuugaagugacgaaacuucuagaauggacugugcugauagguacacguaucugugaauauacuaaaaaucauugaauuuacacuuugaaugaguuuaaugguguacacaaauuacauuccauaaagcugcuuuuuuaaaaaaauguuacccauaauccuuccaugccaauccaauaacuuuauuuucuagguuauuuggacaagaggcacauugacccaauuuggagacguauuuuggaaggaggugaguuuggaggaggagaguagucuuuuaaaggagagaauuagaagaaagauggcguauuugaaggguuggcuguagaagaaaacaaaugggaugagagaagcagaaacagauuuuuaaaucuagauugaauagacuggccagcagaagaaaaggauguuuaacagucuuucaaauucauauugagaguuguauauauauacauauacacuuaguaugagccaggcacuguuuauguuacuagggauacagcagugaacauaauagauaaaaacccgcugccuuuagugaguuugcauauuccaguguggagagacagacauuaaauauuagaugguuauaaguguucaacuuuuuuuuuuuuuuuuuuuuaagagagggucucacucugucaccccagcuggacugcaauggcgugaucauggcucacugcagccuugaucccccggugcaggcgauccuccuaccucggccuccuguuuaacuaggacuacagacaugugccaccacaucuggcuaauuuuuuguagagacaggguuuugccauguugcccaggcuggucucaaacuccuggacucaagcagucuauccgccuuggccucccaaagugcugagauuacaggcgugagccacuucaacuagccaagguuguaaguguuaauggagaaaaguaaaacagagaagagggaugagguugguagaguggucagggaagacuucaucaagaaagugacauuuuagcccugaaggaggagagggaguaagccacauagauaaauggggaaagaacaucauagcaaagagaacuguagguacggggacucugaaguagaagugugccuggcacguuugaagaacagccaagaggccgguguuuuuaccgcagugaacaaggauaagaguaguaggugaggucacagaaguaaugagguuggccagaucauacaggaccuugucggcaauuuuaaagaccuugacccucugaguaagaugaaaagucauuggaggcuuuugggcagaggaguuuuguguuuugacacauauauauuaauguguugagaauacauuauaagggaugagguugaaaauggaacagggggaccaggcguggugacucaugccuguaaucccagcacuuugggaggccaaggcagguggaucaccugaggucaggaguucaagaccagccuggccaacauggugaaaccccgucucuacuaaaaauacaaaaauuagccaggcuuggugguaugugccugucuucccagccacucgggaggcugagacaggagaaucacuugaauccuggaggcagagguugcagugagccgagauugcgccaucgcacuccagcuuggaugacacagcaagacuuugucucacacacacaaaaguggaacgaggagaccaguuaagagaccguugucgucaucugggcaacagauagcaguggguuggaagccaagcgcagugacucaugccuauaauccuauuacuuguguggcugaggggagaggauugagugaagccaggaguuugagacaagccuaggcagcaaagcaagacccuguaucuaaaacaacaaaagcaaaaacaguggacuggaccagggcaaugagggcauaggugauaaguaguugucagauucuagauauuuggaugagcuagccaguaggauuugcuaaugggucguguguggcauguaagacaaagagaggaguaaaauuucuuaaaccaaguuugucuguuugucauaaacaacuggcagcauagaauuaguauuuauuggaauguagaauucugagagaagagcagguuuuuguggugggagguauguaucaggagcucaguuuuauauuuggcgagcuugggagaccugcuggacauccccauggagagacgggguaggcaguuagaugugugagucuagaguggagggcagaguaaggacugaggcaucaauuugaaaacuacuaaugugcacaugcuauuuaaaacugugagacuucaggagaucaccaaggcaaugaguaaugaccaguaagaaaaggggacaaccaggaagagguguccuggaagccaaacaaagaaagcuuugacggagucagggagagaggcacugugggguucugagcaggaaaaugguauauggaaguaacaguggugauuaucucuuuucauacuuuuacacaaaauucuuucccaaaggacugaagauuuuuuuuuuuuuuuuuuuuuuugagacggagucucgcucuguugcccaggcuggagugcaauggcgcaaucucggcucacugcgaccuccaccucccagguucacgccacucuccugccucagccucccgaguagcugggacuacgggugccugccacgacacccggcuaauuuuuugcauuuuuaguagagaugggguuucaccguguuagccaggauggucucaaucuccugaccuugugauacacccaccucggccucccaaagugcugggauuacaggcaugagccaccgcacccggccacaggacugaagauuuuaaauagauuauaccagguagaaggacauaacagaacaucaucugacuugcucagaaucagaguggauugacagcgaaugcuugauaagaaaguuuucaccaaagcaauaaaaaaaucagccucucucccucucuccuucugucucugucaaucauauaacaugguauggcauucccuuuccagccaugagguuuaucuucaugaaaauuucuauaauaagguugcuuaaaguacaggagcucaagaucuuggguuaucaauugagauggagauuaugaagagccuuuuaaaguuuauaaguaauuuuuuuucuuuugcuuaagauaauagagaaaguacgcgaaauaaagauagcaucaguggcuuuauauucauuuuaaauuugauauaguggguacucugccuuaauuucuauuuacuacuucugcuuuuggagaggggagugggggcaggggaagucaauauguuggugaggcuggccuugaacuccugggcucaagggauccucccuccucagccuccugaguagcagggacuauagguacgggccacugcaccucgcucuauguacuguuucuugcuuauuagagacuuuucugcaucuucuccuccuauccuauaacuucaaggaaaagauuguagauuuguuuuuguguuguugcagauaacaaggagacuuuucuacuuugugugcuuauccauuuaaauauucaaugccauucugauuuuuauuugaaaauaauuaugaggaguaccuuuugaaaauucaaaaggcaugaauuucaggauuuggagauacuuuaaagaauacuacauuuuaggccgggcgugguggcucacgccuguaaucccagcacuuugggaggccgaggcagguggaucacaaggucaggaguucgagaccagccuggccaauauggugaaacccugucucuacuaaaaauaacaaaaauucgccaggcguaguggugcacaccuguagucccagcuacuuggaaggcugaggcaggagaaucgcuugaacccagaaggcagagguugcagugagccgagaucacaccacugcacuccagcuccagccugggcaacagagugagacacugucucaaaaaaaaaaaaaagaaaaaaaaaacuacauuuuaaaacaucagauucuuuccaagaagcaaauaugaugauguugaagagggaaccagucuaauccuguacuguuuuuauuuuucuauucguggcccguaauuaugaauuuuuguguauuugauaggugugaaaaagacagcaugaacuuuaccccaacacacaccccugucugcagaaaguaagacauuugcuuauuuucaaguuguuaagaaaucgagacuuguauagccuuagucuaagcauaggaacuggaaagguauuggaaacauauuuccuaaaguuuuuuuucuuugagacagaguuucacucugugcccaggauggggugcaguggugcaaucauugcucauugcagccuugaccuccugcacucaagcaauccucccaccucagccucccagagugcugugauuacaggcauaagccacugugcccagccugagacauccccuuuagaaaauaugaaauguuggccgggcacgguggcucacuccuguaaucccagcacuuugggaggcugaggugggcaggucacaaggucaggcguuugagaccagccuggccaacauggugaaacuccgucucuacuaaaaaaaaaaaaaaaaauuaacugggcaugguggugugcaccuguaaucucagcuacuugggaggcggaggcaggagaauugcuugaacccaguugguggagguugcagugagcucagaucacgccacugcacuccagccugggcaacagagcaagacuccaucucaaaaaaaaaaaaaaagaaauguuaaguaaacuaguauuucucucacaaguuuuuaaucacugggaaaauguuuaaguuuuucuucaugcuaguugacagauuuuaauaucucugcaugcuuauuuauuacaagugagcacauauauuaacuauaacucagagcuucugguauaguuucuccacuguacuauuuuguuauguuauaaauugcagacaaccaaauuggauuuauuuucacaggaggguuucucuucuucuguacuauuuuuguuuuuuuuuuguuuuuugagauggaguuuugcucuuguugcccaggcuggagugcaauggcaugaucuuggcucaccgcaacgucugccucccagauucaagugauucuccugccucagccucccgaguagcugggauuacacacgcgugccaccaggcccggcugauuuuuguauuuucgguagagacuagguuuugcuguguuggccagguuggucuugaacuccugaccucaaguaaucugcccaccuuggccucccaaaguggugggauuacaggcuaauuuuuguauuuuugguagaaacuagguuccgcuauguuggccaggcuggucuggaguggcgugaucucggcacuugaaccugccuccugcguucaagcaauuauucugccucagccuccagaguagcugggauuacacacgcgugccaccaggcccggcuaauuuuuguauuuuugguagagacuagguuucacuauguuggccaggcuggucuugaacuccugaccucaacuaauuugcccgccuuggccucccaaaguggucggauuacaggcaugagccacugcacccggccugcaauaugucuuaugguacuacauuuucuaauuguuacuacauggucucccuuaguuuauauucuguuuuuuuaaauuaucuuuuucgucucuaauggauuuuauuuuuacuuuagagacaagguguugcuauguugcccaggcuggacuggaacuccuaggcucaagcgauccucccaccucagcccccugaguagcugggacugcucagcuacucagcugugccaccauuccuggcucuaacauguauuuugaauccagcuuuaaaccauuaguacuuggaagauaauuaauaaaauuauuuacuauccuguaauaucaaacuuucaauuuguuuuuuuuuuuugagauagagucucgcucugucgccaggcuggagugcaauggcaugaucucgacucacugcaaccucugccucccagguucaagcgauucuccugccucagccucccgaguagcuggaacuacaggcgugcacugccacacccaucucauuuuuuauuuuuguauuuugguagagacgggguuucaccauguugcccaggcuggucucgaacuccugagcucaggcaaucugccugcuuuggccucccaaagugcuaggauuacaggugugagccaccacgcccggccaagauuuuuuuuuuuuuaaauaaagacaggguuucacuauauugcccaggcuggucuugaaccccugagcucaagugauucucccaccuuggccuccaaaagugcugggauuacaggcaugagccacuaugccuguccaaacuuccaaauuuaugagcaccuuaauuauaagcacuuugggaacacaaaacccccuuuuauuuaggaaguuauaacucauaaacuuucgcagagugugaugaauauaucauuucuaauuucacguaggcgaacaguugucuccaaacgugguguugccgucaguggucccaccaagaggaggggaauggcagauucacuggagucaacccccuugccuucccccgaagaucgucuggccaaacuccauccuucuaaggagcuccuggaauauuaucaaaagaagauggcugagugugaggcagaaaaugaggacuugcugaagaaacuggaacucuacaaagaagcuugugaaggacagguaaagaaacgaugcugcugcuuuagaacucugauggagucuucauaaauuagagaugcccuacaagugccaguuuauaucagaagcagauguuuuauaaaaauacuccuuuuuuauuccccagcccagcuauugccccuucaggcccuccuuggaucauaacccccaaaacugcccuuccucucaaaucuuaaauucugacaucuccauaucucuuauaccuaguucuuucaucuccuuguaccugaguaguccuuaacuucuuuguuaccuccauagcuuccugacuuuucaguuuucugagugcuguauauagcucugauaucaaguccuucaaaccuaaaccccaugaugcuuuacuugaguaguaacugcagugccugcaaaugaccccuugcucaauuauucuucugcuccaccugcauagcaaaaacugagcuguggcaucauccaguucucugccacguguucuccuauagcaggauuucuuaaccucggcauuauugacauuuuggccuggaugauucuuuguugugagggguuguccugugcgugaugggauguuuagcaggaucccuggccucuacccgcuggaugccaguaacacaacacccccagcugugacaaucaagaaucucuccagacauugccagauguuucuggaauggguguauggaugugcagagucacuccugauugagaacacuguuguagaaaggucacaaaucaguacagaaugaaucgaugguaaacaaauucagcuguacccucaaccauuauacagcagucuucucaccuauccuuacuggcuuuccucuccuuccacaucugugccauacccucaccucuagccugcaaccccuucuuagcccuccucucucaacaucuuuucugccaucugcacaccguuacuccauccguaucuaucuccuucuuccuuccuuuguuuuuucucugguugcuuuucuuuuuuuuuuugagacggagucucgcucugucgcccaggcuggagugcaguggcgcgaucucagcucaccacaagcuccgccucccggguucaugccauucuccugccucagccucccgaguagcugggacugcaggcgcccgcaaccaugccuggcuaauuuuuuguacuuuuaguagagacgggguuucaccguguuagccaggauggucucaaucuccugaccucgugaucugcccaccucggccucccaaagugcugggauuacaggagugagcaaccgugcccggccuguuuuuuuguuuuuuugagacagcgucuuacucugucgcccaggcuggagugcaguggcgcgaucucagcucacugcaagcuccgccucccggguucacgccauucuccugccucagccucccgaguagcugggacuacuggugccugccaccaugcccagcuaauuuuuuuguauuuuuuuaguagagacaggguuucaccguguuagccaggauggucucgaucgccugaccucgugauccacccgccucggccuccuaaagugcugggauuucaggcaugagccacugcgcccggccucucuagcuacucuuuuuauauaaauggcucuuucuuuucccagucacacuuccagaaucuuuugacuuucccauucacugaaugggauuuuuuuuuuuuuuuuuuugagacggagucucgcucugucgcccaggcuggagugcagugacgcaaccucagcucacugcaagcucugccuccuggguucaagcaauucuccugccucagccucccgaguagcugggauuacaggugcacgccaccacaccuggcuaauuuuuuguauuuuaguagaggcaggguuucacuguguugcccaggcuggucucaaacaccugaguucaggcaaccugccugccucggccuuccaaagugcugggauuacaggcgugagccaccgcgcccagcugggaaaugucuugacugcaguuucaucucgguccuugccaugccacuaaaaccgugccgucugcggucuccaaauaccuguuuaccaaacuuuucucuuuuugcccuuugcagugucugucacuuuugaccucucuuuuucuaaaauuuucuuccuuucuugauuuccuuuuuuuuuuuuuugagacggagucucacccugucugccaggcuggagugcaauggcacaaucucggcucacugcaaccccugucucccggguucaaacgauucuccuaccucagccucccaaauagcugggauuauaggugcccaccaccacaccuaacuaauuuuuguauuuuuaguagagguggguuuucaccauguuggccaagcucaucucaaacuccugaccuugugauccgcuugccuuggccuccugaagugcugggauuacaggcgugagccuggccuccuuucuugauuucugugucauuuuucuuucacaauuucuaucuaaccucucugaucagcucaucucaguguccauuaacaacucucuuuccuuacucuuaaauuucagaguucuuccagauucuacuauaaaugaccuuguuuuauccuuguauuacacuucugcauacgggaugaugacuguuaaauaacuaacccugacucacuuuucuccugaggcuccuuucucuacccucccuuccccacccgcacauguacugccaccauuucgccuuccuccguuucucaugccuuaacuuuuucuuuauucuuugucuuggcaaauggcaucauugccuacgguucuuccagucccccuaaaccgaaucauuuggcaaguccuguugauucugcuuccuaaauauuacuuaauccauucccacacccaccucacuuuggccacgaugcucacacagacccuugaguugcgucuaaacugugacgguguccuccuugccaguaccugccucuggccucuuacauccccaguuggccucacacuuuucacucuagcaguacugaaauauuuguacuuguccaaauuuaauaggcuuuuguuuuuuggagguuuacuugucauuuuuaucacauuauguauguauacaaugaauuacaggguaauucauuccauuugggcuccuggauagcuucaggaugggagcugguugccagauggcagugaugcagcaucucugaauacauuuacugggacacagugugagccaccgugcccagccuaauuguuuuuguagauucuacaaaaaaaguguuuccaaccuuuugaguuccacuguggacuuguaugcucucccuuucucugaaucaguuguuaauauuuauuaacauaauuauuaacauaauauuauguuaauauaaucaacauaauauuauguuaauauaaucaacauaauauuauguuaauauaaucaacauaauauuauguuaauauaaucaacauaauauuauguuaauauaaucaacauaauauguugauauuauuaacauaauuaacauaauaauauguuaauauuaacauaauuauuaacauaauaauauguugauauuauuaacauaauuauuaacauaauauguuaauauuaacauaauuauuaacauaauaauauguugauauuauuaacauaauaauauguuaauaaaaauguaauaaauauuuuuaucacauuauguauguaucuauagaccucuggguuuuuuguuuuuuguuuuuugaguuagggucuugcccuguugcccaggcuggagugcaguggugcgaucauagcucacugcagccucaacguccuggacucaagcaauccgccugccucagccucccaaguagcugggacuacaggcauguaucaccaugcccagcuaauuuuuuauuuuuuauuuuauuuugagaugaagucuugcucuugucacccaggcuggagugcaguggcacaaucucggcucacuacaaccuccgccucccagguucaagcaauucuccugccucagccuccugaguagcugggauuauaggcgcccaccaccaugcccggcuaauuuuuguacuuuuaguagggacuggauuucaccauguuggccaggguggucuugaacgccugaccacagaugacccaucuggcucggccucccaaggugcugagauuacaggugugagccacugcacccugcccaauuuuuuauuuuuuguaaagacagaaucucgcucuguugucuaggauggucuugaacuccugggcucaagccauccucccacuuuaaccucccaaaguguugggauuacgggcgugagucacugugcccagccuuuaugaaauuauuuuuaaugaccuugcccaauuuuaaguguucaguugaguaguguuaaguguuuaugugugugugugugugugagucuguggguguguggggguguguguguguguguguguguguguguguguguauauauauauauauauauauauauauauauauauauauuucuuuuuuuuuuuuuuggaggcagucuggcucuuucacccaggcuagagugcaguggugccaucucagcucccugcaaccuccgcuuccuggguuuaagcaauuguccugccucagccucccaaguagcugggauuauagggugcgccaccacacucagcugauuuuuguuuuuuugguagagaugggguuuugccauguuggucaggcuggucuugaacucguggccucaagugaucugccacgccuggcguguuaaguauauucacauuguugugugacugaucucuagaacguuuucauuuuacaaaaccaaaacuccaucccauuaaacagaucauuucuccccacacucccuguaaccacuauuuuacuugcuauuucuaugaauuagaaauagagcaggauuugucaggcaugguggcucgugccuguaaucccagcacuuugggaggccgaggccggcggaucaccuggggucaggaguucgaggccggcggaucaccuggggucaggaguucgagaccagccugaccaacauggcaaaaccugucucuauuaaaaauacaaaaauuagcuaggcgugguggcacauaccuguagucccagcuacuuaggaggcugaggcagaagaaucgccaaggagguggagguugcagugagcugagaucacaccacugcauuccagccuggacgacagagcaaggcucugucucaaaaaaaaaaaaaaaauagagcaggauuuauuuagaauagaguggaaucauacuguaguuuuucuuuuuguaacugacuuauuucacuuagcauaauguccucaaguuucgucuguguuguagcaugugaugagauugucuuccuuucugacaacaucaggcucucucaugguucuuauuuacaguucucuuuucuuggaguaccaacugucugcuucucucucuacccaucuucuguucaucugucaagugucagcucuugggugguagcgcuuugauuucccaaacagaucucagaauguuuauuccugccacgcuuucccccacaccauuucaccaugcaugcuuucaugaaguaauuauuuuauuuuaaucauuugccucucuccccaugaaauuccguagcucuguagacaggaaucguaucuuuucaucuuuguuuuccugcaugucauaauaaugcuuaugauauaggaaacauuacuaaaaaaguguggauaggcuaggugugguggcucacgccuguaaucccagcacuuugggaggccaagguggguggauugccugagcucaggaguucaagccagccuggccaaaauggugaaaccccgucucuacuaaaauuagcugggcguggugcacaccuguaaucccagcuacucaggaggcugagacagaagaaucacuugaaccugggagguggagguugcagugagcuaagaucaugccaccgcauuccagccugggcgacagagugagacucugucucaaaaaaaaaaaguguggauagaauaggugagucguacagcauucuggauucuauagucuguaaaaggaagaugugagagcuuugauguuaaaugcaaacuucacacucauccuguagcuguuaaacuccagucaaggcugggcaugguggcucgugccuauaaucccaguacuuugggagacugaggcggguggaucacuugaggucaggaguuugagacuagccugcccaacauggcgaaaccccaucucuacuaaaaauacaaaaauuagccgggcaugguggcaugcaccuguaaucucagcuacucgggaggcugaggcacaagaaucaccuagaagguggagguugcagugagcugagaucgugccacugcacuacagccugggcaacagagcaagacuuggucucaauaaauaaaaaaacaaacaaacuccagucuauacaugccuauugcugucauuugaauucuguauuggcaaaauuauuuacuuuggaauauuucuacaugaguagacuccucccuauccagugagagauacuccauugaaacccagugucuuucaacuaucuuauugugguuuuuuugcagcauaaacuugaaugugauuugcagcagagggaggaagagauugcugaauugcagaaagcucuaagugauaugcaggucugccucuuccaggaacgggaacauguuuuacgccucuacucagaaaaugaccgacugagaaucagguaccaaauaggagaagggaaauguuggaguuuaacuuuaaauuacauucauucauucauucauucauucauucauugauuuagaggcaguaucacucuauugcccaggcuggaguacaguggcgcucucuuggcucacugcagccuccaccuccugguuccagcgauucucaugccucagccucucgaguagcugggaacacaggugugcacuacaaggccuagcucauuuuuguauuuuuaguggagaugggguuuugcccugucagccacgcuggucucgaacucuuggccucaagugauccgcccaccucagccucccgaaguguugggauuacaagcgugaaccaccaugcccagcccuuuaaauuacuuuuaaaaagauacauuucuccacauuaauucucuuagguuguauucucuaggaaguggacucugagauggagauuugccuucacgguaguuacuggagaagcucucuggaauaauagcuaugagcagauuugggcagagguagaauaugaacggauacugugguaacagaagccuuaaccaacccccauagggagcacuaaggauaggguggucuuucggcagcaaaggacugagaauuuuguguccccacauugaccagucauaggaugcagguaguccccagggaggguauguaaacuugggagaagaagcccccuucagccaagugucauuuuucagagaaaaacugagcuccugggagauauggucacaagaaggagucauagcaguacacuacauguuccauuacagugcucuucugugugugugugcugggagugagaggguaaaauacacauagcagcacacuccauguuccauuacagugcacuucugugugugugugcugggagugagaggguaaacacacauagcagcacccuccaugcuccauuacagugcucuucugugugugugugcugggagugagaggguaaaacacacauagcagcacccuccaugcuccauuacagugcucuucugugugugugugcugggagugagaggguaaaauacacauagcagcacacuccauguuccauuacagugcacuucugugugugugugcugggagugagaggguaaaauacacauagcagcacacuccauguuccauuacagugcacuucugugugugugugcugggagugagaggguaaaauacacauagcagcacacuccauguuccauuacagugcacuucugugugugugugcugggagugagaggguaaaauacacauagcagcacacuccauguuccauuacagugcacuucugugugugugugcugggagugagaggguaaaauacacauagcagcacacuccauguuccauuacagugcacuucugugugugugugcugggagugagaggguaaacacacauagcagcacccuccaugcuccauuacagugcacuucugugugugugugcugggagugagaggguaaacacacauagcagcacccuccauguuccauuacagugcacuucugugugugugugcugggagugagaggguaaauacacacauagcagcacccuccauguuccauuacagugcacuucugugugugugugcugggagugagaggguaaauacacacauagcagcacccuccauguuccauuacagugcucuucugugugugugugcugggagugagaggguaaaacacacauagcagcacccuccaugcuccauuacagugcacuucugugugugugugcugggagugagaggguaaaauacacauagcagcacacuccaugcuccauuacagugcacuucugugugugugugcugggagugagaggguaaaauacacauagcagcacccuccaugcuccauuacagugcucuucugugugugugugcugggagugagaggguaaaauacacauagcagcacacuccauguuccauuacagugcacuucugugugugugugcugggagugagaggguaaaauacacauagcagcacacuccauguuccauuacagugcacuucugugugugugugcugggagugagaggguaaacacacauagcagcacccuccaugcuccauuacagugcacuucugugugugugugcugggagugagaggguaaacacacauagcagcacccuccaugcuccauuacagugcacuucugugugugugugcugggagugagaggguaaacacacauagcagcacccuccauguuccauuacagugcucuucugugugugugugcugggagugagaggguaaaacacacauagcagcacccuccaugcuccauuacagugcacuucugugugugugugcugggagugagaggguaaaauacacauagcagcacacuccaugcuccauuacagugcacuucugugugugugugcugggagugagaggguaaacacacauagcagcacccuccaugcuccauuacagugcucuucugugugugugugcugggagugagaggguaaaauacacauagcagcacacuccaugcuccauuacagugcucuucugugugugugugcugggagugagaggguaaauacacacauagcagcacacuccauguuccauuacagugcgcuucugugugugugugcugggagugagaggguaaauacacacauagcagcacacuccauguuccauuacagugcacuucugugugugugugcugggagugagaggguaaaauacacauagcagcacccuccauguuccauuacagugcucuucugugugugugugcugggagugagaggguaaacacacauagcagcacccuccauguuccauuacagugcucuucugugugugugugcugggagugagaggguaaaacacacauagcagcacccuccaugcuccauuacagugcacuucugugugugugugcugggagugagaggguaaaauacacauagcagcacacuccaugcuccauuacagugcacuucugugugugugugcugggagugagaggguaaacacacauagcagcacccuccaugcuccauuacagugcucuucugugugugugugcugggagugagaggguaaaauacacauagcagcacacuccaugcuccauuacagugcucuucugugugugugugcugggagugagaggguaaauacacacauagcagcacacuccauguuccauuacagugcgcuucugugugugugugcugggagugagaggguaaauacacacauagcagcacacuccauguuccauuacagugcacuucugugugugugugcugggagugagaggguaaaauacacauagcagcacccuccauguuccauuacagugcucuucugugugugugugcugggagugagaggguaaacacacauagcagcacccuccaugcuccauuacagugcucuucugugugugugugcugggagugagaggguaaaauacacauagcagcacacuccaugcuccauuacagugcucuucugugugugugugcugggagugagaggguaaauacacacauagcagcacacuccaugcuccauuacagugcucuucugugugugugugcugggagugagaggguaaaacacacauagcaaaaaguucaccauuuuagccaucugaaguguacgguucaguggcauuaaguauauucacguuguugcacaacugucaacaucauugaacuccagaacauuuucauauuccuaaacugaaauuguauacucauucaacaguaacucccacauccccguuaccccaguuccuggaacacacuaugcuacuuuucgucuccaugaauuugacgauuuuaggugccucacguaaguggaaucauacaguauuuguuaugcuuauuucacucagcguaaugucuucaagguucauccauguuguagcaugugucagaauuuucuuccuuuuuaagacugaacaauauuccauuauauguguguaccacauuguguuuauccauucauccaccaguggagcucagcucacuguaaccuccgccuuccaaacugaagcuguccacccaccucagccucuugaguaacugggacuacaggugugugccaacaugucuggcuaauuuuuuuuguaauuucuguagagacaggguucugccauguggcccaggcuggucuccaacuuccaagcucaagugaucugucugccucagccucccagagugcugggauuacaggugugugcuacugugcccggcugagaccuuacuuuuaauucuuuuguguauauacccagcaguagaucacauuguaauucuguuuuuauuuuuuugaguaacugccauacuauuuuccauaguguuuauaccauuuuauauucccaccagcagugcacaaggguuucaguuucuccacauccuugacaauaccuguuauuuucuuuuuuuuuucuuuuaagccuuuuuuuuuuuuuuuuuuuuuuuugagacagggucucacucugucacccaggcuggagugcaguggcaugaucuugccucacugcagccuuuaccuaccuccuaggcucaggugauccuugcacuucagccuccaaguagcugugacuacaugcaugugcugccaugcccagcuaauuuuuauauauauauauauuuuuuuuuuuuguggagacaagguuucaccauguuucccaggcuggucucaaacuccugagcucaagcaauccuccugccucagccucccaaagugcugggauuacaggcaugagccaccaugccuggccaacacuuguuauuuucuggguguuuuuuguguuuuuuguguuuuuuuuuguuuuguuuuuuuuuuuuuuuuuuugagacagggucuugcucagucacccaggcuggagugcagcggcaugaucacagcucacugcagccucaaccucccaggcucagaugauccccccaaccucagccucccaguuaguugggaccaugggugcgcaccacugugcuuggcuaauuuuuguaucuuuugaagagaugggguuuccccguuuugcccaggcuggucucacacuccugggcucaagcgauuugcccaccuuggcuucccgaaguguuaggauuacaggcgugagccacugugcccagccuuauuuucuguuuauuugauaguaaccgucuuaaugggugugagggagucucauugugguuuugauuugcauuuuuaaauguugagcaucuuucuugugccauuuauauaucuucuuuggagaaaugucuauucaaauauuuugcccauuuuaauaauuggguuguuuuuguuguugaguugaaguucuuuuuuguuguugagacagggucuugcucugucgcccaggcaguggcgugaucacggcucacugcaaccuuugucugcugggcucaagcuguccucccaugucagccuccugaguagcugggacuacaggcaugugccacuacaccuggcuaauuuuuguauuuuugguagagucagaguuucgcgauguugcccaggcuggucucaaacuccugagcucaagugauccucaccucacccucccaaagugcugggauuauagaugugagccaccgugccuggcuauagaaguucauuauauauucuggauauuaaaccuuuguuagauauacagaugcaugcaaauauuuucuccuguuccauagauugccuuuuuauuuucuccucuuuuuuuuuuuuuuaggggcaggguaucacucugucggccagggugauccuccugccuuagccucuggaguagcugggauuauaggcaugcaccacuaugccuggcuaauuuauuuucuuuuuuucauuuuuuuguagaaacagggcagaucucacuauauuccuuaggcuggucuugaacuucugaccucaagugauccuccugcuucagccucccaaagugcuaggauuacaggaaugaaccacuaugccgagccaggaguuuuuaauuuuuaugaaguucaauuuauguauuuuuuuauuuuguugcuucugcuuuugguaucacauucaagaaaucauugccagauucauugucaggaaacuuuucuccuauguuuucuucugaaaguuuuauuauuuuagcucuuacgucuaggucuuugauccauuuuuaguuaauuuuuguauacagcauuagguaagguuccaacuucauuauuuugcauguggauguccaguuuucucaacaucauuuguugagaagacuuagccacaugguuucuuucuuuuuuuuuuuuuuuuuaauuuuuauuuugagacagggucucccucugucacccaggcuggaauguaguggcacgaucucggcucacugcaaccuccaccucccaggcucaggugauccuccugccucauccuuccaaguagcugggacuacaggcacgagccaacacaccugacuaauuuuuguauuuuuuguagagacaggguuuuuccauauugcccaggcugaucucgaaguccugagcucaagcaaucugcccuccucagccucccaaagugcugggaugucaagcgugagccaccgcacccagccucgccacguggguuuuuggugucccacggucaagugcuccguuuuuagcaggaucuacuagcauggcagaagcugguuuucaaauguugucauucucagcuguagacagcauggucucgcuccagauucucagagggucuguuaggauucuugucguggugcuugccguaaacuccaccugguaccuugugccaccacagacaccauaggauccgccaaaugaugucccaagcagcagagcauccuuucaacucugggccacaccgaaagcucgccuuccaugucaguugauacauaggucagagcaguauuccaaaaugcggaguauguugucuccagaaccugaagucuccuuucgggcauugugcuuccuucuuggugguagcauguaccaggugaaauaauuugaucuuuacaucggagggaauauccugggauaccuggaucacagccuuaaaaacuucacucaugugcuucguaagguucaucugcaacccucccgagcacacguaucuuaccacgugcacuugcuguuucuuguucaugccgucugauuuaacgcgauaucaucaguagugagcuacuggccaucuguggaguagccagauccagauucuuuuuuuuguuuuuguuuguuuguuuguuuguuuuugagauggcgucucagucugucacccaggcuggagugcaguggcgugaucgcagcucacugcaaccuccgccucccagauugaagugauucuccugccucagccucccgaguagcugggacuacagcgcacgcuaucacgcccagcuaauuuuuguacuuuuuaguagagaugggguuucaccauuuuggacaggcuggucucgaacucccgaccucgugguccacccgccucggccucccaaagugcugggauuacaggugugagcuaccgcgcccagcccagauucuuuuauacuguauugacagaaaguaaaagcguuaacauggcccugggaaagacuauaaaagcacacugcuguccaugucacaugaugugaacugccucuggucuuuugagggguaggaaagaauccauuugccuaauuaguggccacuuaccaugugccugagacuaaguaauucucuucuagcaaaggugcuacaucuggcacaaugacugaaauugggaccuacuggguaguagucuacucuuaucuuccagaauccaucugguuuuguaugggucauacugaggaaugaaaugaggcuuucauaaggaccuccaccucugcauucuuuaggucuuuauugaucgucuugacuggguagggaggggcaguuucugaggcuuucacuuagcuugccccagaagccaagaagcuaauuuggagguacugucccccaccuaguauguccauuuuaagcauuugggaacugaagaaaugcccauugauuugguggauccaguagaccugcugugaguuggacgugggccacaauuccauuuauuccaugguccccacgugccccagugccaugaugaugcuucacguuaucuggugucggugucagcuuagacccuguauccagcaguccuuaaaaugcccaggucuuuccucuuccccaguauacaguuacuugaauaaauggcuauagacccuuuggaggauguggggaaucauuaccaugaauaucuacucuguggugucgcagggucuuaccuucuaggaguuccagccucuucuuuagguaauugucucuaggacuuaaaacugacuuggggcugguaaucccagcacuuugggguggcugaggcgggcagaucacgaggucaggaguucaagaccagccuggccaacauggugaaaccccaucucuacuaaaaauacaaaaauuagcugggcauuguggcaugcgccuguagucccagcuacucgggaggcugaagcaggagaauugcuugaacccaggaggcggagguugcggugagcugagaucaugccauugcacuccagccugggcgacagagcgagacucugccucggaaagaaaaaaaaaaacggacucgggccugaaaaacgagucagagauugugauuuuguuuggggugcagcccucagccucuuuuccaucuuugacuuaucuuuuauuguuugagcuauacucuguugacuacccaucuaccuugcugcuagaaacgccacguucuguaaaccaucuccauaucaagucgcucugaaaucccuuuuuauguuguuuuuuuuaauuaauuaauuuuuuuuuuuuuuuuugagacagagucuugcucugucgcccaggccagagugcgguggugcaaucuuggcucacugcaaacuccaccucccggguucaagugauucuugugcuucagccuccugaguagcugggauuacaggugcacgccaccacgcccagauaaauuuugcauuuuuaguagagaccaagguuucaccauguuggccaggcuggucucgaacuccugaccucaggugauccgccugccucagcccaaagugccgggauuacaggcaugaaacaccacacccggcccgaaaucccuuuuuagcguuugcuuccuuggcccaguccagaccuaagcuaucuuagguugaguucucugggaaacagacuguacaguggagauuugcuugcaggaauuuuauugggaagugagggaacuuaaacugggauucaguugcagcaggccucguccaacacgauagggaucucugaagcugggauggcucuucagagauauccugaacugagcaaggggauuggauuuuuguguuuccucauugaccaggcacuggauaugggcugucccugaggaaugagaggcagaaacuugggugaggcaguucccuugucuggggauucaacuacaagcuaucagcaggcagcauuccuggcaguuggcagaaugagcccaucagccccgaagagcaagaucugagcaguaacccucagcagccacuaccauucccuuuuagaauuagcuaagaaguggccgggcgcaguggcucccgccuguaaucccagcacuuugggaggccgaggcaggcagaucacgaggucaggagaucaggaccuuccuggcuaacacagugaaacccugucucuacuaaaaauacaaaaauuagccgggcauaguggcgggcgccuguagucccaggugcucgggaggcugaggcaggagaauggcgugaacccggcaggcggagguugcagugagccaagaccgcaccauugcacuccagccuggacaacagagcgagacucugucucaaaaaaaaaaaaaaaaaaaaaaaaaagaauuagcuaagaagugcccuggccccuuuucucugaauggaaauaccugauguuuuacgaaguagagcugaagucuagauacaaacuauucaauuuuaauuugagguuacuguuuuaauuugggguuacaauuguuuuaaaaaaaaaauagaagggagauccuuuaaacagaaaaagguuacuuacuugggacauuuaauaauaugugcuugcuuuccaugagaauugcagggagcuagaagacaagaaaaagauucagaaucucuuggcucuugugggaacagaugcuggagaagugaccuauuuuuguaaggagccuccucacaaaguaaguaaucuuugguguagcauggugaguguggcuuuacaagucacaggcuaaggcccaucaucagaagaacuuuaguauccgcuggagaaggcagauggagaauuagccaucacagugccuuguuugccugaguuuuuaaagcauuuuucuucgaaaaccuugggaaguagcauuauuuaccccauuucaauguuuagaaaccugaagcacagagggguggcuguuuuagcugagacagagaggaaagcaggagcagacuaugugugggagcaaguuuugaugcuuaaguuucuuuuuaaaucuuuguuuauacugauuacaaauguaauccauggucuuuauuaaaaacaaacacagaguauaguaaucuaucauauaaaaguggcagguucucauaauccuauaccccagagauaauccauuaguaauaguuugguguauauacuuccaucucuuucuucauuccuauagaaauaguuaugugucuguguauacuauuucuauuuuuucacuucuauaaacaguuccugagcauuuuuauacauaucuguauacguauacuucuguuuucuaaagguccuuggccaagagcuacuuuuuuuuuuuuuuugagacaaagucucauucuguuacauagguuggagugcaaugcgcaaucucggcucacugcaaccuccgcucuggggcucaagcacuccucccaccucagccucccaagcagcugggacuacagguguacaccaccacgcccagcuaauuuuuguauuuuuugcagagaugggguuucaccauguugcccaggcuggucucgaacuccugagcucaagcaguccgcccaccuuggccugucaaagugcugggauuacaggcaugagccaccacacccaccaaagagcugcuuuuaaaaaaacaauaaaaauuuuaaaaaaauuuuagagcugaggucuugguauguugccuaggcuggacucacacuucugggcuuaagcaccauccuuccacuguagccagccuuccaaguagcuggaacuacaggggugcaccacugugccccaagcuguuuuuguuuuuguuuuuaaucauauauuacuaaauagcccugcaauuuuguuuauuuauuuauauuuauuuauuuauuuuucaagauggaguuucgcucuuguacaccaggcuggaguguaauggugcaaucucggcucaccacaaccuccgccucccagguucaagugauucuccugccucagccuccugaguagcugggauuacaggcaugugccaccacgccuggcuaauuuuguauuuuuuauagagaugggguuucuccauguugguuaggcuggucuugaacucccgaccucaggugauccgcccaccuuggccucccaaagugcugagauuauaggcaugagccaccgcaccuggccuuauuuuuauuuuuuuagaaacaaagucucauuuuguugcccagguuggagugcaguggagugaucauaacucacugcagccuuaagcuccuaagcuuaagcaauccucccaccuuagccuccugaguagcggggaccacaggcacaugccaccacaccuggccuaccuuuuuaaguuuauauugucaacacaggguuuuauccaguuugcuacuuugccuguguggucugucaugugcaugacauccuuauaugaucauaucaguuuugacuaauuuaacuucuaguguucaaucugcagaacuaaggcugaaaaguaaaauauuacguuuauaggaaggcuacuucaauaccaguuuuugcuucuucaggucaccauucuccaaaagacuauccaggcuguaggugaaugugagcagagugaaucuucagcuuucaaagcagguaacaaccauauaaccuauuagaaauucucaucaaugcagaauugaaaaucacagugcaggcugggcgcgguggcucacgccuguaaucccagcacuuugggaggcugagguugguggaucaccugaggucaggaguucgagaccagccuggccaacauggcaaaaccccaucucuacauaaaauacaaaaaacuagccgggugugguggcaggcgccuguaauccuagcuauuugggaggcugaggcaggaggauuucuugaaccugggaggcggagguugcagugagcugagaucgugccauugcgugacagagcaagacuaucuccaaaaaaaaaaaaaaaaaaacagaacacacaauuggaaauguuuuccuacuguacagugauaauugauguucauaaugaugccuuugguggucuaaugucuuaaugagcuucuugaaucauccaaggaauuaaauuuugcucaguucuuuuuuuuuuuuuuuuuucuuuugagauagaguuuugcuccuguugcccaggcuggagugcaauggcgcgaucuuggcucauugcugccucugccucccagauucaagcgauucuccuaccucaaccuccugaguagcuaggacgacaggcauaugccaccacaccuggcuaauuuauuguauuguauuuuacuuuguguaggaagggguucucacuaugucacucaggcugguuuugaacuccuggcuucaagugauuguccugcuuuggccucccaaagcacugagauuacaggcaugagccacaacaccuggccuuauucugaucgaauaggauuuacuaagaaaauagacacaacuauuuuagugguugauucuaaggaaaauuuagugguugauucugccagaagaugaauaugauuauuuaggugacauccugcagaguucccuuauagagauuccuauuugaaaaguuaagcacuaugauuaugauguuucccuuugucuuccgaaucccuucauuagugagaaccccuucauuacccuuacagguaaaugaaucugaacuccucugcgugggaaauacugauauuucaauagcacacagaaaagcugaguaaaaucuucuugauggauuuuguuuucuauuuuagauccuaaaauaagcaaaagaagaccaucgagagagagaaaagaaaguucugagcauuaccaaagagacauacagacacucauccuacagguaaagaauguauuuuggcagaccaagauggcuuuuauccacaggugcagcucuaugucacauacccucagugucaugugauaaguaucuccuugcacacagguuacaucuaagcaucaugugguuaagaaaauugagauuguuccuaauuucuaagagcuuauauuuugaaaccauccuuuucuauuugaacauucuuaaggugcuacucugaaccuucaauucaauauacuaagccccauccaccaaaaccauuacaagguaagaauucacuggccuagggauaugcagagauugcagagggaagcuugucuaugcugauagaucaacauuugaugguauauucauuuauuuagugcuuagguuccaaagucuaggaaaguaaugaacuguucucuuaccuccugguuaugugucauuuggaaccaugauuuuucaucuaguugcacuaaaguuucuguccuuacuguguuaaaucucuguugauuuaaaugacaguuucuaccuuuggccaguaucuccauguggagucaugacaaccagacacagagaaggaaauuacauuauauucauuuugcucugcuuuuugaaaccaaaaacuaagaaaagagucauuuugcuucugugcaggaagggugucuuaaagggagacagucaagggagauagugaaaaggcaaaaaucacagggugagaaaacuggauuuuguagcuuuguuuguguguuguagaugcuggguuucguuuggacaaagaaucuacucuuguauagccuaaccccauuuauaagacauuaagaggaacugggcugggcauaguaaugccuguaaucccagcauuuugggaggccaaggcgaguugauugcuggagcccaaaaguucgagaccagccuggacaacauagugagaccccaucucuacaaaaauuaaaaaugaaauuagcuggguguggugguacacaccuguaguccuggaggcugaggcagggaggacugcuugagcccaggggguugaggcugcagugagcuaugaucacgcccacugcacuccagccugggggacagagcaagaccuugucuugaaaugaacaagaggauuaggauugagauguuuuuguuuguguuuguuuuuuaauuuuucuggagaaaggcucacuuuuccuagagguaugaaguaaguggaaguagggcuggauuccucaccccuuuuuggccugucuagguggaagcacugcaggcucagcugggagagcagaccaaacuuucucgagaacaaauugaagggcucaucgaggacagacggauucaccuugaggaaauacaaguucagcaccagagaaaucagaacaaaaucaaagagcuaaccaaaaagugagugucuaagaaagcuguaccuaacggguauuguauuuuucugagugacuuaaaaguuaacauuuuguacuugaacaacagcgggucauagaacuaaagggagccuugaaaagacugucuuccucagaaacccccgccucuacguaggugaguaccucgcuuuuccaggcgugcuguugaagagcugaugaguauuucacgugcuccuuuuaauccauuuugguguuuuagcuugcuucugguggcuaagaaguguucuuaggccgggugcaguggcucacgccuguaaucgcuccugccugggugacagagugagacccugucucaaaaaaaaaaaaaaaguguucuuuuauccacugauauacuaucugacucaauguaguaagacccuuuucuuuuguuugccccuucaugaauauggaaaacaugaguuuacauaucuaaaaaaaacugcacacucaguauuuuaaucagaacucugccggugcuuuuaucuagagacauguuaucauuuuuggcuucuaugaaauuuuugucccaagaaaggcaggauuauauuuuuuucuaacagauugaguugguguaguguauucuugguuaucaaaauacucauauagcuuugggauuuugaauugguaaauaucuaugaugugugaaacagcaugauacauacuguacgaucucaagcccauaaaauuggauguugugucuacacacacgcaggacguagaacguccuguaaacuuuacaguuuacaaacuguaaagugcuucugauuguggaugacuuuguucuuugcuucuuguguguuuuaguuuccuauaaugcacauacuuuaaaaaaaaaagguuauuuuuaaaaucugaaaaaauaaaaacaaaaaauggcaaacucuguccucauuguuuuuguuccuaaccugcuuaccuuucuuuaccugucugcagucugacuucauccccaccauuuuacuaaacaugcccuuucugggguucuggggucaccauugaccucuuaacuuuucuuucuuuuuuuuuuuuuuuuggagacuaagucucacucugucgcccaggcuggagugcaguggcgugaucccgguucccugcaaccgcugccucccagguucaagcgauucuccugccucagccuuccaaguagcugugauuacaggcaugugccaccacacccagcuaauuuuguauauuuaguagagacggggugucacuguguuagccaggcugaucuagaacucccaaucucuggugguccacccgccucagccucccaaagugcugggauuacaggcaugagccaccacgccuggccuaccucuuaacuucugagaccaguuauaucucuucaguucaguccuuauuauacuuaguaucuuccugcauguuuggcaucacugaucagccccuccuuguaauucauuucccuugauuucugcagcaccugucuuucuugguucuucuaccuaucuaaccccuucacccuuuugccugguuccaguggccagaccuaugccauaaggacauccucaguugaauguguuugagcaugucagauuuaccauuacugaaaccacgcuguuguuucucccaacaaaugcucccauccccgucucaaaccuacuuuucuguuuuucaucuaguuucaugguaucacauguauuccguuuccaaaugcucccauccccgucucaagccuacuucuuucuguguuucaucuaguuucaugguaucacauguauuccguuuccaaaugcucccauccccgucucaagccuacuucuuucuguuuuucaucuaguuucaugguaucacauguauuccauuuccaaaugcucccauccccgucucaagccuacuucuuucuguguuucaucuaguuucaugguaucacauguauuccguuuccaaaugcucccauccccgucucaagccuacuucuuucuguguuucaucuaguuucaugguaucucauguauuccguuuccaaaugcucccauccccgucucaagccuacuucuuucuguguuucaucuaguuucaugguaucacauguauuccguuucccaagcuugaaaccacaggaucaucuucaacucuuaacuuucuuauuccuuaauuccaaacccuaugaauuauaagccuaaaaacccccucaaguccauucucugcucucugauauaggcaguucuacauggagcacaacauacacaaaagcaaagcuguuuuugauacuacagaacuuguguuaacuugucagaacuccacaacuuaguacuuccuugucuuauuccuaggaaugguccauacuuaugcaggcuauguguaaauaucccuguaguccuucuaaucauauaacccgaaguuagcacucaggaaaauaucuccugucugauuguuuuguuucauuuuuuccaguaaagacagggucuuacccuguugcccaggcuggagugcaguggugugaucauagcuuacugcagccuugaacuccugggcgcaagcaauccuccugccucagccuuccaagucgcuaggauuacaggugcauaccaccaaaccugguuuauuuuuauuauuuuuuguagagauggggucuugcuauauugcccaggcuagucucaaacuccugguuucaagcaauccucucaccucagccuccugaagcacugagauuacagacaugagccacugugcccagccuugcacucucauucuuaguacauuaauucaaacucuauuccuuuguuuaaauuguuccuauugcugauccuuugucuuuuuuuuuuuuuuuuuuuugagacagagucucgcugugucguccaggcuggagugcaguggcacaaucucggcucacugcaagcuccgccucccggguucaugccauucuccugccucagccuccugaguagcugggacuacaggcgcccaccaccacgcccggcuaauuuuuuuuuuuuaauuguauuuuuaguagagacaagguuucaccguguuagccaggauggucucgaucugaccucgugaucugcccgccucggccucccaaagugcugggauuuccuucuuaguagagacaggguuucaccauguuggccaagcuggucucgauccugaccucagguaaccugcccaccucagccucccaaaguguugggauuacaggcgggagccaucgcgcccggucugcuauguuucuuuuaacauaguauaauguguuugcauuuggccaguauuucuccaccuucauuuuuauuuuuaguauuuuugcacuuaaguauagcaucuugacauuucaauggguuuuguuuuuaaggaacagauauuuuaauauugucauaguaauuuguaauuuuauaucuguuuuccagaauaccaguaaccuuccuuguuuagcguuaucugcauaucugagcacaugaucgguuccuuccauuagauggaucuuccuaagaagggcaugaaauccagggccguuaaugacugcccuuuggguaucacuuucaagcuacuuguauuuuaacaagccuauaguuucccaguuugagauugagaagauaauguaagacagaauaaaauaacucauugaaagugagagagacccuugugguaauugaaucaaucucucucuacauacacaugcacacauaccugacuguauauauucaccuugugacauuuacucuacugugugcuuggcacucugcugucauuuccucuuaucugugcacucuguuacucaugaaaauaaguggaucucacauuauuuguuugguagaaaaauacagugauugcuucaugguauuuaauacucuugcaagcagccagaucauucaguauagcauuuuucugggugguaauguuaaacugaugaguugcuaacuuccagggauauuguuuuuuaaagauagagacguugucuauuccuaaauuucaggaaauagucaccaugaaucuguuaacugccuguguauguccaguaguuaguauuauccuugacaaucucauggcauuggggcaaaaauaauaaauaagguauaugcuuucacucaggcugggaaaaagugcauguugacaguuaaaauaugacagaugagcaaguguugaauuauaagacaagggaacauuaaccugggauggaguuucagagaauggaggaauuaaaauaggcuaaaguuguuggaaaugacuucauacaggaaguugauuuuuaaaaaaguaggccaggugcagugguucacacuuguaaucccaguauuuugggaggcuggggcgagaggaguguaugagcccaggaguuccagaccagacaagccuaaggaacauagcaagaccccaucuccacacacacacaaauuuuuaaugagcuggcaaacacccugggagguggucccagcugcuuaggaggcugagacagaaggauugcuugagcccagaaggucagggcugcugugagcugugaucgugccucugcacuccaaccuacgugacagagcaagacccugucuuaaaaaaaaaaaaaaaaaaaaguucuuuuuaaaauaaacaaaggauaagauuuugauauaggcaguucuacauggagcacagcauacacaaaagcaaagcuguuuuugauacuauagaauuuguauuaacuugucagaacaccgugauuuaguucuuccuugucuuauuccuaggaaugguccauaguuaacgcaggcuauguguaaauaucccuguaguccuucuaaucauauaaucugaaguucgcacucaggaaaguaccuguaaagaccagucuaugaaccagugagcauggguagauacauuauacuuuacccaguaaaacauguaagauugccagugaucagauuuuuaaaccugcuaauauuuuacaaaauuuauauaucacaccauuuuaaaagaaccacucucuuccauuuuggaauaauccuugcuuucaggugugcugugugcgcauccucaugucugcauuuauacuuucuuuccuagucuucaccacacccaagaacugcucuaugagagcaccaaagauuuucugcaacucagaucugaaaaccaaaauaaagagaagucauggaugcuugaaaaagauaauuugaugucaaagauuaagcaauauagggugcaguguaagaagaaagaagauaaaauuggaaaaguguugcccguuaugcaugagagucaccaugcucaaagugaauauauuaagguaauguccuuaugucguaacgaaguuguuuauuuuucugggagaguugaaggaauuccaaagaaccuacaauuuguaauguaagauccauucaguccaggaagcucugguagcagcugccucaagaacuagguuucaaagagcagcugaucguuguaguauuuggggauucaaaauauuagacuuguugauucauucauucauucauucaacaaauauuuauuguacuccuggccgggcacagugguucacgccuguaaucccagcacuuugggaggccuaggugggcaaaucgugaggucaggaguucaagaccagccuggccaacauggugaaaccccgucucuacuaaaaauacaaaaaaaaaaaaaaaauuagcugagcaugauggugggugccuguaaucccagcuacuugggaggcugaggcaggagaauugcuugaacccgggaggcagaaguugcagucagccgagacugugccacugcacuccagccccgaugacagugcgagacugugucucaaaacaaacacaaaaaaacauaaauauuuauugcacucguacuauggguuaggcccuagaguuacaguaaucuaaacaaggucuucccucaugguguuuacauuuuaaugggugagaaaaaacagaaacauuagcaaauaacuaagaaaauuauagauuaggccagacgcgauggcucacaccuguaaucccagcacuuugggaggccaaggcggguggaucaccugaggucaggaguucgagaccagccugaccaacauggugaaaccccgucucuacugaaaauauaaaaauugguggggcgugguggugggcaccuguaaucccaguuacucgggaggcugaggcaggagaaucaccugaacccgggaggcagagguugcagugagcugagaucaugcgauuguacuccagccugggcgacagagugggacuccaucucaaaaaaaaaaaaggacuuugggaggcagagguggguggaucacgaggucaggaguucgagagcagccuugccagcacagcggaacccugucucuaccaaaaauauaaaaaaauagccaggcgugguggcggacaccuguaaucccagcuacuugagaggcugaggcaggagaauugcuugaaccugggaggcagagguugcagugagccgagaucgcgccacugcacuccagcccagugacagagcaaggacuccgucucagaaaaaaaaaaagaaaaaauuauagauuauaaaaugcgguauuaagggaauaaaagaauuacaugaaaauuauauguaguugcuggaaguccauuguauuaauagaaggaaugcacagggacacucucuuauaucuaguguuucugcugagaccugaaaaaugggacuaagcuugccauacagaccuugaggaagaacauuccuggcagagggaagagcaaguuuauaggcccuggaguauguucaaggaaauggaaggcugucaucaugguuguagaggaauaaauaaggaggaagugguaugcucuuuaagaagccagcauuggcagcagccaguuguggagggccuugugcaucaucguauggagugugaacuuagcucucaauaguguuauguauuugaaggguugugugaaauaaguaacaugaucugauuuggguuuuuaaaagaucauuuuaacugcucaauagggcauguauaauaagcguuguuguuaauauuucuuccuuuuuaaagaagaacuuuagaaauguagcccaaaacauauauuguaaugucuuccuugggacagcuucugagcuccguuaucugagucuucccagagccaaaaauauuuguuuuaauuuuuacuguguacacuuuagaaaaagggcuuaagagacuggucuagaaguagauuuucagauguuccucaaaguuccuugucaucugguuccuuaacucauuuuguaccucuggaaaucccuucuuuucuuucuuucuuugccuaaaagcuacuugaauuaccugaauuguagaacugaguguuaauguuuuuugucccuuugacuuguagucccuaaaagauaaguuaguacaagagaaaaagcuguccaauauguaccaagagcagugcauuuccuuagaagaagaacuugcccgaauucgugaggaagagggaaugaggagagagaucuucaagguacgaaauuaucugccacuuguaauggaauaggaagugcagauggcuggggaagacgcuucccucaccuucguaaaugccuucccauuccccauauuuaggaucgcacuaacaagauggggaagcguuuacagauaaugacaaaacgcuaugaggcauuggagcgucgacguauccuggaaguagaaggcuuuaagacagauauuaaaguucuccgacagaaacugaaagacuuggagcaaauguuguauaagguaauugcugguccugaauugccacgagggagagaagagguguaagugagggaacauggucacgagggccccugaaaagaaggaugugcuguuucccugcugguaaacacuaacagaucaccaucuucaagccucccugaaaauuaguucaagaacaugcuagagggaaaauaaaaagacccugaaaucauugaacgacugcaucauucauacuucgauguaagcuaaacagauugucaucccuccuaauucaagaaguagauuaaagaaucgugucugucuuacaguuggggagggugaguaauugagugauagaguacuuuuuuccagcagacacaguucuuuagaauacaagucgccucaagagucuucuuaaugagauuuagccaguuagccuguguuccagacaagguuaguugcagaaaagaggagacgccugcuuucauucugugacaaacuuaccaguaguguugcgcuuucauucugugacaaacuuaccaguagugucgcuuauccuggccucucuuacuccucuuucauggugcauugaucucuaccucaagccuccuuuauugcaugggaaggauuuucaugagauuucugccuuaauucuacauuuuccuucuuuaguuagccacugaacaaaggauggaauuuauccuauguacucaaaaucucacaaaaaggagcuagcauagcugugucuuuuugacugauaucgcuccccuggcauaugccaucaucauuucuuuuuuuuuuuuuuuuucaaaccccuaggcaacaguuaaugcccgggcaaaccaggaucuugcccuucugugugagguccgugacagcaauagacgggcacauaagauacaaggagaacugaagaaucuuaagucgaaaguguuuggucuggagaaugaacuuagacucuguuaaugucuacuuuuggaaauggcccccauuuagaagaggugugcuucuugaaaccugaggacaaggucaucugcugccagaaaauguaaaccugaguugacuagaguggugguauucauuauuguaaagacagcuugaagaaucggggaccacuaggaaagcuuuucuugcauacucagcuugcuuuaucauuuuugcuguccuuuuaacacuugcgaggaguaggggccugguccugaaugacuuggaggcuuucauuauuuauccugucuguauugaccgguuuuuguuuuuucagaaggcagugaugaugaaaacuuaggaagaagguauuuugcaauaagcuuggcugaguguccaugggaagaauacuuucccuaaagagagagaagcacucacagaggcugccuuucuccugagcucggggagaaggcagcacaucacaaccugucacauugaaauaggcgcucauucugcuauuucaccuuccguccugagcagagccugaauuacguuuuugggcaauuucaugguguuucaccagagggcgcuagagacucaaacgaaauguccaucuggaaagauucgggagacacuuugccgaggggaugaagcugagaugaugcuuguauggaaaguuugauauuuuuaucagucacauggcuuuugaaaaaugauguauauauuuuaaauuaacuauuuucaauaaaauauuucacucaa

SEQ ID NO: 191687 - RNA, 36686 nt, Homo sapiens
cucuucccauuggcugagaagggucaugaggaugaacugugcagucaccuggcaggaaccggaacccgcgguuauaaaguaaaggaacccgagaucugcgcagggguucccuuugccgauuucucucaccucaccuuucaaaccuaaacucgagccuacuguucaccggccuagcauugcucucgccauggcucucagcgaugcugacgugcaaaagcaggugaggggcuugguugggucuuacgaagccgcggcggcagucccggggagugggcuggagcccgccuagggaaggccgcgggccuugagccgcccagaugccgcaggaaggucccuugcuccaagucaccagauccaagaggucggccugaggacggagauuugccccgcagcucaugugacuuuugcucgggucuugggcacugcccgcuugccugcgcgcugccuucuugaacgcccuggcucuuugccucccaccucagcauucccuguuuuccaaggguauucacugugccuagucggacagagaucugugcaaggauugaaaacagccuuguggccaggggcaguggcucacgccuguaaucccaguauuuugggaggccgaggcggccggaucaccugaggucaggaguccgagacuagccuggccaaaauggugaaaccccggucucuacuaaaaauagaaaauuagccggacgugguggcgcgcgccuguaaucccagcuacucgggaagcugaacccggaggcggagguugcaguuagccgagaucgcgccuuugcacuccagcaugggcgacagggcgagacucccucuggaaaaagaaaaaaaaaaaacaaaccagccuugucacuuuuuuuuuuuuuaacccugagggaaaugcuuaaggcuauaugauaggaaacagugcggagggaagagaccugcuuccaaccaguguuuugacaaggucguucacuuuaugaacuguguuuuuuucuuuuuuucuuuuuuuuuuuuuugagacggagucucacucugucgcccaggcuggagugcaagggcgcgaucucggcucacugcaaccuccgccccggguucaagugauucuccugccucagccucccuagaagcugggauuacagacucgcgccccaagcccggcuaauuuuuguauuuuuuuuaguagaggcagggucucaccauauuggccuggcuggucuugaacuccugaccucaggugaucuucccaccugggccucccaaagugcugggauuacaggcaugagccaacgcgccaggccuguauguacuguuaaucuucauuuuggggaaguccccucuaucauaauggauuguaaugauuggucucccacuaauguguguguuaacauuugugagauacaggcuggggccgggcaugguggcucacgucuguaauaccagcacuuugggaggcugaggagggcggaucaccugaggucaggaguucgagacgagccuggccagcauggugaaaccccaucucuauuaaaaauacaaaaaauuagccgggcaugguggcgggcgccuguagucccagcuacucgggaggcugaggcaggagaauggcgugaacccgggaggccgagcgacccugggcggcagagcgagacucccucucaaaaaaauaaaaaaaaaaagauugucugggccuaguggggugcgccuguagucccagcuacucaggaggcagaggcaggagaaucgcuugaacccggcaggcggagguugcagugagccaagauugugccacugcacuccagccugggugacagagugagacuccaucucaaaaaauuuuaauauuaauaaacacaaauacacgccaggugugguggcucacaccuguagcccccagcacuuugggaggcugaggugggaggaucgcuugaucccaggaguucaagaccagccugggcaacauagaccuuaucucuaaaaaauuuuuucuuaaaaaauaagccaggcugucugggcaugguugcucaugccuguaaucccagcacuuuggaaggccgaggugggcauaucaccugcggucaggaguuccagaccagccuggccaacguggcaaaacccugucucuacuaaaaauacaaaauuaguggggcgugcuggcauaugccuguaaucccaacuacuaggaggcugaggcaggagaauuucuugaacccgggagguggagguuauggugaggcgagaucacaccauugcugccugggcaacagagcgagacugucucaaaaaaaaaaaaaaauugccaggugugguggggcacacaugugcuccuagcuacuuagggaggcugaugugggagaaucauuugagcccaaggggucgaggcugcagugagcuaugaucaugccacugugcuccauccugggugagagagcaaaagacccugucucuaaaaauauuaaauaaauaaacaaaauugugucaaauggaagaccgcuuuuucuuuucuuucuuuuuuuuuuuuuuuuuuuuugagacgaagucucgcucuguugcccaggcuggagugcaguggcauggucuccgcucacugcaagcuccaccuccuggguucaugccauucuccugccccagccucccgagaagcugggacuuacaggcgcccgccaccacgccuggcuaauuuuuucuauuuuuuauuagagaugggguuucacuguauuagccaggauggucuugaucuccugaccucguaaucugcccaccucggccucccaaagugcugggauuacaggcaugagcuaccgcgccuggccaggaccccuuuugcuuacauuuaggagccucaaugccuaacgguguuuggcaccaaguagauguaucagaguuuaugggaaaaaauuguuguggaagucgugaacccacaucaguuuucaaaguguaaucaguccugggaaacuuuuuuuuuuuuuuuaagugccauaccuucaagucuguagguauuaagaauuuugucaugcaaaagacucucaggggaauauaguagcaguuuauaagccuauaacuaacaaaucagaauccuugcauuuaguaaucauauugccgauagauuuuucagagaaggaaguuuaaggcugcaguuuuaauuugcacauaguuuagagaacuaaguccuuuuuuuucugaaguacugugcuaggaaaauucucuuacuaaagcacacucacugucuuaugaaucuucugagaugagcaauaaaauuuuuuccuggccggcucacgccuguaaucccagcacuuugggaggccgaggcgggcagaucaccugagguugggaguuugagaucaccugagguugggaguuugagaccagccugaccaacauggagaaacccugucucuacuaaaauucaaaauuagccgggcgagguggugcaugccuguaaucucagcaacuugggagccugagacaggagaaucgcuugaacccagagguugcagcaagccgagaucaugccauuguacuccagccugggcaacaagagugaaacucggucucaaaaaaaaaaguuuuucguuggauguuuccauuuccuugaaagugucuuuucauuuuauucuuaaccuaauaugcacuaagacgaguggguauuucuucuucauuuugugguucugcuaaugccaaaggguaaauagagaugacaaaauuaguaucuauggagaaguuuaagaaaucauacaauauucuuacagaaccaaaggguuuuuuuaaaccuuuuucacugcuucuucuguucacugcuucuucugcuucuuucaauauaggaaaagcuugaugcaguggaaaaguaaaaugcccuccauauacucuuaguggccacagugcuaauucucucccucuuguucccuuucuucccuccuugucauaauauauugaagacuaaggcuuccauaggaaaagcuaguauaaagauaaagcuauaguuccuuggaaucuagaucaaaaugauuuuuuuuuuuugagauggagucuugcuuugucgccuaggcuggagugcaguggcgcgaucucagcuugcugcaaccucugccuccuggguucaagcgauucuccugucucagccucuccaguagcugggacuacaggcguaugucaccacacccggauaauuuuuuuguauuuuuaguacacaugggaauucgccacguuggccaggcuggucuugaaccuccgaaguggugggauuauaggcgugagccacugcgcaugaguuauuuuuucuuuuuuuugagacagucucgcucucuugcccaggcuggagugccauggcgugaucucagcucacugcagccucugccucccggguucaagcgauccuccugcaucagccuccugaguaccugggauuacuggugcccgccaccacacccagcuaauuuuuguauuuuuaguagagaugggguuucaccauguuggccaggcuggucucgaacuccugaccucgugaucugcccgccucagccucccaaaguauugggauuacaggugucagccacugcacccggccuauuuuuuauuuauguaaaauugaaagaaggaaucuugucuauuuccuauaauccuucaugcuacaugaaagcucgaugaggacaguguguguuguuuacuguauucucauaaguaaauagaugaagcaccaagcccauaguagaugcuuaauaaauccugaauuuucugacuucuccauugcaugaaaauauuuguguauauuugcuuuuuuccuggggaguaugguaauuuauuucaucaaauuuacaaagaaaccugacucuaaaaaccuuaauuacugagcaggaagaagaaacuguuuuuuuaaaggucaaauuuucugccuuagggguggaguuaaauguccuuaaaggguugacuauaucucuucuuggaacucuuaaaagaauaugaucauguuaacuguaaauaggcuucugaccuggguuagaauuagcgcaguuugcucuaggcugugcuggucuggucaaaucugguagccaagggugcagcagagugcuaaaggcagauaauccagguccgaaucaggguucaccuuuagaggccaaacuuguagcauuuauaaacaccgguuuugauuacuguauuuaguuaaaugacuuuuuuuuuuuuuuugagacagagucuugcucugucacccaggcgugaucuuggcuugcugcaaccuccaccucccagguucaagugauucuccuccaucagccuccugaguagcuaggauugcaggcacccgccaccacgccuggcuaauuuuuguauuuuuaguagagaccagguuucaccauguuggucaggcuggucuugaacuccugaccucgugauccacccggauuggccucccaaagugcugggauuacaggcgugagcccggcuaguuaaaugacuuaaaauuccagauagaauaaguucagugagacuucaaacuaaacuuguagacaccauuaccaugaccccucuccauacucccaaauuuguggagcugaucuuuuaagcaaggucagugauuucccacacaucuaggucuggauuagguaccccaaguauuucaaggcucaagauauuguaaguaccauguuaucuauaacauagguuugaucaucauaacuuuuugucuccuuaaaaguaggauuggaaacacgaugguggccacagaaguuggaauccacugaguguguaacaacucaccugccaaaauaagaaaaaaaagaaaaguaggguggcuccaagauuuuugauaaaacaaaaaaacugucccuucuaaaauccuccuauauguuuuuuguuucauuuuguuuuguuuuuuuugagacggaguuucgcucuucuugcccaggcuggagugcaguggcacaaucuaugccuaccacaaccuccgccuccagguucaagugauucuccugccucagccuccugaguaacugggauuacaggcaugcaccaccacgccuggcuaauuuuuuguauuuuuaguagagaugggguuucuccaucuuggccaggcuggucucaaacucccaaccucaggagaucuacccaccuuggccucccagggucuugggauuacaggcaugagccaccauacccaggcaguaguguuuucuuuucuuucuuuuuuuuguuucauuauacuuuaaguucugagauacaugugcagaaugugcacagguuuguuacauagugauacgcgugccauggugguuugcugcacccaucaacccaucaucuacauuagguauuucuccuaaugcuaucccuccccuagcuccccacccaguagugcuuucuuaauucguuuugguacaccuauguauacuuaagauuuaugauaucuuguguuauauggagaagcugcuauggggauuguuuacagauuguuaaacccuaaaaaguaccugggauaccuuguauuccuuagaagucuugaaacucccaacagauuugcauucauucacaaauuuuuuugagcaucuccuaugguggugguuguuccauguucuggguucacacuggcauaaaagacaagaucccuguacucaguggugcuuaccuuuuagugggauaauuaauaaacaaaaugaauuaaugaccuaaagauccuacgucaauuuuuagcuuuuuuuuccuuuuuggauuucaucacucccuuaggaaaugaagcuaccauugcaucccacaaccagugaguuugaugagcugugucgguuggauuuuuacuuggguauauuuuauaucugccacaagagaugauacuucauuuaugagucuaaguuggauuauuccccaagccccauucggaagccuucauuggacuuuauucuccaauuguagccggugaucuaggaaccuuuaacaaguuccuagccucauaguucaguugaggauagggacaaauaagcaacaauuacaaguuuaggugccgugauagaggaaguacaaaguacucuagguacaggaaagauuucccuaaggaggugauaguuauacaagcugaggcccaaaaaguuagaaggaagaauguuccaaauggaaggaacagcauguuugaaaucuuggagaugagaaagaauggugagcucaaggaacugaaauaaguuuaguaugguaggaacuaagagucugaagauggugaguagugaaggguuuguuguuucauaugaugcuugaaagguaagcagugggcugaguacggugacucacaccugaaaucccagcacuucgggaagccaaggcaggaggaucgcuugagcccaguaguucaagaccagccugggcaacauggcaaaaccccucucuacaaaaaauacaaaauuaagcuggacguggugacacgcaccuauggucccagcuacggggggaucgcuugagcuguagaaggcggaggucaaaaugaggcgggauugugccauugcacucuagccugggagacagagacccugucucaaaaaaagacagauaagcagugauaagauccuguaccuucuaaaaucuuuaucuuaagcggggguagaguguuacaugauaagauaggcauuuugaaagcaucucucugguggcaauguagagucgauuagaaacaacaagaauagcggcaggaagacaaauuuggaagcuguuguaguaguuuagcugagaggagaugauggcaaggacuaugguagucccuccgaugauggagcgaggugggcaagguaaagaacuauuuuuuuuuuugagacagagucucgcucugucgcccaggcuggugugcaguggcgcgaucucggcucacugcaagcuucgccucccggguucacgccauucuccugccucagccucccaaguagcuggaacuacaggcgcccgccaccacgccggcuaauuuuuuguauuuuuaguagagaugggguuucacccuguuagccaggauggucuggaucuccugaccucgugauccgcccgccucggccucccaaaguucugggauuacaggcgugagccaccaugcccggccgguaaagaacuauuaagagagaauuaauagaacuuggugauugcuuggauauaaggacugagguaggaggaauagucacaguuggguguuggugcuaaucccugagagagagcucaaagugagaaguggggagaggaguggugagcaguucaguauugaauguguugaauuuaaauuacuaugaguaggauguucaaaaagagcugucuaggaggcagaguggaagaguauggccccaaaagaguggaagaguauggccccaaaggagacuggaaaggagaacaggaggaagucacggacgcaaagggaagauuguuaaagaagggaagguugcucgccgugcgcgguggcucacgucuguaaucccaguacuuugggaggcugaggcgggcggaucacagggccaggagaucgagaccauccuggcuaagauggugaaaccccgucucuacuaaaaauacaaaaaauuagccaggcaugguggcgggcgccuguagucccagcuacucgggaggcugaggcaggagaauggccugaaccugggaggcagagcuugcagugagccgagaucaugccacugcacuccagccuggguggcagagcgagacucugucucaaaaaaaaaaaaaaacaaagggaagguugcugaacacaucaacugaugcugaaagaucaaguaagaaaaggccaagaucaaggggcgaggagauggucacuuuaugagagaacugucaguggaguacagagaagggugcaagugagacugcaguguugagagaaagguaguaaaguugaaagaguaaguauagauagcucuucagcauacuuucuuacagguggagaagagaaagggagggugcuggcuaacuuguauuccaaguuccuugagaggaggaugaagguccuauuuaucuguguuauugaguauuguaucuggucuauuuucuugaacaaauuuuagauccuaaguuuccugagaauaggaaugaucucacuuauccuuguacucagagccuagcacaauaugcauucaguaagugauugacuuuuuuaaauuuuuaguagagacgggguaucuguguuguccagacuagucuccaccuccuggccuaaagcaauccucccuccuuggccccccagagugguaggauuacgggcgugagccacugcaccuaccuaugauuacuuguucaaugaaucagaaaagauauuuccauauuuuugaacuaaaaaauaaaacuuuuuuuccuuauagauaaagcauaugauggcuuucauugaacaagaagccaaugagaaagcagaagaaauagaugcaaaggugagauucauuuucuaguuuuaagaaguuaucaagguuuccauauuguuuugcuuugcuaaauaauauuguuaguaaaacugcuuaacaacagauugcaucggacugauaaaaaugucucuuccuucccuccuuccccuccuuccuuccuucauuuuuuuuuuuuuggagaccgaguuucacucuugucgcccaggcugaagugcaauggcgcgaucucggcucacugcaaacuccgccucccagguucaagugauucuccuaccucagccucccgaguagcugagauuacaggcaugugccaccaaacccagcuaauauuuguauuuuuaguagagacgggguuucaccguguuggccaggauggucucaaucucuugaccuugugauccgccuaccucguccuccccaagugcugggauuacagguaugagccacagugccuggccccuucuuucauuuugagacagucucgcuucgucacugggacugcagugcaguggccugaucucagcucacugcaaccucugccucccggguucaagugauucuccugccucagccucccaaguagcugggacuacaggcaggcaccgucacaccugucuaauuuuuguauuuuuaguagagacaggguuucaccauguuggccaggcuggucuugaacuccugaccucagaugauccacccgcuugggccucccaaagugcugggauuacaggugugaaacaccgugcccagcccuauuuauuuacuuuuuuuuuuuuuuuuuuuuuuuugagauggagucucgcucugucgcccaggcuggagugcaguggccagaucuuggcucacugcaagcuccaccucccagguucacaccguucucuugccugagccucccgaguagcugggauuacagacacccgccaccacgccuggcuaauuuuuuguauuuuuaguagagacaagguuucaccacauuagccaggauggucucgaucuccugaccucgugaucugccugccucggccucccaaagugcugggauuacaggcaugagccaccacacccggccuuuauuuacuuuuuaauuuaaauuuuaccuuaauaaauuccucauuggaaaugucuguaucuuuaacauuaaaaaauaaauuuuccuuucuaaugguugugaugccaauaaguguccugaaauuuuauguuagaggguagaaaaguaauguaugauucauuuucucauggaaaccaaaauucagauauuuaacaaccguggcgaacugugauaggugacuagagaagguuguaguguuucauuguuuagcuuuuuuguuaaucugugcucauugcaaaaaaguaaaguuugggcugggauugguggcucacgccuguaaucccagcacuuugggaggccaaggcaggcggaucaccugaggucaggaguucaagaccagccuggccaacauggugaaaccccgugucuacuaaaaauacaaaaauuagcugggcaugguggugugugccugucaucccagcuccucgggaggcugaggcgggagaaucgcuugaucccagaaugcagagguugcagucagcagagaucgugccacugcacuccagccuggacgacagagugagaccuugucucaaaaaauuaaaaaauaaaaaauaaaaaguuuggaaguauauaggguauaaaaugaaaaccccacccauuacaaaggugaccuuccaucagcauuuagaaguuuuauauauauuuccaguuguacauugcuuaugccaauuuauauuccuuaacaguaugucaaaauguucuuuucccaagguauaaucauaacacgcauuuuuuaaagcuugccuuaaaaauauuaccaaaauauggccggggcgguggcucacaccuguaaucccagcacuuugggaggccgacacaaguggaucaccugaggucaggaguucaagaccagccuggccaacauguugaaaccccaucucuacaaaaaauacaaaaauugguugggugugguggugcacgccugcagucucagcuacucaggaggcugaggcaggagaaucacuugaacccgggagguggagguugcagugagcugagaucgcaccacugcacuccaucuagccugggugacagaguaagacucugucucaagaaaaaaaucaguaaauaaaauaugaccaagauauauuguuuaauauuuucauuguccuuuuaguacagccuuaaauuuuuaugugccugguacucuagaaauaaaacucucugaaaccuugggcuauuugacuaguuuaucauuugaagaagaaaagacuauuuucccucucacuaauacauaacagcugauaggauauugcuuaauauuguuuugauggugauaguuucuuguaugacucuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacacccggcuaauuuuuuguauuuuuaguagagacgggguuucaccguuuuagccgggauggucucgaucuccugaccucgugauccgcccgccucggccucccaaagugcugggauuacaggcuugagccaccgcgccuggccucuuguaugacucuuucuggaucaaauacagaaguccuauuucagcuauuauuucaggaaaugcauuucuuuuuuuuuuuuuuuuuugagccggaguuucauucuuguugcccagacuggagugcaguggcgcgaucucagcucaccacaaccuccgccucccgaguucaagcgauucuccugccucagccucccaaguagcugggacuacaggcgcaugccaucacgcccagcuaauuuuuuguauuuuaguagagaugggguuuuacuguguugcccaggcuggucuugaacuccugaacucaggcaguccaccugccuuggccucccaaagugcuaggauuacuggcgugagccaccacgccuggccucaguaaaugcauuucugucucaaauauuuauuuauuuuauuuaguuuugagacggagucucccucuauugcccaggcuggagugcaguggugcaaugucggcucaccacaacccccaccuccuggguucaagcaauucucuugcuuuagccuccugaguagcugggauuacaggucccugccaccaugcccagcuaaauuuuuuauauuuuuaauagcgaugggguuucaccauauuggccaggcugcuguggaacuccugaccucaugauccuccagcuucagccucccaaagugcugggauuacaggcgugagccaccacgcccggcuuuuguuuguuuguuuguuuguuuguuuguuuuuugagauggagucuugcacugucgcccgggcuggagugcaauggcacgaucucagcacaccgcaaccucugccucccagguucaagugauucuccugccucagccuccugaguaccugggacuacaggcaccugccaccacgcccagcuaauuuuuuguauuuuuaguagagaugggguuucaccguguuagccagggugaucuugaucuccugaccucacgaucugcccaccucagccucccaaaguguugggauuacaggcguuagcuaccgcgccaggccaauuuuuguauucuuaguagagaugggguuucaccauguuggccagacuggucucgaacucuugaccucaugauccacccgccuuggccuuucaaagugcugggauugcaggcgugagccaccucuaucgcccaggcuggagugcagcaguguaaucucugcucacucuaaccucugccuccuggguucaagcgauucuccugccuuagcuucuggguagcugggauuacaggcgccuacccaggcccagguaauuuuuguguuuuuaguagagacgggcuuucaccauguuggccaggcucgucuuggaacuccugaccucaagugauccgccuaccucggccucccaaagugcugggauuauaggccugagccacucuaccuggccuguuuacguauaauaaaauaauguauaauaaaauuuauguauaaaaaaauuaauauuuuuuuuggauggagucuugcucugucacccaggcuagagugcaguggcaugaucucggcucacuguaaucucugccuccuggcuucaagcaauucuccugccucagccucccaaguaucuugaacuacaggcgcccgccaccacgccuggcuaauuuuuguauuuuuaguagagaugggguuucacuauguuggccaggcuggucuugaacucccgaccuugugauccgccugccucagccuccgaaacugcugagauuauaggcgugagccauggcgcccagcccauaauuuauauuuuuaaauauaugcgacacuuacccaugagggaaaaaaaauuuuuuuuuuuuuugaaacggugucucgcucugcugcccaggcgcgaucucgguucacugcaaguuccgccucccggguucaugccauucuccugccucagccucccgaguagcugggacuacaggcgacugccaccacgcccgccuaauuuuuuguauuuuuuaguagagacgggguuucaccauguuagccaggauggucucgaucuccugaccucaugauccgccugccucugccucccaaagugcugggauuacaggugugagccaccgugcccaggcaacuuuuuuuuuuuuuuuuaagaguucgcuuuuguugcccaggcuggagugcaauggcgugaucucagcucacugcaaccuccaccuccuggguucaagcauuucuccuaccucucccucuugaguaucugggauuacaggcaugugcccaccaugcgcggcuaauuuuuguguguguguguguguauuuuuaguagagaugggauuucuccauguuggucaggcuggucucgaacucccgaccucaggugaucugcccgccucagccccccaaagugcugggauggcaggcguuaggccaccaugccuagccuuuauuuuuuauuuuuauuuuuuuagauggaguuucccucuucuucccuaagcuagagugcaguggcacgaucucggcucacugcaaccuccgccucccagguucaagcgauucuccucccucagccuuccgacuagcugggauuacaggcaugcgccgccacgccuggccaguuuuauauuuuuaguagagacgagguuucucuauguugaucaggccgaucucaaacuccugaccuuaggugaucugucugccuuggccucccaaagugcugggauuacaggcgugagccacugcgcccagccaacuuuuuaauuuuuuuaaguucauuuuacaagagaggacacuaagccugagguuacucgaccacauuuuaugggcaguaaucuggaucuuuguuuuuuuuugagacagaguucugcucugucgcccaggcuagagugcaguggcacgaucuccacucgcugcaagcucugccucccggguucacgccauuguccugccucagccuccugaguagcugggacuacaggcgccugccaccgcgccuggcuaauuuuuuguauuuuuaguagagacaggguuucaccguguuagccaggaugaucucgaucuccugaccucgugauccacccgccucggccucccaaaguauugggauuauaggcgugagccaccgcacccggccaggaucuucuaaacuuucaaguucugugucauauuuauuggcccaccaguaagcuaauggauuaaguuucgaacgugugguaauuuuuuucaugagcagaauauucuacccaauuauauccuuuaguaacuugucgguuacuguuacccuugacgaaauuuuuaguuuccuaguacgucauuuauaaugaaaauugcugaucuuuccuuuugaauaaauuagaauccuugaaaaugaaucacaauaaauuuucuguuuuauauaugaaauuaguguucauaagcaaguaacgcaggucaccagcuguuuaaaacuguuaaucaaaacuugauguaaugaauuaauauugacuaauuucccucuaggcagaagaagaguucaacauagagaaaggucggcuugugcaaacccaaagacuaaagauuauggaauauuaugagaagaaagagaaacagauugagcagcagaagaaaauguaaguagauccugguugcaguauuaagcuaagaaguuuucugaagucaugagcaggcgcuuuggagucaggcauauauaaauucaggucuuaacucgaccaccuacuacuaaucugacaaauuguuuaacuucucuuucuucauuugugaaaauuaaagccugacaggauuauucaaagauuaaacugcaggcugggcaagguggcucacgcuuguaauccuggugcuuuggggaggccaagggaggaggauugcuugagcccaggaguucgaauucuuucucuacaguuuuaaguuguuacuaaugcuauuuuucaauaccguuuugcagucagauguccaauuugaugaaucaagcgagacucaaaguccucagagcaagagaugaccuuaucacagugaguaauuagccccuauuaguuauaaaauuauuacauguuuauucauuucccuguuguaaauuacuaguuaacauuaauuaaggaguugauugaauaaucuuuagagagaaaacauuccaauuauuauaauaaauacaaaagugaauaagagccaaggccuguauugaaggaccuucugaucuaaagagcauguaagacucuccuggauuauagcacacacuauggguggaccgcacaguaguacaugaggguacagggaccagugagaccagaaccauaggaugguuaauacagaggccaugagugugaggcugaagagcuucaccuguuuucaacagaaagcuguggaaacuuuuguauuauuuuguggagaauaucauaaauaaggcucaugauauaagcgugcaggcuaaauuuaacagggaagaggcuggaaaaaagaaaaccauauggaaaguauuauaguccucuaaggaagagggcagaaaccuucagaagcauaccacuucauugagaaaguguagagcuauuuggauuauauucauaagccaaacagggaugccugcuguuuccacuguuacucauugugacuguggaggcccuagauuccuuaugaguuggagaaaugagaguuacauaaauauugggauagaagaaacgaaauuaccaucuuugcagauacgguuauucaagcagaaaauauaagguucaaaaaacauaagauccuauaacuaauccagcaaugugacuggcuacaaacacaauaggaaaugaauaguuuuccuguaugccaacaauaaccaguuugcaaguaaaauaaaaaguagaucucucuauaauagcuacuaaaauuauuaaauuacuaggaguaaguccuauaugaaaacagcuauaaaacuaaaaauauagaacuugaaaaaauggaagacauacuguuuucuuagaugagaaagaaacacaaaccaguauuccaaguugucaguucuuauuaaucgaugguggcagugagaacugaguagcaguguuaguguugauggauuuuacaggaagacuuuccagacauucauugacucugccuuuucuuccaaguccaucacuaaauucugaguaucagguguggauagacuaggagaaugguggauccauuaacaaaaaugggaagucaagaugcugaaauguuucguuaagaaaaauaacuaguucuuuuuucuguuuguuuguuuuggcaucccugggugggcuggacuuuuggacauguuugagggaccaagaaaccuccagauguaagugucagugaggauguuaaguguaaaggacugauauuuaggacaccauagagaugauuuacuaauauaacuccuauauuacuucaaauaauaaaaguugccccaaauuuaagugcuuuaucugcuuugaaacuccaggaaugugggaaaauacaaaaucuguugccaguuuaucuugccacaugggauuaguucauccccuuuaaaauacaaaagaaagagucaagaguuuccuggggaaauguugccugcaaaauguuacuagcucaggacaacuguuauuuugcgucuucacuaaagugucaauaaucaggaguugauuuccuuccaggggauucaaauuccuuuagcaacuuggauugacugaauuaauuuauaacaggcuuuuacaauaauaaugucuuagggaagguaguuuguuguagaagggcuuggggcuuaagagucagucagcuaugaguuuaaaugucaacucugccauauucguuugucuaaauuacuguuucugacccucgguuuucucuuguauucauuaucuauguuauguauauucauuaugauguuugguucagagugcuuaugagaaucgaaugagagaacacauuuaaguccucuggcauguaacauuugucauaucguguuuaaaaaauguuaguucccuuucuccaaccccaucuccgucuccaccagugauaacccuuccuucuaauaauaggccuguguagauaaaauauucuuagcuuauugggugcuaaugcccagaaagccucuugacuauagucuuuucauuauuuaugcccaaaguaaaaaaugacaacugugacaucuacugcauagauauuauuauuuguacaauucaaaaaaguuuagaggcauguaauguuaaugucuuggcagcauuccuaaauauaaguagcaagggcuauaacacacaagguuauagcaaaagauuauagucuuagcuaguuaauaggcuuuauaauuagguuuuuuauuugguuuguuuuuuaugccaccuuuuugaagguuaauaauauuaagaguggaaaagauucugagaaagaucaucuaacauauuauagaaaugguuuugaugauacauucucugaugcuguccugccuuagaugguauaccgaccuuucauaacuggauguaaacaacccauaggucuaguggauuugacuugacuuguaauuuuaacuuguuauuuauugcccuuauuuucucuuugcuuuaauuuuuuaauccacuuguuuauauuuuauuaguuauuuuuucuaauuugcuuuuuaaaaaacguaauuaacguuuucauuagauauacuucuguaagcugccuuaaaucuauuagaauauauaaauaauuacuaguuggcuuuuagaaggaauuuuuuuuuaagaggcauggucuggcuauguugcccaggcuggaaugcaauggugcagucauagcucacaaacuccugggcucaagcaguccuucccaccucagccuccuauguagcugggauaacaggcaagagccaccaugccuggccucagagggaaaauuugaaguggcauagauaagaaaacuugacaccuaaaauucagaucauucauucauuuaucaaauacuucaauaucggugcuucucaacuuuuuucccuucucucuggaauauucauacaguuauuuuacauuuuaguaacaucucucaugacacacagugguuuucaaauuuugagguggaggauauuaaaagaaaguguggggcugggcgugguggcucagaccuguaaucccagcacuuugggaggccgaggcgggcggaucacgaggucaggagauugagaccauccuggcuaacaacggugaaaccacgucuccacuaaaaauacaaaaaauuagccgggcgugguggugggcgccuguagucccagcuacucgggaggcugaggcaggagaaaggcgugaacccaggaggccgagcuugcagugagcugagaucgcaccacugcacuccagccugggugacagagccagacuccgucucaaaaaaaaaaaaaaaaaaaaaagagcaggaugggcaugguggcucacgccuguaaucccagcacuuugggaggaugaggcggauggaucacuugaggucaggaguuugagaccagcccggccaauguggugcccugucucuacuaaaaauacaaaaaaauuagcugggugugguggcgggcgccuauagucccagcuacucgagaggcugaggcaggagaauugcuugaacccgggaggcggagguugcaaugagcugagaucccgucauugcacuccagccugggcgacagagugagacuccgcucaaaaaaggaaaaaaaaggaagugcaguuguauggaaugaauuuuuguuuguuuguuuguuuguuuguuuuguuuuguuuuguuuuuugagacggagucucgcucuaucgcccaggcuggagugcaguggcaguggcgcgauaucagcucacugcagacucugccucccggguucacgccagucuccugccucagccuccuugaguagcugggacuacagacgcccgccacugcgcccggcuaauuuuuuguauuuuuaguacagacaggguuucaccguguuagccaggauggucucgauuuccugaccucgugaucugcccgccucggccucccaaagugcugggauuacaggcgugagccacugcucccggccaaugaauguguuuuaauuucaacuuaggauaguuuuccaaaauacaguaauccaucauauucuuucagagaugggcuagccaggugccauggcucaugccuguggucacagcacuuuaugaggccaaggugggaguguggcuugaggccaagaguuugagaccagucugauaaauauagggagacccugucuguacaaaaaauuuuuaaaaauuagcaaggugugguagcgcaugccuguggucccagcuacucuggaggcugagaugggagaaucacuugagcccaagaguuugaggcuccagugagcugugauuaugccacugcauuccagcauaaaugacacagggagacccugucucuaaaaauaauaaauaauagaaacaaaaagaaaugggcuagagaaaaauaauucuuuuuaugaccuugaaagacaaagcagucauucaguucauaccacaugucuuucccggauuuagucacucugaguuugucugcugacuuuaaaauuguugcaaacaaaauucugguuuugguacucauguuaucccucaguugucacucuucuguuuucaugucauaacucaguuggguucccuugaggcacuaagcuguuugaauuuaacaguacauuuaucccauguguccuguaucgugcuggccccucuaggagucugcagucuaauaggaccuggacaagauaauacaucuccacuacagcuguuugagcaugacuugaaguauuagucaugggauaggauacagaauggagagagcagugugagugaaaaaccgagaccugaauuugacaugugcgggaaacagagguagucuggcagaguggggagugggcagagaacaggccacauauuagggucuaauuagaagggccuugagugucugcugaagaauauggacuucauccuuuuggcuaauucucuaacuuuaaugggcauaaaaaucaccugggggaccuuguuaaaaugcagauguucauucccauuuccagagacuuuuauauucuagucaggagucagcauuuaaaccagcagcucaggguaaucuuggugcagguagucugagaaccacacuuugagaaauaguguuuaaugguuacauuuguguuagaggaaccccacuggugaccauguggaguagaaacaaggaggguauggcuuaccuuccaggucgagaaguagaaugguggcagcagaaagagaagacaggccuauuccagagauccuaaaaagguaggaaucuguaggacuuggugacuuacaguugugaugagugaaugcaaaggagucaagaaugacauaagaguuuguagucuaggcaacugguagauggaaugaagauuagaaauaugggaagauaaucccagcacuuugggaggccgaggcaggcagaucgugaggucaggagaucgagaucauccuggcaaacauggugaaaccccaucucuacuaaaaauacaaaaauuagcugggccugguggggggugccuguaaucccagcuacuugggaggcugaggcaggagaauugcuugaaccagggagucagauguugcagugagccaggaucacgccacugcacuccagccuggcgacagagugagacuucaugucaaaaauaaaaaaaaaaagaaauauaggaagaacagguaaagaauggugaaaaaaaucauuguguuugaauugccuuaggauuccaggugaagcucuaugagucuguuaggagagaagaggagcuuauguggagacaacacagaagucccugcuggagcugugguuuuggauggagaauuagaagagaagcgggccaaaaaaacugagaagcaucagauuuaauagaaaauaaauugcuaaggaaaugugggggaaagcaguuauguuggagaauacagagaagccaagggaacggcaaacucaaaauggucucuaauacaguguucaauguuugagagaaugacagugggaagagcaugguggucuuuggauuuggcagucaagaugucguuuuucacauuugccagagcaguuucauuggacugaugaaggcagaaagccagauuguuauggcaugagaagggagaagugcgugugaggugaggagcugaaggcagcgugcguggccuguucacaagcugggcuguguguuuuaaucucuuuuggaacaaauccaaguauacuguugcaugcaacuugaauucaguauauagcuugagcuuuuauauuauuucucugacuuauaaugagaauuuugagaagauaaacauuuauguaauuucaguuauucuaaagauacuuguuucuuuuuuaaccgcuuacagucuuaacuucuugccgucauugaacccuguaaauaagagauguggagaguugaggaaacagacugugaaaugauaccgaucaaacaggauucaaucugcauaaaagcacacauacaugcuuugaguggauuuugcuauuucuaaacuuuuuacuucuaguuuuauccauagaauaagaagcugugaaaggaaaggaaguugucaugcaguuagaaaaggauauugacaaaagauggaaggaaggggaaaaauacagaacugggguaaaaauuaaaagaaaauaggcaaguuguguggugcuuuggucuaaguugcauaauccuuuauagauauuugucuguguugauccuuuuuccuugccugcccagguguuuuccaggauuaagagugcaggcuuuggaauuccuuugagguuuaaguuccguuuuuaccauucccagcugcucaguaggcagauuuuuaaaccccacuuuacuccuuugaacccuucauuucuuauaaaaaguaggagaaggccaggcaccaucccccaugccuauaauccccacacuuugggaggcugaggcaggaggauagcuugagcccaggcauucaagaccagcccaggcaacacaguaagaccuugucucuacuaaaaauuaaaaaaauguagccaggcgugguggugucccagcuacucuggaggcagaggcaggaggauugagcuaugauugugccacuguacuucagccuggaugacagagcaaugcccugucucaaaaaaaaaaaaaaaaaaaaaagagaaacaucuaccuaaagcuuauuuagaaaaaaauuagaucaccuagguagagugacuaguauaaugccuaaaacaaaaugaguguugagugaaugauaguucuuuauuaucauuuccccaaaccgcaaaacuuacaaguuuucuuuuuucuuuuucuuuuugagacggaguuucgcucuuguugcccagccuggagugcaauggugcaaucucggcucacugcaccccccgccuccuggguucaagugauucuccugccucagccucccgaguagcugggauuacaggcaugugccaccaugccaggcuaauuuuguauuuuuagaagagaugggguuuuuccauguuggccaggccggucucaaacucccgaccucaggugaucugccugccucggccugccaaagugcugggauuacaggcgugagccaccaugccuagccauaaguuuucuuuucuuuucuuuucuuuuuuuuuuuuuuuuuugagaugaagucucacucuugucccccaggcuggagugcaauggcgugaucucaacucacugcagccuccgccacccggguucaagcgauucuccugccucagccuccccaguagcugggauucaccaugcccuacuaauuuuuuguauuuuagguagagacaggguuucaccauguuggccaagccggucucaaacuccugaccucaggugaugcaccugcuucagccucccaaagugcugagauuacaggcgugagcaaccgcacccagccaaguuuucuuuuuuaaacgagaauaaauaagcauuaacauuuaaauucugagacauugguacugaaguggagauuucuauugcugugguuagagaugaaauagaaauaaaugucuuuggccggguuugguggcucaugcuuguaaucccaacacuuugggaggccgaggagggcggaucaugagguccgggguucgagaccagccugaucaacauggugaagcccugucucuacuaaaaauaaaaaaauuagcaggcaugguggugugcaccuguaaucucagcuacucaggaggcugaggcaggagaaucgcuugaacccagggggcggagguugcagugagccgagaucguaccacugcacuccagccugggcgacaaagcgagacuccgucucaaaaaaaaaaagagaaaacaaagaaauaaaugcccacugacucuucagacuaggcagggccagggagauaugguuuugauguugacaucauaaucagguuuugguuuccugcuuuugaggagcaggaaauauuuucagaauccucagggcaguuagguucaguugggcagauuuucccuuccaaacucauaaaauacaaauaagcccacaugugaacugcaguaguuuacagugagagacacauguugcuguggaaaagcuacaugaggagccagauuauaaccagaaaguuaauugaaguuagagucacaccagagggugucacugggauguuaggagcuuaucacacggaugguaauuauugaucauaauuuaccuuucucucccguggugacauaguggacaggcaugcuucagacaagggauaacacaguuuaugucaauuagguucuagccugcuuagcuagaguuuaguuuauuuagacucaacgaauuggccuuuuaaaacuccuuaauuaccguuucccuguuuuccauaguagauuccuuaugcaaauggcuaguagcacgcuccacaaguugacauuacuuaauuuacuggaguagccucgucuccauacucaggcugucuaucccugucugugugaccaguguggauagggugauuccagcacagagaggaaaaauguuagagggcucuuuugguggggaggagcuaagaguucuuucagccagaugucuuauagacaggguguguaucccuuaucugaaauguuugggaccagaaguuuuuuggauuucagauuuuuuggauuuuggaauauuugccuacacauaauaagauauuuuggagaugggacccaagccuaaauacgaaauucauuuuuaguagagauggaguuucacucuguugcccaggcuggccucaaacucuggguuuaaguaaucagcccgccuuggucucucaaagugcugggaucagaggugugagccacugcacauggcugaggcugugcuuucucuugagccuuaaaaacacaguuucccagguuggagugcagugguaugauuaucauucacgacagccucaaacuccuggacucaagggauucuugcaccucagccucccuaguaccugggacuacaggugcucaccaccugauuuuuuuuuuuaauuuuacagagacgaggucucacucuguugccccggcuggucucaaacugcugggcucaagcaguccugccaccuaugccucccauuaaagacugcauuuuaaaguuucuuuaagucugggcaugguggcucacaccuguaaucccagcacuuugggaggccgaggcaggcagaucacuugaggucaggaguucaagaccagcccggccaacauggugaaacuccgucucuacuaaaaauacaaaaauuagcugggugagguggcgcacgccuguaacacucaggaggcugaggugggagaaucgcuugaacccgggagguggagguugcagugaguuaagaucaggccacugcacuccagccugggcaacagagcgagacuccgucuucaaaauaauaauaauaauguuucuuuaaaauaacuaucauacaguaugauuacuuuuucuccauuuaacaaguggugugcucuguuuaacuuuauuuacaauuauaaaugagugaaaguaugauucauugaccaaugaauggcauuaaaucuuguuuguuuuagggacagaguauguauuauaaaccaaaaucuuagaauaaauaaauaauguuuaaguguuaaaaguuucuaaagacagaaacuauauuuaucacuugguauuuggaaucuuugcauuuggagcuuaagaaagucaaauggccaggcgugguggcucacgccuguaaucccagcacuuugggaggcugaggcaggcggaucacgagguuaggagauugagaccauccuggcuaacacggugcaaccccaucucuacuaaaaauacaaaaaaauuaacugggugugguggcgugcgccuguagucccagccacuugggaggcugaggcagaagaauugcuugaacccgggaggcagagguuacagugagcugagaucgugccacugcacuccagccugggcaacagagcgagacugucucaaagaaaaaaaaaagccuugaguuuucuuuuagcccuuaagccuuauuacuuaacaaaugauauccaguguguucucagccauaugagauuuguuuccugauaguauuccuauuuuaguuauuuuuauuauagaagccaguguuuauuggagacagauuagaaaauacaaacuaaccaagaaaauugaggcuggauauguuggcacacuccuguaaucccagcacuuugggagaucgaggugggaagauugcuugaggccaggaguucaagagcagccuggguaauauagcaagacuccaucucuauaaaaaauaaaauaauaugagcuggguauagugguacacgccuguggucccagauauugaggagguugaagcgggaagaucacuugagccuggauggucaaggcuguagagagccaugauuguaucacugcacugcagccugggcaacagagcaagacccugucucaaaaacaaacaaagagggcugagggcgguggcucaugccuguaaucccagcacuuugggaggccaaggcaggcggaucaccugaggucaggaguuagagacgagccuggccaacauggugaaaccuugucucuacuaaaaauacaagaauuagcugggcgugguggugggcgccuguagucucaucuacucaggaggcugaggcaggagaauugcuugaacccauggguggagguugcagugagccgagauugcaccauugcacuccagccuggguuagaagagugaaacuccaucucaaaaacaaacaaacaaaauugaaauuauucguaaucuggccuuccaaagguagacuguucguauuucgauccauagccagacaucugguuuuuuuccuuaaaaaaaaugggguaaucuuguauaaccguuuaauagcuugcuuuucaaaguuacaucgcgcgcaucuuuccaugucagucacuugugucgguuucugaacugaugguuaccugagcuauucucugcuaggccguggacucccugggagcagagacgguguuacaugcuuccuuguacccagcacagccccugcuuuaucucagaucucagggaauguguguugaaugaaaauccagcaauaaaaugugaggcagcugggcaugagccaggaucagccucacaguggguuaugagccgacugcccagauguguagauaacuuuuaucuuuucuaaucuuuguaggaccuacuaaaugaagcaaaacagagacucagcaaggugguaaaagauacaaccagguaccaagugcugcuggauggacugguucuccagguacccucauagaccagaucuacuguugauagccacaguucugagaaaauuuagaaugccuauuagagaccagcucuauuuuuuccugcuuucucauuucucuaguuuuuuuccuuucacccuuuuuuuuucuuuuagcuuuuuuacuuucacucuugaccauaucuaaaaugugugcugcauaggaaaauaguaaaucugucugcuuggauaagacuuccaggccuacuacucaauuauguagucuuacaugacuuaagggucaaauuugcuugcaauggcuagcuuuaaauucccuuaauuugauuuugccacuaaaauacuugcuuuagauuuaggauucagaccaaacacuguauauguuuuaauuguuuacugcugagcugugaauccuuauuuuacuuauguuaauuacaauaauauuuguccucagcuugguugauguaauauaagaugucugcaugaauuuuguuucuaucaccaaagguuuggguucauuuaucugguuugggauagauagaucuuuccauggucuuaugugauauaugccaucuguuaguggaacuuaccaggggaaauuuuuccaaccuaaaugaaagaacuguagaagcaucuuauuuuacuguugcuuuauuuuauuuuauuuuuauuuuuggagacagagucucacucugucagccaggcaggagugcauugacaucaucucuguuuacuucaaccuccgucuccuggguucaagccauucucuugccucagccuccugaguaaucugggauuauaggcacauaccaucauuccaggcuaauuuuuuguauuuuuaguagagaugggguuuugccuuguugccuaggcuggucucgaacuucugagcucaggcaauccgcccgccuuggccuuccaaaguguuaggauuacagaccugagccacugugcccgaccuguuucuuuauuuuauaguuugcauuuucuacugacuguaucuacuauuucuuccaggguuuguaccaguugcuggagccccgaaugauuguucguugcaggaaacaagauuucccucugguaaagguaaagaacuuaggauaauuuuuucccucccucccuccccccucccuuucuuccuuccccucucucuuucuuuuccuuccuuccuuccuuuucuuuuuuuuuugguggagucucacucuguuguccaggauggagugcaauggcgggaucuccacucaccuguaaccucugccugccggguucaagcgauucuccugccucagccucccgaguagacuagcuggaauuacaagcgugugccaccaugccugacuaauuuuuguauuuuuaguagagggaggguuucaccauguuggccaggcuggucucgaacuccugaccucaggugauccacccgccucguccucccaaagugcugggauuacaggcaugagccaccgcgccuggccguaaaaacccacuucuaucuuuuauuccagggaucuaguuuccuuuuuuuuuuuuuuuuugagauggaguuucgcucucauuucccaggcuggagugcaauggugcgaucucggcucacugcaaccucugcccccccggguucaagcaauucuccugccucagccucccaaguagcugggauuacaggcaugcaccaccaugccuggcuaauuuuuuguaucuuuaguagagacaggguuucaccguguuggccaggcuggucucaaacuccugaccuugugaccugccugucucagccucccaaaguguugggauuacaggugcgagccaccgugcccugccuuucuuuuuuuuuuuuaauggugguaaaauacacauaccauuuuaaccauacauugugccauuaaguacauuuacaauauugugcagccaucaccaccauccaucuucagaacuuuuccauuuucccguacugaaacuuugugcucauuaaacacuaacucuccauuauuucucuucucuucucuucucccccauucaccucauauaaguggaaacauucaguauuugucuuuuugugacuguuucauuucacuuagcauaaugccuucaaggucccuguagggugggucagaauggccuuccuuuguaaggcugaauaauauuccacgguauggaugccccacguuguguuuauccguucaucugucacuggacacuuggguuacucccaccuuuuggcuguugugaauaaugcugcugcaaacauggguauacggauaucuguccugcuuucuauccguuugucuguauacccagaaguagaauugcuggaucaugugguaauuguguacuucauuuuuugaggaccuauuauacuguuacuuugauaagaaccauccuuauggguauggcauggcacugcuguuucuggugccugcugucucccccucaucugcaacugccaguugaagcucaugccagcagccaaacuucucuucccucccuucucuccuuaccuacccccagcuucuaacacucucagcugggggaauaauguaucuuccuccugcugauccauguuucaaauguaauaacugccucugguguguuuaaucaccugccaagcccuguuaaaucuugacagaaaccauucgcaucucuucccuccugugugcagacugucauuucuccucaguggccgugccguuuuacauucccaccagcggugccucuguucuuuuaccugggauaaauggagguauccuugcuuguauagucuguugaguuuuuggauacuugcuucauaguuccuagugacaccucucauuguguucuauacuuccaggcugcagugcagaaggcaauuccuauguacaaaauugccaccaaaaacgauguugauguccaaauugaccaggaguccuaccugccugaagacauguaaggaguauuccugcugcuaacagcuaccuucucucccugggagaguggccuuuauaccaggccuuuuuuaaaugguauuuucaccauuuaaacgcacucuuagacacaaggcuagagcugugguguauucuacuugcagccguuccuguuguucucgcagugcucucuugcucucccuuguuggcuggcuaaauauacucuaaaagucuaguuuggccaggugcgguggcucacgccuguaaucccaacacuuugggaggcugaggcagguggaucacaaggucaagagaucgagaccauccuuaccaacauggccuagggagcuagacucccuaucauaccaguccacccucugcucauaguccaguccugucucuacuaaaaauacaaaaauuagcugagcgugguggcgcacgccuguagucccagcuacccaggaggcugaggcaggagaauugcuugaauccaggagguggagguuguagcgagccaagaacacgccacucacuggacuccaguauggcgacagagcaagacugcaucucagaaaaaaaaaagucugguuuauggucacugcuuuccuucugcggggagguggcccccagaaugaaagcuaggaccagaucucuguauuggaugcugagguagauacucccuucuucuaaguaauaguuaucaaaacaagaauuguguaugccugguaguuagguuccuuagagauagaauugcaaguaugagugguauuuuuaugacugugaggaaaugacagaacauuucugggaucaguguuccuaacaagcuuuguguagcugggguaggcaguagaaacuccugacaaggggagagccagugucauuuucucgauuucacuggccugucugaggccaccuagccacacuacugacuaacauugaagaaaguaccuuggacacuuuuuuuuuuuuuuuaagacaggcagucucacucugucacccaggcuggaguacaguggcaugaucuuggcucacugcaaccucugccucccagguucaagcgauuuuccugccuuagccuccugaguagcugggacuacaggcgccugccaccacgcccagcuaauuuuuuuguauuuuuaguagagaugggguuucacuguguuagccaggauggucucgaucuccugaccucgugaucugcccgcucggccucccaaagugcugggauuacaggcgugagccaccaugccuggugccuuggacacauuuugaaguuagcugauuaucacacuuaggaauguaagaccuagauuugaguccuaucuuggccuuuugcuacuaugggaccuggagacugaauucaucauauguaaaauaggaucauugcuuuuugcuuuuuuguuucaugcagugaagaaaaaaagaugagauaguacaugugaaaaugcucuguaaauggaaaaaguauauaaacucauaagauaugcugucagaguuggguuagauuccugauucugccacuuacuaccuggguaaucuuggacucguuuauucaguuucauugaguggugucguccauuuaguguugcuauaacagaauacccgaggcuggguaauucauggagaaaagagguuuauuugguucaugauucucauggcuggaaaguucaagauuggacagcugcaucuggugagggccucaggcugcuuccacucauggcagaagguggaaggggagugggugugugcauagagaccacauggcgagagaggaggccagagagccuagggaaccagacucccuaucauaccagcccacccucugcucacagucgaguccugccggagcuagaauccaggcccucgccacaguucauugccucgggaucugcccuugagcccugaacaccuccuacuaugcuccaccucccaacacugccacauugagaaucaaauuucaccauuaguuucugagggaacagacucaaaccauaguagugagcccugauucccuuaucuguaaauugacguauuagcacuaaccucauagcauuuuuuaucuuauuuauuuauuuauuuauuuuuugagacagagucucacucucacccaggcuggagugcaguggcacgaccucggcucacugcaagcuccaccucccagguucacaccauucuccugccuuagccucccgauuagcugggacuacaggcacccgccaccaugccucgcuaauuuuuuuuguauuuuuaguagagacgggguuucaccuuguuagccaggauugucucaaucuccugaugucgugaucugcccaccucggccucucaaagagcugggauuacaggcgugagccaccgcacccagccucuuuuuuuguuguuguuguuguauuuugaguaagggucucuuucugucacccaagcuggagugcaguggugugaucucggcuugcugcaaccucugccuccuggguucaagcaauucuccugccucagucucucaaguagcugggacuacaggcacgccccaccaugcccagcuaauuuuuguauuuuuaguggagacaggcuuucgccauguuggccaggcuggccucaaacuugaguuugggagcaccucggccucccaaagugcugggauuacaggggugagcuaccacgcccggccagcaguggcaucuuuuaucagacacacaugcagucgugauagggccucaucaguaaugagcaggauugggcuuaagaaaacauucagaugaggauugagugauuugcaaacugagaugaaauccucucuuuuucauuuuguuggggagggcuggcugugauaauuaaaacagguuuuguaacauaaaaucaaauugacacaggcugggcgcggugacucacuccuguaaucccaacacuuguggaggcagaggugggcggaucaccugaggucaggaguucaagaccagccuggccaacauggugaaaccccgucucuacaacaauacaaaaauuagccaggcgugauggcaggugccuguaaucccagcuacuggggaggcugacgcaggagaauugcuugaacucgggaggcagagguugcagugagccaagaucgcaccauugcacuccugccugggcaacagagcgagucucaaaaaaaacaaaacaaauugacacauagugucacuugguaaaugacaguuauugagaugaauacagucaguucucuguaucuuugggguccacaccugugaauucaaccaacuuuuucuuuucacucccuaaacacuacgguauaacaaccauuuacaucguauuagcuauuuuaagugcuguagacaugauuugcaauauaggggaggaugugugaugguuguaugcaaauacuacgcuguuucauauaauggacaucuaggcggggacugggguuuccugaaaccaacugugcguuacaucuucagaagcuuuuucaguuccuuucaagccuguugcuuagguugcgcagucuacacaccaagacaagggcauuccucugcgggaguaaaggguaccauguaucuuucucaagucuuugaaaaugauuauuuccugugcuuuuuuuuuugcagagcugguggaguugagaucuauaauggagaucguaaaauaaagguuuccaacacccuggaaagccggcuggaucucauagcccagcaggugaguguggggguacuucuugguaguuggucugcuguuacuuugaagugggacagagaacacguguccauucacugguauuugggauuuguugcugucuuuccaguuuuggacauuuucucaaaaagaaugagaauugggcauguaguagcauuugcugaggugguaacauuuacaugagggugaauuuggggucagaacaaguguuuuguugaccuaggauucgaauauguacauuuuacuacauguaaggugcugacaaguucuuucucuaacaggagugaugggaacuaaagcaaauacuuguguuuuuuuguuuuguuuugcuuuuuugagauggaguuucacucuuuuuugcgcaggcuggagugcagucuuggcucacugcaacuuccaccucccagguucaagcgauucuccugcuucagccucccgaguagcugggauuacaggcaccugccaccacacccggcuaauuuuguauuuuuaguagagacgggguuucaccauguuggccaggcuguuaucaaauuccugaccucaggugauccacccgccuuggccucccaaagugcugggauuacaggugugagccaccgugcucagacacaaauacuuauuuaaaggaauuaucauaaagcugcuggcuuuucagauguuuccagauuuguacacaggaacucuaggaaacaagccaggaaaauuccauuuguucuaaaaugcugggcaucuucuagacuucuagugggagucuauugcuguggcugccaaccuaguuauucccugaccuagauaugcaguuuacuguuuaugcagauacuugucuuauaacuaaagcacuuucaccuugauuuuuucauauucugguaacuuaaaccucagaacauuguuuccuaguagccacugucccauccaguaucauagccacuacucacuuacggauauuuaauuaaaccgaaaaauucaguuucucagcacacaauaaccaucuguagcuaggacugcccuguuggacagccgagccuuggaaguccaggguuaaguucuccuaaggauucaucaguggcuguagcaagugcuuccagccuaagcuggcauuggaaguguucuuugcagcugcuguggccauaguaggcacucaguaaauguuuguugaagaaagaguguaggugacccagcauauuguggugagaugauuaugaugaguuaagucugagauaguagugacuuuagguuuuuuuuuguuuuguuuuuuuuuaaugugucccuuuuguaagcagucugaaccccagauuugggaugaguuaaguuucucaccaaggaauguguuacuugcuucagggaaggagaggguggcuuugaugugcguggcuuugugaguccuucccagccacauagagguucauggcuuuccaccugugguuaagaugugcagcacucuggccaggcuugguggcucacgccuguaaucccagcacugugggaggccgaggcggguggaucacgaggucaggagaucgagaccaucccggcuaacauggugaaaccccgucucuacuaaaaauacaaaaaaauuagccaggcaugguggcaagcaccuguagucccaucuacuugggaggcugaggcaggagaauggcgugagcuugcaaugagcggagaugcgccacugcacuccagccugggcgacagagcgagacuccgucucaaaaaaaaaaaaaaaaaaaagaugugcagcgcucuacaacuucuucagcugacauugcguauuuauuacacuuucucuccacagaugaugccagaaguccggggagccuuguuuggugcaaaugccaacaggaaguuuuuggacuaagccuucaggagguggagcucgucgucagcucuccugcugugauguggaagcuucugauauuugaagaaacacgaaugucucuguagcuuccucuucacugccccaguauugcucuguauuuaucagcgaugccccucugucacucaugccuugccuaauuguucacaaugguggaaagcuucauguaauaugaucaggacccaccuccaguucuucugaaagugugacaguguccagccgguucugcagcacuaggggagggggcagauggugguugcaugggcuuccugggucuccacucuccgucuggccuaaaggugauguauuugguguuuggcccugcaguccccacucuugaggcuuaaggcgcauguggcacaccacuccuuccagcaguagucgcuuuacuguuaccuguuuaggccuagaaguuuucccucaucuguaaaugugauuuaaaaucuaagccaugaauaugcuuuauuuauuaaaagaguuaugcggauuuaaugugauuucuaguguaaggcacuacaa

SEQ ID NO: 191688 - RNA, 40356 nt, Homo sapiens
gaaggaggaagcgcgcggggcgccauaaggaggaagcggguagucgaccguguccgcgcgccugggagacgcugccucggcccggacgcgcccgcgcccccgcggcuggaggguggugagugcacccgcgccccucccgggguacgcgccgagccccagcccgugaccccugccugccgccugccccggcguggagcucagggcccgccgcccgcccugggcccgaccgcggugggagccagaggaggggaggcggggggucagagccccaggccucagcagcgaccugagggccgggucucucccgccuccccuccgcccgggcgcccuccucggcgcggccggcaggucggugcugagggucggguccgccucggaggcggggaaggcuuuguuguguccucuccacguggccuggggauucaggggaggggugcggggcgcggggagggggaggggccgaggccagccccggagaggagaaaacccgcgggccuggccgggugcaggccacccuugccggcggaucggaauccccgcccacaccguggucuuuccagcaccgcagacaccugccggcuccucccgagcggagcucagggcugacaaagcgcggucagagcggccgcuuacuggggcucgcccgcuccuuagagcacuggcaaugaugugcggauccucgcugcugcugcugggaaacuguugaguggcugaaugaccccaggggacccugggagagcucugaagcccucagccaccaaguggcugggcuggcaaggguucauucauucauucaacaaauacgaaugugcagcggugcuggggucaugauggcucggugggcagcgaggggccgggccggcuggaggagcacagugcggauucuguaagugggcugggggcugggccuucugcggcuggaccggccuucaccugcaggcaggguuggggcaggugaggagcagauggacccacccagagcucuuccaccuucucaggcuugcacccccuuccuggagccuuauccacacccucaguccucgcucucacugugggggagcugcagaggaugcgguuuuuccacauuccaucuccacccacaggaggcuuugagauggggggagcucuccugggccugaaugugugccguccuggggcccugcaguccccugggagugaugaccgagaccagauucccugagcuggggucuuaaggguguggggagcgcagagggauccucuggcaucaggaguugagguagacagagcuccagggaggcacugccgggaggacgacccuggccaagccucugccugcggcccagggugugcgucccugccccuucugccccucuugcccagggagggaagaggaaaugcggggucagcaguucguggcugggguuuaaaggcagggaucucccaggacgggcacagggagcaugaggaagcagcucgugucucuguucaugagaugugagaguggugacugagacgaggggugcagagaccugccguggcuggggcgaggugcuguuagugcuucugaggagguugggcaggauagacgguggcugucagguggucucaagguugugcaggagcuugccagagagggaagcggggcauggccccagggugguaugggggauucuagggggagggugccugggugggaaggggugucgcaugcccagcucagaggccuugcuuaggggugcucacaggcucggcugacgugaggaugcugaucgaaggagcugagggucccacucauuugcaagggggaacugucugcccaggagccccagcagugcccaggccccuggacugacaaggauggaugagggugauggaggcggauggacauuugacacuggagccugccuuccaggcagaagggccgugagucauccucucuccggugccaaguggaggggcugagcagguccucgacgugaccgaggacugugcccguuuuuucaggggacccggagcgcuggcucuggcugucagcccaugagagaccucccugcagagcuguggccucuggaaaugcuuccugucguugacaucuggucaccauucuccagcuggggcuguggagggcagcacaggccuggaguguccccgagagcagcugggcgucugccccugcccaccccacagggccucccacucacagggccuaauuagcagcuccauggcugccauaccuggcggaccgcccucagcggccacauauauccuugccccaagccaaugacaggucugaagaagacacugauggagcugaagcacaggacagagacaagcaccugugugccggacgcucacggagcacuugaugugugcugacuggcucacaucacgguggucagacgaggguagcauccccauucuccagaugguguaacugaggcaaggagaggcuaaguaacuuguccaaggucacacccgagggaguuggacuucagggucucagcucugagcaucaggcacacugcccagauucccccuccacaugucacaccuguuaggccacuggggguaaggagccuuucuguggccucgcuccccugugagccccugggagggaggcagcccagauuccaaggcagcgagugacgugugugggaaaggggaagcuuccggggcagggguucagaaaccucgcagugggguuuuccccaagagccacugcuggcagguuccuacagccccauccagccccaacacagccugccucuuuuccuuccucuuccuccuuuucucuuucugccugcguugguccaaaauggggaaguuucacauaaauggcaaacaggccacaaagcagcuauuucuggaggugcugcugccuugcagauugaauucuugguuggcauuuuagguguuuguuuucaggauccuuuucuguagaagaagccaacaacuaagaaaaggaggaaguggcuuugggaggcugagacgggaggauugcucgagcccgggaggucaaggcuauagugagcugugauugcaccgccgcacuccuugaauccuaucagcuuggccagggugggggugggaaguggggucuuaaaggggaaagaccagccgggcgcgguggcucacgccuguaaucccagcacuuugggaggccgaguugggcggaucaugaggucaggagaucaagaccguccugacuaagacguugaaaccccgucucuacuaaaaauacagaaaauuagcugugcgugguggggggcgcccauagucccagcuaccugggaggcugaggcaggagaauggugugaacccgggagguggagcuugcagugagccgagaucgcgccacugcacuccagccugggggacagagcgagacuccgucucaaaaaaaaagugggggaaagaucaccaucuggaucauagaccagaccugaaagggggcuggucacuuuuagguacguagaguaacuggaaagacacacuguccuaguggaagccguggguggccucuguggcugcuguggccccaggggaggagauaccugucuucuggggcugcggcucagucuggcuccggguccggaucaccagggaacuuucugcagagcauccugccugggcuuugccuggucugcaugggaucccccagccuguggcucagcccgcuucuaugcucauagccaugcuggcgccgggggcaguccuuggcuucccuccucguuggcuuaacaaacccccuuucuucagaggaaggaaagugugccguggccuggugggacaggcugggcuuggaggugccaaauguccugugugcuuggggacagcugcugaaccuccccgccgccgucacggcccuuggccaagagcuuucauccaaggcuggcaguaguugcucuauuucuguuauggggcaccucugcaucuggguuugguuuaauuuguguaacugaaugucucauuuuauuccucacauucauucugugaaguuucccuugucugggugaguguucaggugacuacaacccuggguccgggaugggcgguguuccaggagcuucugcuugggccucucccauucucccccaaaaccaaagagaagggaaaacccuuuguaaguggaugucacaugucaggugcuuuuucugauacugcaugugaucccacaaggcagggaguguccccuuuuacagacggggaaggugagaucacauugcagguucaaagcccgacaugaccuguccaccuuuacagcuucccucucugggcugggagugcgugagggcuucuuaaaaugcagauggacuugggggauugagcuucucugggguucugguguuuuuguagggagagccaucuggggucagggcugggguggggacagcaggagaacaggacaggaguggcaacccagggccagggaagggaguaggcagggguagcauauggggguggaaagaaaggggccaguggcacgaagggcccugggaggcagcagcgugucccuccuggggguaaguccaggaagguggccauccccgaggagcuccguuccugugacaaugaggcuaggccugagggcaccggaggccagcgggcaagugcacacccccaagccuggcggggcaccacgugaccaggccugguauugggacugggaguggcuccugcaccagcuggcaucugccuagagacaggaaggugggugccuccuggguucagcugggaacucugagcuuugggugcuggaggucacugcguuugggauggcugccuccuggacccagcugccucuguguguggagucaguaaggcaccguccuggcugcggaacugaggcaggcaugcuaugagaagauaaaauugccuuaacaacuguccccaggauccuuccagcaggcacuuccuugcugugcccuggaaaagcgggguggcacucuggaugacagcacagccucagggugcuucucuguggcccacacacccuuccggccugauggccacguccguuccuguuuacccaagccccacuuccccugaaauccaggcagggagagauggggccuggcugugagaaaccuggccccaggugucaccauuuccccaaaagccuuguuucucccucuggguaucccugaggaccccugcagacauccagccccaaacccggccaacugagcagggagcccagcuaggggccuuuguggaagggucacccguguacucacaccagcagccagccgcuccugggucaucagccccuccauaggagaggggaggcguuucugccaggggcuggguggcauuucugccaggcaggggcauggcguuggcacggcacaggcccugcugugcucugugaggcucugcccugacuuggacucugccugggauguggugaaagccuuguucuuuauuuauuuaguuauuauuuauuuauuuauuuauuuauuuauuuauuuuugagacgagucucacucugucgcccaggcuggagugcaguggcacgaucucugcucccugcaagcuccgccucccagguucacgccauucuccugucucagccuccugaguagcugggacuacaggcgcccaccaccacgcccggcuaauuuuuuuuuuuuuuuuuuuugagacggagucucgcucugucgcccaggcuagagugcaguggcgcgaucucggcucacugcaagcucugccucccgaguuucacgccauucuccugccucagcuucccgaguagcugggacuacaggugcccaccaccaugccggcuaauuuuuucuauuuuuaguagagaagggguuucaccguguuagccaggauggucucgaucuccugaccucgugauccacccgccucggccucccaaagugcugggauuacaggcgugagccaccuugcggcccagccuuguucuuuaugacagagucuacagagaguucagggaggggcggaccaggaggcucaccagaggcucaccagggauucuggaguagcugagggacaccugccuuccccugccauccaccaugccccacccagaagcccagggccugggcaggggagggaggcaggacucccgggucacaaagaccuggagcauagggguccacugacuucuggggccugugguggagccuccgaccucugggagggggccccagucaccugaagaggcucuugccuccucaugucuccuccugcuggcugccuuuucaaaaaccguuugauugagacauacugcacaugccauaaaauucacccaucaaagggcacaguucaguggcuuaguauauacacggugugcgaccgucaccaccgccuacaggcagaacauuucaguaacccaaagagaagcuccagacacacugguggcugcuccgcagcccuggcagcccuaaucuuucugucuauggaguugcacauuuaggacauuucauacuaauggaaucacacacuacguggucuuuugugacugacuucuuucauguagcauauuuucaacucauguuaacugcuguaacucauguuacaguaggugucaauguuuccuucauuuuuuauuuuguauuuuuuguagagacagggucucacuguguugcccagguuugccucaaacuccugggcucaagugauccuccugccuuggccucccacagugcuggccuuuucuuggcuaccagaggcaaauucaagcagcaauggaacuuuucacuucgcggacgcuguuucuccguuuucucuccgugucucuguuuccccugccccugacucuguguucuguugguuucgggcuuacccauggcuugguggcaucagugauugagcauugguuuguggucauauuguuuugcucaucuuuguaggcggaugacagagaucaguucucuguggucagauacggagaaucuggaugaucagacuucguucucuguguccuuagccucuuuugagcucaauucaauucagaauuuuguguccaccgggaaggauaccucuuugacaccugguccagggacuuuuccaguuucuguguuuacucuugcccuggggcugaaguuguaauucagaaaggccuuugccucucacuaagugaauguggaaaacuuuuuuugagucauuggguaaggucaugaagugucuugaauuggaggaacucuauucugauugguucgugauuagcuuauguaaguaaauauuucuaagauuuccagaacguaggaaaaucguacuucuaauaauuuauuucuuuauuuauuauaauuuuuuuuuuuugagauggaaucucacucugucacacaggcuagagugcaguggcgcgaucucggcucacugcaaccucugccuccuggguucaagagauucuccugccucagccucccaaguagcugggauuacaggugugugccaccaugcccagcuaauuuuuguauuuuuaguagagaugggguuucaccauguuggccaggcuggucucgaacuccugaucucaggugauccuccugccuuggccucccagagugcugggauuacaggcgugagccaccacgccuggcuguacuucuaauaauuuuaaugcacuagacuuuaaauuuaaaaagaaauucuuggccgggcaugguggcucaggccuguaaucccagcacuuugggaggcugaggcaggcagaucacgaggucaggagauccagaccauccugguuaacacagugaaaccccguguccacuaaaaaauacaaacaauuagccgggcgugguggcagacgccuauacucccaacuacuugggaggcugaggcaggagaauggcgugaacccaggcugcggagguugcagugagcagagaucacaccauugcacuccagccugggcaacagagugagacucugucucaaaaaacaaacagacaaacaaaaaaggcugggcgcgaaguggcucacgccuguaaucccagcacuuugggaggccgaggcgggucgaucaccugaggucgggaguuugagaccagccaggccaacauggagaaacccccucucuacuaaaaauacaaaauuagcccggcauaguggugcaugccuguaauuccagcuacucgggaggcugaggcaggagaaucgcuugagcuugggaggcggagcuugcagugagcugagaucgcgccacugcacuccagccugggcgacaaagugagacuccaucucaaaaaaaaaaaaaaaaagaaagaaagaaauucuucuuacagaaacaaacuggaauauuuuaagaaucuuaaguucaggccaggugcaguggcucacaccuguaauccuagcaauuugggaggcugaggcaggaggaugucuugaguccaggagcucgauaccagccugggcaacauggcaagaccuugacucuacaaaaaauaaaagauuagccgggcauggugguugugccuguagucccggcucuggaggcugaggggggaggaucgccugagcccgggagguugaggcuguagugagcugugacugcaccacugcaguccggccugcggaacagagccagacccugucuccaauaauaauaauaacaauaaucaucuaaguucacguaauugauguaaaucuuuggcaaaugagacuaauaauuuggguuuuaaaaagcuaugucuuuucuucaguuucuuuuuauuauuauacuuuaaguuuuaggguacaugugcacaacgugcagguuuguuacauauauauacaugugccauguuggugugcugcacccauuaacucgucauuagguauaucuccuaaugcuauccuuccccccuuuucuucaguuuaucagcauuagcuauaauacagguguaccuuuuguucuacuuggcuuccuccccuaaacuucuacggguuuacuuaucaaaucagcuaauauuacuguuacauaauguuuaagauuaugaaaaauauaaguuuguguucaaauaaauguguucauuauucugaaaguguacuguaccaaaauaaagcuuagguaacuuaaaaccuuggacugauacuaaauggaguugaguagguauucuuuggauaucgacauacuuacucgguaagacagaauaguaaaacauugguuacuagguauaccuggguuuuuuucagcucuaaaaagaggccguaucuuggccugcagucaugaccuuggcaagucacuucuuucaaugccucaguuccccaucugucaaaugggggugaucauacugaccuaccucacaggggcguuguugugaggcauuguaagucaaaguuaauagaauaccgcaggguccucuguggaggaugucuuggguccucuguggaggaugucuuggguccucuguggaggaugucuugagccggacacacaggcuuugguccucacugagcugucuccaagacuggaacuacuuacugacucggcaaauucucuacccccaccccucaucagaucugcuaguucagauguugacaguguuuucaugaauguuggaaucuuacuaguccagacuuacuuaggauguuguuggggaaggcacuugggauuuucugugucuugcauucacagagggaggucauuucagaugcaggagcauuggauuagggaaucgugaggcagagaugcuaccgcuuauuucucucugcagguuggggaugaaaguuccauuccccauggguuugaagcagacucagacugucucaggaucaaagcaacccucaaugguuuugauuuaugucauugcuuaccacuccccaaccgaucccaggacagcugggucacuguaccccuuugugguaucuguacccgggccucuccuuccucauagggacagcugauucaauaaaugugaccaccuuauuuccaccccccaacaaaaagcuacauuggaauuauuuuuccuagaaauguguguaacacucagaauugggcauugauccuuaaagcuucauccgauucacuguauucagcaucugugaucucuuagugucugcagucuuaaccuaaccuugaccuuuuuucccucugguuugagaaaaguuuggacacuauuucuacuugcccaggugugggcucaagagccuuacucuuuccaucucaguguaggggcacagccaacgccucuucccaauagggcucuuucuccuuucccucuccuuggcccuagauuuguaauccaugaaaaagcacaagguccuggcugcuugcagucacauucugguucucuguguuuuguggacugugcucucacuguucacccagcacuagcaguaccagacgguucuguggaguccuggggaauggagagagcacagucugacgcccugccaaguagccaggaguugacuugcccaugguccgcuggcuuucccaccacuuccuacaggaugggaucuaagagacucaguagcuggguuucuuucagcacgcuguacugucccaaguagcaaacaaaucacucuguagccagauuucugaauggaaaugagaaauugaauucuccauggacuuuuagguuuaugggggaguuuugguuguguuuccugguuuuauuucagccaaacaugucugcuuuugauuuuuuuuuuuuuuaaauuauaaguggucuauauauauguucaccuuguaaaugucaguguuuaaaaagaguaagcauuuauguguuuccauaacugacaucugauacagaccucauucucucccccucuucuacccuccucuuuucccucuuuucauacucuuguauugguucuaauaaaugguugcuuuucaaaaaaaaaaaaaaaguauguuuucauguugaggaagcauagaagggcgcgaguggcugugaaggcuauggugugugugcccacaggcgucugcuaaacaugugucuggagacagcucucaacugucagccugcgguucucuguaaaauggaagucaguuacuuuguuaaaaguuauaauaaggccaggcacggugguucacgccuguaaucccagcacuuugggagaccaaggcgggcggaucaccugaggucagaaguucgagaccagcuugaccagcacggaggaacccggucucuacuaaaaauacaaaaauuagccaggugugguggcggucaccuguaaucccagcuacuugggaggcugaggcaggagaaucacuugaacccaggagacgaagguugcagugagccaagauugugccacugcacuccagccuggaugacagagccagacuaugucucaaaaaaaaaaaaguuauaauuaauacacaugauggagacaaacagcuauguaaaugcuuuuauuuuucaaagaaaaaauacagguggccaggcgaaguuucucacgccuguaaugccagcacuuugggaggcugaggcggguggaucgccuaaggucaggaguuugagaccagccaggcuaacauggugaaaccucaucucuacuaaaaauacaaaaauuagccggaugagguggugcaugccuguagucccagcuacucgggaggcugaggcaggagaaucgcuugagccugggaggcggaggauguaaugaggcaagaucacgccauugcacuccagccugggugacagagugagacuccgucuuaaaaaaacaaacaaacaaacagguuuuguuuuuuuuccucaaagcagcacuucucaaacuuuuuggucucuagaucccuuuauauauaaaaauuauugaggaaccaaaaagcguuugauuaaguaggcuuuuaucccuauauucuguguuagaauuaaaacugagaaauuuuaaaaauaggccagucacagugguccuuaccuguaaucccagcacuuugggaagcugaggcaggaggaucacuugagcccaggaguuugaggcuguagugggccaugaucgugcuacugcacucuagccugcuugacagagugagacccugucuccaaaaaaaaaaaaguguucauucauuugaaauuugugaaauuguuuaauuaaauuaauuaauuaauuaauuuugagacagagucuugcucuguugaccaggcuggagugcaguggccugaucuuggcucacugcaaccucugccuucuggguucaagcaauucuucugccucagccucccgaguagcuggguuacaggugcacgccaucaugcccggcuaauuuuuguauuuuuaguagagacgggauuucaccauauuggucaggcuggucucaaacuccugaccucaggugauccacccgccucggccucccaaaguucugggauuacgagcgugagccaccucgccuggccaacguaacuauuuuauaaaacaaaacauuucuauugagaagaacagcauugcgucaguguuucugcagaucuccugggugucugacugaauagaggauaccuggauucucgguuguugcaguaucucuuucgcucagccccugggaaaguccacuguacccucaugagagaaugacagaagaaacuguguuauggaagcuuuucaaccucacagauucucugaaaagggccucaggcacccuaggauauccugguccacacucucuccuaaagcgauuuaccaguguuuuccagaauaugguaaaaaugacaaaaaacauagugaagggcaaaacuagguaugugccuuuuaucaucaugguaccugagucugaaaagcagcaaugaauuaugucacaauuuuagcaaaguuugcuggccuugauggucuugccuucuuuguuuacucauuaaugccuuugccuucaaagugaaagauuauggccgggugcgguggcuuaugccuguaaucccagcacuuugggaggccgaggcggguggaucacgacgaugucaggagaucgagaccauccuggcuaacacggugaaaccccgucuccacuaaaaauacaaaaaauuagccgggcgugguggcgggcgccuguagucccagcuacucgggaggcugaggcaggagaauggcgugaacccaggaggcagagcuugcagugagccaagaucacgccacugcacuccagccugggcgacagagcgagacuucaucucaaaaaaaaaaaaaaaaaaaagugaaagauuauucuuuccuuucuguguaaugcaccuggauggcagagguucuguauagcagaaucauuuuugaugcuuuauguugacuuuauuauguuugugcuuauuuaaggggaaaaaacaaagaacaaagguucaucacuugugaaacaucagguuuguuuuguuaauggauaaucaagucucucucagacacccgcgagccugccuuaaacaacuguccagauugccucuaaaacugucccugagacucugagugccccuggaaaaucacaaagauuugaucauucaccuuauaaaaagaaaaauaccauagacauaaugagguuuguuuuaagcguuaucuuguaagaccugcacgggaagagugguugucaaaucacaagagacgcuggccacagcuccuugguucgguguguauguguaaauguuauucauggaaauaauucagaaguucugggcuuggcgggaggccccgugcuugucagugcccucccuugcucuguguaggauauuuucauucagaaaauaucugaaugaaauauucagaaauaucugaauaacgcaucuggccagaugcauuagaaaaucguuaugaaaagagacuuugagucuucccaugcugauguuccccaugugggaaaggauugccuggugcuuucaccagugacuaauagagccucugggcccaggcuucugcauggacauuaccucaauggcucucagaccaccccagcgcgccgggccagggcuucgugaggcuggaagcuggcuccgaguccugcagagugcgacgggcugcugagggaacugaauuguggugguuugcuuggaauauagcugauguguucauuucuguuuucuagauguaagaggaaaugcuuucucauucuuagugucuguaauccgugaugauuuaguaggcucugcucugguagauggauaugaaacuuuuuuuuuuuuuuuuuuuuuuuuuugagacagagucuugcucuguuacccaggcuggagugcaguggcgcgaucucaccucacugcaacccccgccuccuggguucaagcgauucuucugccucagccucucgaguagcugggacuacaguugcccaucaccucaccuggcuaaguuuuuguauuuuuaguagagcugggauguagaguagagauguuggccaggcuggucuugaacgcuugaccucaagugaucugcccucaucagccucccaaagugcugggaguauaggcaugagucauugugcccggccagauaugaaacuuuuuuuuuuuuuuuuuuugagauggagucucacucugucgcccaggcuggagugcaguggcgcaaucucggcucacugcaagcucugccucccgaguucacgccauucuccugccucagccuccugaguagcugggacuacaggugcccaccaccacgcccggcuaauuuuuuguauuuuuaguagagacuuaggguuagccaggauggucucgaucuccugacaucgugauccacccgcuucggccucccaaagugcugggauuacaggcgugagccaccucgcccggccgaaacauuuuuaaaugauauugcuuucucagugaacccccauucucacugucuccuuauuuuuuguggugauauaguuauuugcauagguucaguaagaaucuguccuuuuuaaaauugaaauuugaaauuuaaaaaauuuuaaacuuuaauaauaauaauaauuuuuagaguuggggccucacuauguugcccaggcuggccuugagcuccugggcuuucaagcaguccucccacugcagccuucugaggagcugagauuacaggugcacaccacuacaccuggcucuguuuuuuguuuguuuguuuugagacggggucucacucugucacccaggcuggagugcaguggcaugaucucggcucacugcaaccuccgccuccuggguuuaagcgauucuccugccucagccucccgaguagcugggauuacaggugcacgcccggcuaauuuuuguauuuuuaguagagaugggguuuucuccauguuggccaggcuggucuugaacaccugaccucaagugauccaccugcuuuggccucccaaaaugcuaggauuacaggugugagccaccgcacccagcccacaccugguucuuuuguuuuuuuuuuuuuguuuuguuuuuuguuuugagacggagucuuuuucugucgccaggcuggaguguaguggcgugaucucggcucacugcaaccucugccucccggguucaagugauucuccugccucaaccuccugaguagcugggacuacaggugugcgccaccacgcccagcuaauuuuuguauuuuuaguagagacgggguuucaccauguuggccaggauggucucgaucucuugaccuugugauccgcccaccucguccucccaaagugcugcgauuacaggcaugagccaccacaccuggcccaccuggcucuuuuuuaaguguauauuuuuuuaucgugguaaaauagauauagcauaagauuucccauuuuaagcauuuuuaagcguacaguucaguggcauucaguacagucucauugucgugcaaccauuaccaccaaccaucuccagaacuuuuucaccuuucaaaacagaaaugguaccauuaaacgcuaacuugccacccccagcccuuggcaggugccuuuguacuuucugauccuugugaaguugacuacucugggcaccccuuggagauagaaccacauguauuuguccuuucaugacuggccuaguucgcccagcguagugucuucaaguucaucuguguuguagcgugugucaauuguaugucaccccauguuuuauuuuuccacucaucuguuagacaucuggacuauuuuggccuuuuguuugcuguuagcaugggugugcaaauguguguuccaggcucuacuuuucaguucuucagcguaauacccaaaagcugaauucuaggucaaaugguaguucuagguuuaauuuuuugagggacuggcgucugugccuuuucucaaacuaaaauauaacuggauaaguuccuagugcggccagggccuucccuggaaugccguauuugugaaggaugcugaccagccacuucuagaggaacugaggcgaccguggagucagugccugcgaggucucggccuccugggaagaguagcucggccccagcucacagcguggcaggaaggucacuugccagcagcuggggaacuuaagcucuuugagggaccugaauaaaagagauaugagacugaauguacaaacagacaugacuggaccccguuaccuucaaggaccccccaggaggccacaggccagcuuguggagccgggugcugucacuagcaaccauccgggaagccaugcaguaacuagagucuaugcugucagccccacauggccagggcuugauugacuggcagcuuccugaaguuuugucucugcuuccauccaacuugagaccaaguagagaacccauaggugcacguaacggaucgauggguagcuuuccuuggagccucucccaggcaaacgcgagugacagcggccgagucccuugcuguugggagcucugagaacacacccucgccucaccuuugggugggcuucacucgcacaggcacuacaggagaaaccugcuggaauugcuuucuuuuuuucuuuuuuuuuuuuuuuugagacggagucucgcucugucgcgcaggcuggaguacaguggcgcuaucuuggcucacugcaagcuccgccucccggguucacuccauucuccugccucagccucccgaguagcugggauuacaggcgcccgccaccacgcccggcuaauuuuuuuguauuuuuaguagagacgggguuucaccguguuagccaggauggucuggaucuccugaccuugugauccgcccgccucggccucccaaagugcugagauuacaggcaugagcgacugcgccuggcauuuuuuuuuuuuuuuuuuuuuuuugggacagggucaggcucuguugcccaggcuggagugcaguggcgugaucucagcucgcuguaaccuccaccucccgggcucaagcaauccuuccccaguagcugggacuacaggcacacgccaccaugccuggcuaguuuuuguauauauuauagagacuggguuucaccagauugccuaggcuggucuugaacuccugggcucaggugaucagccugcccuggccucccaaagugcugggauuacaggcaugagccagcgugcccggccgaagccuggugguuucuuaggcuuaguuuccagcccuccaaauagcagauuguugaugguguucaagggcaaucuaagauuccuucugaagauagccagggagaagcugcuuuugugcccucauugcuguuugacacugcauggcccuaaauuagucaaagaagcauaaggaggcuuaguuaaauugaacucucacugcaccauguaauggucaggucagucucaugaguccugcccuuuuguguuaaagaauccuuugcggccggcauaguggcucacgccuguaaucccagcacuuugagaggcugaggggggcggaucgcaaggucaggaguuugagacccgccuggccaacauagugaaaccccaucucugcuaaaaauacaaaaauuagcugggcaugauggugcaugccuauagccccaucugcuuggggggcugaagcaggagaaucacuugaacccaggagguggagguugcagugagccgagauugugccauugcacuccggccuggguaacagagcgagacuccaucucaaaaaagaaaaaaaaaagaaagaaaggaaaggaaggaaagaaagaaggaaggaaggaaagaaggaaagaaagagagagacagacagaaagagagagagaaagaaagaaagaaagaaaagaaagaaagaaagaaagaaagaaagaaagaaagaaagaaagaagaaagaaagaaagaaagaaagagaaaaaagaaaagaaagaaagagaacagaaagaaaugcgacugaacuuugcccaguggaaaacgaccagugccuuguggcuguugggcccaguuuugcgucaguuugucaacgcauuuccaguuuccccguugccugcgcacacaguucuuggacuccuuugaaugguuuuaacaucgcuguuuccccuguuaaaaaaugaguuaauaaaaccuuucacauguguucacguaagaacaacaacaggccggcugcaguggcucacgccuguaaucccagcacuuugggaggccgaaggaggguggaucaugaggucaggaguuccagaccagccuggcuaacauagugaaaccccaucucugcuaaaaauacaaaaauuagucaggugugguggugugugccuguaauccuagcuacucaggaggcugaggcaggagacuugcuugaacccagaaggcagagguugcagugagccgagaucgugccauuguacuccugccugggcgacagagugagacuccgucucagaaaaacaaacaaacaaacaaaaaaccaaaaaggaaaucaccuucuccaaacccuuuauuuuucuuuucuuuuuuuuuuuuuuuugagacggaguuugcucuugucgcccaggcuguagugcaguagugcgaucucugcugacugcaacccccgccucccagguucaagugauucuucugccuuagccuccugaguagcuggauuacagguacgcgccaccacacccggcuaauuuuuguauuuuuagcagagacaagguuucaccauguugaccaggauggucucagucucuugaccucgugauccacccgccucagccucccaaagugcugggauuacaggcaugagccaccacgcccggccuccaaacccuuuauuuuucugaagacaccaaggcacaaaaaagugaagugucaggaauuccuuucccuaccccucuccuuuucugauuaauucuugggcauucuucagcccugacccaaauggcacugccccuucucugggucaccaaucuaggccaugguccauguguguucacauuuccggguuggagcuuuccuuggcacugcacggagcaugcugugaaguuugguggguggaucgacguuccuagagcagcacgauguuccuaaauuagcgggcauggugcugggcaccuguagucccaucuacucgggaggcugaggcaggagaauggcgugaaccugggaggcggagcuugcagugagcugagaucgugccaccgcacuccagccugggcgacagagcaagacuccgacucaaaaaaaaaaaaaaaaaaaagaaaagaaaaaaagaaauucaggccaggcacgguggcucacgccuguaaucccagcauuuugggaggccaaggugggcgaucaugaagucaggaguucaagaccagccugcccaacauagugaaaguccgucucuacuaaaaauacaaaaauuagccgggugugguggcacacaccuguagucccaguuacucaggaggcuaaggcaggagaaucgcuagaaucugggaggcggagguugcagugagccaagaccaugccauuguacuccagccuggguuacacaggugagacucugucuccaaaaaaaacacaaacaaaaacaaaaacaaaaaaacuggaaaagaaauucagugagucagcuguuuccugugagugggacuaggaagacagggaugauguugaccaaggagaggacugcccugcagauaucuggcccuuaaaaaucuucuucugggagcaccugugugcugugcuuguccccgugugacccaugccucuaucugaccaacugcaugguguuuucaaugaguuccaggacauuuggcuuccagagugcaugggaggcacauaggccucagaagcaaagcuggcaucugagcauacucgugagggccuggcgcccccuggcucagcagcagcgaagcugcccccugcccucccugggcacccuggagccucagucgugucuccgaaaccagggcagaagcgccuuccuggcgaggccguggugaggauuggaggggaggccugcggaggggccuggcggugccugcugggguccuuguugucagagaugguauuugucacccccgucuggcaaaguccuggagacugggggaaugucacccccauccggcagaguccuggagacugggggaaugucacccccgcccggcagaguccuggagacugggggaaugucacccccauccggcagaguccuggagacugggggaaugucacccccaucuggcagaguccuggagaaugggggaaugucaccccuguccugcagaguccuggagacugggggaaugucacccccguccggcagaguccuggagacugggggaaugucaccccuguccggcagaguccuggagacugggggaaugucaccccaguccugcagaguccuggagacuaggggaaugucacccccaucuggcagaguccuggagacugggggaauggcacaugcagggcucggcaccucacccugcucacugcgagggccuuggggaaccuggcugugaguguccuggcaugagggcagccucacugaggugaggcaggguauuucccguuucccaucugccuggccgucuucccacuggcccuuggaagagagagggcaugaacuccuggcugcgugaguuuccuucuuacuagcaacuuuguuuaggaguugggaugggcguagggccgcuauugacgggggagccucugugguuuccagggcgucugcauccacgcccuccuaggcccacucacagcugcaguugacucauuggauuucuucuuaagugacaaaugaagccagagguuacccgaugcagggcuggugcuccaccuaaaguugaccagccaggccuaggaaugccacucccugcuccuaaagcccuccaagaccguugccuaggggaggcggccucaugucccaagggauggggcccccagggucugggccguguggccucaaggcacagcucaggggagcugcccucacucuguccucucccgagacugccacaacaccuugccccucuguuaucccauaugaucauggauuugauagaaaaugucccauuggggggcugggcgcggugguucacgccuguaauccuagcacuuugggaggcugaggcgggcggaucaugaggucaggagaucaagaccauccuggcuaacacggugaaaccccgucucuacuaaaaauacaaaaaauuagccaggcgugguggugggcgccuguaguccuagcuacucaggaggcugaggcaggagaauggcgugaacccgggaggcggagcuugcagugagccgagauugcgccacugcacuccagccugggugacagagcgagacuccaucucaaaaaaaaaaaaaaaaaaaagacugggcgcgguggcucaugccuguaaucccagcacuucgggaggccaagacgggcggaucacgaggucaggagauccagaccauccuggcuaacacggugaaaccccgucuguacgaaaaauacaaaaaguuagcugggcgugguggcgggcaccuguagucccagcuacucgggaggcugaggcagaagaaucccuggaacccgggaaguggagcaugcagugagccaagaucaugccacugcacuccagccugggcgacacagugagacuccgucucaaaaaaaaaaaaugucccauugggguacucaucacagcccugucuuuaguggugacaaugcuaagcuauucacaugcccaacacugggguuagugguauucacuguguaugugacacaccagcauggguuagugguauuccuccaugaugugacaacaucgguaugggucagugguauucugcuguguaugugacacaccaguuuggauuaguggguauucugccaugcauaugacacugguauggguuagugguauuugcuauguauuugaacacacugguaugggacuucggcccugagcacuagugacacuuugagcuggaugaguuguggguuugagcugaugagccgugcccccacugcuacccgcuacgugccaggagcacaccccccauaaaugucuccagacagcuccagauauuuccuggguauccaagucgcccuggcagagaaacacugcaugagacacggcguuagggucuggugggagacucaccacagugccaagguggcugcaguuugcuugugacaugggcguguaucugagugugaaggaagcugguuuuugugagcugccucccgagcucagaggugacagugggcacuuuccccacagagaccccugaaguuguuccuuggagaacaaaguggugaggggcggggauuccagaccuugaggcagaagcuagggucugguccacuguucuguggacugggcaguggcccugggaggugccguggccucuguggccuguuuccugggguggggucugucuugcgcuuugucucuugugggugcagacuccccuuccucugcuguggagccggcagauggccccggagccagauccuggugccucccuguccacaugcagcucagucauuugcucuuggucccuuccuaugaaaugcacggccacacacagccaggguuucuccugggcuccccagagggagaguagggugcagccugcaacagugcaggguccccaggccugugugagcccccagguggggaggugggugaugcgcaugucagugcuaccuccugccaccuccucucugccugggcacaggcuuucuccucuguuugcuuuuuauuuccuauguauucaggaaccaugugaaauugccaaugcuugguuuuguccuacaaaauggccauuucauuugguucaaccugauauugugucuacacacacacacgcacacacacacacacacaggcaaauacuuuuuaaaacaggauuauucuauucacaguguucuguagaaauuuguguucagucuuuuuuuuuuuuuuugagacggagucucgcucugucgcccaggucggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccucagucuuuuuaagacagcuuacuguacugaugccgcacagaucuuuuuuuuuuuucgagacaggguuucacucucgcccaggcuggagugcaguggugcaaucuccgcucacugcagccuccaccuccuggguguaagugauccuccugcuucagccccccaaguagcugggcccacagggcuugcaucaccacaccuggcuaauuuuguauuuuuguagagaugggguuucaccauguuggccagacuggucauucuuuuugagauggagucucgcucugucgcccaggcuggagugcaguggcgugaucucggcuuacugcaaccucucccucccaaguucaugccauucuccugccucagccucccgaguagcugggacuacaggcgcccgccaccacgcccggcuaauuuuuuguauuuuuaguagagacaggguuucaccgcauuagccaggguggucucgaucuccugaccucaugauccacccgccucggccucccaaagugcugggauuacaggcaugagcuacugcguccagccggaagauuuaauuuuuuaauugucaaauccauucucucucucuauaaacauuuuacauuuuaugauaauaaaauaauuugugagcccacggccccguuucccugaugccugaggucuuccuggggcggcaugggagggcugaauucaggugcggggucggccccagggcacugagcgccugggugaguaucuggaaugaggaaaacaaagcuuggcucccgccaaggagaaagaaacucaggaugcggggcucaggccaggaccucggcucagccgccauuucuggagcacaggccagcuucgucguccucccgagggguccugaccagggcuucccaggagcggccgcccacucugugugucccuuuccaggucgccacugggacacugugaaccaggagugagucggagcugccgcgcugcccaggccauggacugugaggucagaggccagauccccugcgggugccuuguggggggcggggucgagggguaagggccugcgugucccccaccacgcaucccugagggcugaggcugagcccgccuggcccuuaccacagcucggcacagacgaaccccgcccagccccuucacugaagcaggcgggagccgggaaguccuaccuuucccuguccugcgccuuccucgcacuccgcuuguggugcagccccuccacaccgcgccuggggcuaacugcaagggcgagggggcuuuggguuuaagaccauuuaacagccauaggcugugggucccagcacuuugggaggccaaggcaggaggauuccuugaggccaggaggucgaggcuacagugagcugugauugugccacugcacugcagcccuguccaaacaaacacgaaagagauuuaagaagaagaaagggggcauuagauaagcacuucauauaauucucucaacuguaaaagcaagacaauacuuaccuugucuaaccaaugccauugcuaugaggagcaaauaaaucaauaaaggucaaauaaaaguacuguaaacuguaagguguuucaaaaauuuuuuaacccacuggauuuaaauuucccuucauagcugggcgagguggcuuaggcacauaaucccagugacuugggaggcagaagcgagaggauugcuugaagccaggaguuugauugagacaaaccugggcaacauaguaagaccccgucuuuauaaagauaaaagcgguggaguucugggaggggagcccggagcccccgccuucagcaggacgcucccuggaugcuuccuugucucuccuucccuuuaaauggucuggggagagaaaaaucacagcacacgggugcucucucccacccgcugcaucacauccuccuccccucccuccugccgaauucugcagccucugggcgccucacgcuguccuggcagccucugggaaggcaucugcgaagucuaaugccuuggcacuuagugacugugucgcaguuccugagcauggagagcacccggcacccaggagguucucaagcugccccuacuggggguccuuuccaaagguggggacgguguggauuucagcgugguggcuggagggcugaggcaguggcucgaguuugauguuaguuacauaaacagaggagauugcaggagcucccccggcccugauccaggcuuguugucaguguccaaaagaccacucugggugccacugucccuucccaccugccgcugcuguuccggcuucgcgcucuggcggccuccgcagguagaacaccaccgucacccgcgcagcgcccugacucgccggaggaggcgccugcccucccgcccgccucuccccggcccccucagugagggaggguggacgucgccacuccccuuucuugccuucggagugaggaagcggaggcagcaguacggcagcccgcccagggccacagagcuggggucacagcgaaacacuccgaaacuuucuuuucaauuauaggguucagccuuuuuucccaucauaacuuuaauucuguguagauacuucuauuuuuuauuuuuauuuuuuuuuuugagauugagucucugugucgcccaggcuggagugcaguggcacgaucuccgcucacugcaggcuccgccucccggguucaggccauucuccugccucagccucccgaguagcugggacuacaggcgcccgccaccacgcccggcucauuuuuuguaucuuaguaaagacgggguuucaccguguuagccaggauggucucgaucuccugaccucgugauccgcccgucugggccucccaaagugcugggauuacaggcgugagccaccgugcccggccuuauuauuauuauuuuuuugagacgcaguuuugcucugucgcccaggcuggagugcagugaugugaucuccgcucacugccagcuccgccucccaaguucaugccauucuccugccucagccucucgaguagcugggacuacaggcgcccaccaccacgcccggcuaauuuuuuauauuuuaguaaagacgggguuucaccguguuagccaggauggucucgaucuccugaccucgcgaucugcccgccucggccucccauagugcugggauugcaggcgugagccaccgcaccuggcuaauuuuuguauuuuuaguagagaugggguuucaccauguugcccaggauguucucgaccucuugaccucaugauccgcccgccucggcuucccaaagugcugggauuacaggcgugagccaccgcgcccggccagcaccaucuuuuccuuuccacuggaacugaucuuauuauuuuugccuccauuagaucauuuuuguaacaugucuugcaggauuuacugucuugaucguuucucuuaacauauuuuuuuccugugaucuaaaaagauaaaaaacuaucaauucuuuuaucaaaaguggaucuagaggcugggcaugguggcucacgccaguaaucccagcacuuugggaggccaaggugggcagaucaccugaggucaagagcuccagaccagccuggccaacauggugaagccccaucuuuacuaaaaauacaaaaauuagccaggcgugguggcacgugccuguaaccccagcuacuugggaggcugaggcaggagaauccauugaaccugggaggcagagguugcagugagcugagauggcaccauuguacuccagccugggcaacagaaugagacucugucuccaaaaacaaaguggaucuagaagaucaaaaaagggcaugauuccauauuggcacagcacaagcccuauucuuggaauuaaauggcauccaucuuccgagcccacuccuguccugcagggccggcccagccugucccugaggcacugguccagacaggagccuguccacacagcuguccacucagugggcccagugcuuggcuucacggucacuugcggcaccuagaccuccucuggcaggugccauucuuuccucucccucccugccgccucgagucuuuauuuucugugggaucuugaguuugauaaccugaccugcugugguggcagcaccgcucuguguccagauucuggaugccaauuuaccaagcgcaggucaaaaagaaguccuugggcagcggcugccugcguuagcuucuuggggcugcuguaggcgguuccaagcaggagaguggcuuuaaacaacagaugcggauccccucccgguucuagaggcccaaaggcuggaaucccauguugcccggcugcuuccuucuggggcgcucuccuggcuccuguggcugccucugucuucacauggcguccucucugugugucucugcuuaaaucucccucuccuuucucuuacaaagacaccagucauuggauuuagggcccacccuaauccaauaugaccucaucuuaacuugauuacaucuguaaaaaccuuauuuucaaauaaggucacauugacagguacuugggguuaggacuugcgcuuuucuuuuugggugacacagcuuagcccagcacuaacugugucaccaggacugucgcuugaggcaggaaugaagcacauccuguuuguaagcugucuugugccaugcggcugcuccguacaagaauuguuaggaauugaugcaguggaauuuugcauacaguuuuuccucucuucagaaacaacuuuggagaaguaaaggcugaauagcaauacacaagcaccuuauuuuauuuuauuuuagauucaggggcacguguacauguuugucacaugggaauauugugcacugguggggacugggcuuccgguaucgcauggagagggacucuuucugcgcucccccgcccccgccucccuacuguaaagugcccggugccugcucucuccaucuucguguccaugggcacccauuguuuagcucccacuuauaagugagaacagucaguauuugauuuucuguuucugaguuaguucacuuaggguaauggccucuagcuccauccguguugcugcagaggacaugauuuuauucuuuuuuauggcugcagcaauacacaagcuccuuauuuuuauuuauuuauuuauuuauuuuuguuguuuguuuguuuguuuugagacggagucuggcucucgucccccaggcuggagugcaauggcgcgaucucggcucauugcaaccuccaccucccggguucaagcgauucuccugccucagccucccaaguagcugggacuacagacgcccgccaccaggcccggcuaauuuuuguauuuuuaguagagacaagguuucaucauguuggccaggcuggucucaaacuccugacuucgugauccgcccgccucggccucccaaagugcugggauuacaggcgugagccaccgcgcccggccaagcuccuuauuuuaagcauuuuuuuuuucuuuuuugagacaggguuucacuuugucacccagguuggagugcaguggugugaucauggcucauugcagccucaaacuucugggcucaagugaccuucccgccucagucucaugaguagcugggacugcaggugcaugccaccuuggcuaauuuuuauuuuuuguagagauggggaucuuguugccaggcuggucucaaauuccugggcucaaacgauccuccugccucugccucccagagugccgggauuacaggcaucaccuagcaaagcauuaaaacaauuugcugcugggugcaguaggucacaccuguaaucccagcacuuugagaggccaaggaguuggggggaguuggggggcgggcggaucacgaggucaggaguucgagaccagccugaccaacauggugaaaccucgucucuacuaaaaauacaaaaauuagccgggcguggugaugcacaccuguaaucccagcuacucaggaagcugaggcgggagaaucauuugaacccaggaagcggagguuguagugagccgagaucacaccacugcacuccagccugggugacagagcgagacuccaucucaaaacaaaaacaaaaacaaaaaaacaauuugcccuguaagaacuguccucuaaaaguuuuugguuuuucuaaugaaaaauauuauggacuuagagaauagaaauaaauuucugccuacacuuccaucuucccucccacccuucucuggcagcccaggaggucuuuuugugugaaucugcgcagaucucagcgucccugcccuucuuuguguuuuguucucucuuccaccuuaggucuuucucuggucugggcacacccagcugcagggcucaccuuugccuguaagaauacagcccccaaacacagucaguaccccaagaacagucccugccaucucuggcggcacagaugcuggccaagcugcagcugccagugcugcccagggagcuggagagcugccggccaagagcccagccccucuggguagagcaggagccagugccaccacucccugugggauucggauuaaggacacacccacccaaaguaaaccaagcuuggccaaaggcaggugcccagcuguggucaccacuccgcaguaguuacugaaaaucuuccaucugcccaauacccuccugagcccgugaaggagaugagcggaaagaggcuccgccuguuggaagcacagccaggaaaggugggcucagauugcugaagccugcaggggaacuugaagaaagcgugccagcacaggauggcggaugaugcccgcaugacacucgcucgccuccccggaacagccuguggccuucucaccuagugggaagcuccccagccgcguguuucaggagguccagcagauuccucugcagaggaaucccuuucugcagagucggggcucgcucccugccaucuacgggcagugcugcuuaaagcuguggcugcagaccuugccucugccuguugagaccuccugcagggcccuccagcccacagggucccucagcucucugggaccugugaggcucuuugggccagcugcaacuggagcucuuugcaggaggggccucuggccuggcugaagucccggcuuccugacuccccuuuccccucaggucaacaacgguuccagccucagggaugagugcaucacaaaccuacugguguuuggcuuccuccaaagcuguucugacaacagcuuccgcagagagcuggacgcacugggccacgagcugccagugcuggcuccccagugggagggcuacgaugagcugcagacugauggcaaccgcagcagccacucccgcuugggaagaauagaggcagguaggcggccggccccaccuccuuccccaaagcugggcuucucugucgccaguaacauucagggagccucagggcuggaagggacccccgggaucacucugccucugcaguuucagcugccacguacgcugguaucacuuaaucacuugacuggucucuacuugauucccuccagugcugcugaacucacugccuaccauuuuugggugacucuguuagaaaguucuuccuuucuguugagacagaaucucauguacuggucuugagucccuugucuggaccaacauagaaugguguuuuuauccaauuuuccaaaugugauucugauacaaagauugcagaccacuugucuggauuauauaacccaagggguucucacacuuggccuuguaucauuucaaggaccuggagcuuuaaaugcuggugccugcaucucaccuccagagauucugauugguuggucugggcauugcugggucugggcaaagcccccagguggcacuaccggugcggccccugccuccccaagcaggccuggcugacugucccauugauugaggcccacugguuucacagugacuuuugcacugucuauaccugacauauuuccuuucauacauuaugcuccgugauuaccuauacaagaacacagaaguauuuggaaccucauuuccaggugaggaaacccagguccagcaaaggguaaaugacuagcuccagaucacacagcuuguggccauguuaccacugggacauggggccaggccccuucuugaggugggccucagccgcccucccacuguagggcacugacuccaggucaccaugguuuccagacuguucaccuuuccuguugcugaucccugcacucuccuccagccuccagcuccacuccccuuugccaaggggcugcuucuauggacaggggcugucccgaguggaggcugggggcgaguggaggcucacccacuuccagauccagcccugcgacgcuggcuuucaguagugugcacauuggaauuacacgagaaaccuuuuccaaaugcaggccuugggcccuacuccagcugccugcaucaggcuguuuuagggcgggagacugcccagaggauucugacgcagguagaaucccugcccugaaagccugcagggauccccggacccugguccaggccuuccaagcucaaggguugcacugcccucugguggcugugggggagaccaacagcugacccagccuucugccucccgccugucuuagaucaggugcuugaggacguggcuggaguuccccacuagaccggggugggggugggggugggggguggggggaggugucugagaaugucucugccuucuaauccagccagcauaucuucuggcucgcccugaacugaggagaaaccccagaucccuuugggaagguccaggaagggcaggaguggacaggcacagcucugcugucagcacugcugugggggugacuguagccccagucugcccugguguuuuucucucgcucuucuccaugccggccuuugccucuagacugagaaaccgggguugacucaaguggcaccugcaaaagugaucauggcaguucacuuagccugcaggugacagggacugugaaucuagucccuggcgagccuggaaagaggggcaagguagaggcucuggcugccgggguuucuuuggugaguccguucacucggcuggacacagacggaucaggaaagauuccuguugcuacucggcugguggccagagggagagaggacguguccguaacugaagcaagguggauaagcuucgggaacgagcgaggcacagauucggugcugggggagugaugaggugcuggaggagcugggugcucugcucugcagggaaucaggaaaacuuuggggcugcagcuccaauugagcugggccuuggggguuggguauguuugguuccuuggaaacugggaagagggaauggccaucuuuuaagcaaaagcccagcggcuauaaaugcuacagugaggcugggugcagugguucacgccuguaaucccagcacuuugggaggccaaggcagguggaucaugaggucaggaguucaagaccacccuagccaagauggugaaaccccgucucuacuaaaaaaaauauauaaaaauuagccaggcgggguggcgggugccuguaaucccagcuacuugggaggcugagguagagaauuguuugaacccgggaagcggagguugcagugagcugagauuguaccacugcacuccagcuuggggaacagagugagacuaugucuugaaaaaaaaaagaaaaaaaaaagcuacagugaguaguugaguuugccuaggaagcguggaaguuaagucagacguacuuucaggcugggucaugacuugucacuuaagcagagaugagcacuugagagguuuugaagagaagugauguggcagccuuacugcauguuccauggacagacuccagggaggccgugaaacccccagagcacagcuucuaagaacgugcccacuccuuagcacgucacuucucccaacccugcccugcucugaggucugugcugugaagguggccgaguagacuggacggcagggaguggggcugucaucaucagaugagagcuaaggggacccccaccaggguggcggcaauggcagaggguaggcaaaacgcuuguauuugcaacauaaggugagauuugacagcugaccgagggugggagcagcagccaaaaccaaaaaagccagagggaaguugcaagcacagaaaaaauagaagauuuaaugggagaaauaacaauagcuggcaucuauugaacacuuacugggagcuagguacagggcccauucauucauucaugcaauuaaaacuuuuuuuaagaaacggggucuugcucuguugcccaggcuggaguguagugguaugaucacagcucacugcagccuugaauuccuggccucaaggaguccucccaccucagccuccuguguagcugggauuauagguacgugcgguacaccuggcucccuuuaaaaguuuuuuguagaggcagggcacaguggcucacaccuguaaucccagcacuuugggaggccaaggcaggaggaucacaaggucaggaguucgagaccagccugaccaacauggugaaacccgucucuacuuaaaauacaaaaauuagccgggugugguggcgggcgccuguaaucccagcuacucaggaggcugaagcaugagacuugcuugaacccaggaggcgaagguugcagugagccgagaucgcgccacugcacuccagccugggugacagagcaagacuccgucucaaaaaaaaaaaaaaaguuucuuguagaggcagggccuugcuuuguugcuggugcaaucacggcucacugcauccucuaacuccuggccuuaagcaaucuucuguccucagccucccaaagcacugggauuacaggcaugcaugaccacaccuggucccugccauuguuuauugagcaccuacugagugccauguauuaagugcuggguauuugucaguggacaaaacagauuaaaaaaaucacagcccuuagggagcuuaccuucuggcaggggcgucagacaauaacacagcaagugcugaggaagaaacggaggcggcagggagcguggcaguugagcguggccuucauggagcugcgacagugguacucgggcaggggcagcacggaggcugugcgccagaggaggaggacugaggggcaagggggagagcucugguuggaaaggcaggggagauucuccagggccuugccggugccagugacaacugggguuuuccugagacgggacugcgaggaaugggggcucucaggcuugagagggcaaaagugggucugggaugccgucugcccacagagccccuuccccaacggcugcccaggccaaggccaacccuguuggguuguguggugugagccaugaagccgcugccaggcuuguaccucaggcguggucgugaugccccagcuucaccggcccugccuguggggacguggugccugugugcgggagccugggccucagccgaggcccugagcuccggcacugcccagaacccagcucagcgcugguacucagcccgcccgcuguggcccugguggaguggagcacgugcccagugggggcuggccuugucccaucgcggaccuguccuuucccggggcaggguggugugggagaggguaucagggacauuuucugagucugcucugucucugccgccccugccugaacacagauucugaaagucaagaagacaucauccggaauauugccaggcaccucgcccaggucggggacagcauggaccguagcaucccuccgggccuggugaacggccuggcccugcagcucaggaacaccagccggucggaggaggugagugagggccugaggaccgcgugggcgggcaagugagccaagggggccuguccccugccucucaccaggcagcccacugucccgugaggccacucaacucgugacugucagguccagaacucugacgaaguaacuggacguaggguaugguucauugccuugcagaagauuucagcugguugacaucgaggaaaccugaaccuuaaaucagaguaaagaguuuagggguaaaagccucuaaaagaugaacgaagcauguuuggccaacagaagaaacagacgcuuccuuugguuguagggaguuuaauaauggugccagugagaaccguaagcccugggaguggugccugcugcucugcugagcuccuugguuggaauccacacaacuuucugagcucuaccaucugcuuggcacuguuggggauacaagauugguccggggcacuguguccccagaacacuuagcggaaagaacuacauccucccaacugccaaaugcaggccuguagcgguaggagcugagaggagagaaaguuccacuuuuucgacucuaccagcugaaaaugcaggcguccucaccuccuagaaauccaaucaugcuucuguucaguggggccagccugugaugucccagcagcugccuagaacgcaggaguggcuggcgcacucccauguaacucugcaugugcgccgaccgccugacgguccuugccagccuuguagucugucuagugucccccaggaacccccuuccuccuguccauucagcuaggucugcaccaauaaaaugggccuaaggcgucgcagguggucacuaguucuggacucgaagugccuugggcgcagggaugacccaggcuucuuguaucccaucaccgucuaacagugggcacaugggcucaccacacaugcguuugcuuaccgagcccccugcagggagugauugcagucuucccuuuccauugccucucagaacucaacuguuucucauucuuuccgcccagcagcccuggauacuuaauaaguacuuugaagugcuucuucauacuggggacugucuuuccuuugagagggaagaguauuaguaaaccagguucugugugccccucugugcaggaccggaacagggaccuggccacugcccuggagcagcugcugcaggccuacccuagagacauggagaaggagaagaccaugcuggugcuggcccugcugcuggccaagaagguggccagucacacgccguccuugcuccgugaugucuuucacacaacagugaauuuuauuaaccagaaccuacgcaccuacgugaggagcuuagccagaaauguaagaacccuugaggucagcuccuucccugccugccgcccaugcccuuuucucuggaagguugagaagcccagcggggccccugccucugaugccagcacaaggguuacaggcuguccugcucggguuugguuuugcuguugugagcuagaaagcuguguguaaaggugacgaagagcacccagaguccuuuggagcuuuagcagcuuacuauuggagacaugcuccauucagagggguggcaaaggcucacgucacacuccuggugggguccucaaggcacaagcagguacagaguggaaggaaggggcuggagggcucacaaugagcuuuucagaccucucaccuugccauaaaaaauaaguguaauguggccagugcgguggcucaugccugugaucccacugcucugggaggccaaggcagguggaucaccugaggucaggaguuccagaccacccuggccaacagggugaaagcccgucucuacuaaaauacaaaaauuagccgggcaugguggcgcacaccuguagucccagcuacucaggaggcugaggcaggagaacugcuugaacccuggaggcagagguugcagugaacugagaucgcaccacugcacuuuagccugggcgacagagcaagacuccaucucaaaaaaaagguguaaugugaaccaaaacgaguagucaaaaaagggggggaacugucugaaaucuuuuccagagcacaucugucccauaaccagguauuacaagucacagucuaaaggcugggcaugguggcucaagccuguaaucccagcgauuugggaagcagaagcagugggauugcuugaggccaggaguuugagacaaaacugagcaacauggcgagacccugucucuaaaaaauuuauaaaaauaauuagcugagggccaggcgcgguggcucacgccuguaaucccagcacuuugggaggccaaggcaggcggaucaugaagucaggaguucaagaccagccuggccaagauggugaaaccccguuucuacuaaaaauacaaaaaaaauuagcugggugugguggcgggcgccuguaaucccagcuacucaggaggcuaaggcaggagaaucgcuugaacccugguggcagagguugcagugagccgcaaucacgccacugcacuccagccuggaugaugggguaagacugucucaaaaaaaaaaaaaauuagcugagcaugguggcguacgccuguaguucacgccgucauggagguugaggcagcuccucaggaggcuggggcagaaggaucucuuugcuugagcccaggaguucaaggcugcagugagcugauugugccacugcacuccagccugaacaaaaacaagaccugucucuaaaaacaaacauacaguguucacaaugcugcccaagaagggccaguuuuugcagcugcccccauguagcaaaaucuggugcuucuguuucauagacccaaauggaaauuaaguggaugugucuuauuuguaaauuuaaaaauauuagcgaauguuugggaauuuuuuuuuuuuuuuuuuuugagacagaauuuugcucuuguugcccaggcuggagugcaauggcacgaucucagcucaccacaaccucugccucccagguucaagcgauucuccugccucagccccccaagaagcugggauuacaggcacacaccaccaugaccggcuaauuuuguauuuuuaguagagaugagguuucucccauguuaggcuggucucgaacucccaaccucaggugauccgcccaccucggccucccaaagugcugggauuacaggcgugagccacugcgcccggccuaauguuugggauuuuaugacaugucagaagcauuacuucaggcuuugguuuuuaaguaaaauagcaucuaauccucuacugagaacucauaagaaaacauuccuuauaugcuguggucuucaguuauacaagcauuuuaaaaacaggagaaugaauauaaaucuuaaaucaggcauuaaacccagcugaauuguuggaaggagguaagccugagaccauuccuggacagcuuuuaccaacacccauguaaagggggaaagggugggcaagacgugugcagcagucuguauggacagcuuaccagagacugagggcugaggcagaaucgugauuccucugacccagcaggggccuccugacaccgucagugccuuggagaugugaauacccaccucaccgccugaacggccuguuuuugcaguugcccccauguagcaaaaaguaggaugcacggauaggacuucaggggucuggagaacauguuuuugcauaaaccccagcuuugcucuacuguggcacagagcucuggagccugguuugugaaugagccuagcugauucuggcuuuuucuccuuucuugcucuaggggauggacugaacggacaguuccagaagugugacuggcuaaagcucgauguggucacagcuguauagcugcuuccaguguagacggagcccuggcaugucaacagcguuccuagagaagacaggcuggaagauagcugugacuucuauuuuaaagacaauguuaaacuuauaacccacuuuaaaauaucuacauuaauauacuugaaugaaaauguccauuuacacguauuugaauggccuucauaucauccacacaugaaucugcacaucuguaaaucuacacacggugccuuuauuuccacugugcagguucccacuuaaaaauuaaauuggaaagcagguuucaaggaaguagaaacaaaauacaauuuuuuugguaaaaaaaaauuacuguuuauuaaaguacaaccauagaggauggucuuacagcaggcaguauccuguuugaggaaagcaagaaucagagaaggaacauaccccuuacaaaugaaaaauuccacucaaaauagggacuaucuaucuuaauacuaaggaaccaacaaucuuccuguuuaaaaaaccacauggcacagagauucugaacuaaagugcugcacucaaaugaugggaaguccggccccaguacacaggggcuugacuuuuucaacuucguuuccuuuguuggagucaaaaagaaccacuugugguucuaaaaggugugaaggugauuuaagggcccaggucagccacuguuuguuuacaaaaucagguaacuaacugcauacacuuuuucucuuuccaugacaucaagacuuugcuaaagacaugaagccacgggugccagaagcuacugcgaugccccgggaguuagcccccugguaauagcuguaaacuuccaauuucuagccauacgcucagcucauccaugccucagaagugcaucuggagagaacagguuucuaagcauaaaagaugaaagagcaguuggacuuuuuaaaaauucagcaaagugguucccucucuuagggacagucaaaaccaagucacuuagguaguaccaaaauaaauaaggaaaagcuuagcuuuagaaacagugcaacacuggucugcuguuccagugguaagcuaugucccaggaaucaguuuaaaagcacgacaguggaugcuggguccauaucacacacauugcugugaacaggaaacuccugugaccacaacaugaggccacuggagacgcauaugaguaagggcacugacggacucaugauuucuucuuaccagaugcuuuccuguucuuuaagaguuuaaaaucaucagaaaggaaaaacaaacucuauauuguucagcaugcaauacauaccacgcuagggcuggcucaauugaaagugggcaaaagcuuacaaauacuaaaaagaagugcugccgcgcaguguggaggccacuguuuggaaauaaaucuuccuaacacuac

SEQ ID NO: 191689 - RNA, 13038 nt, Homo sapiens
ggcugcggggcugggcgagcgcaaagauguccgcgcccgcugccgggaggcgaggugagucuuugaucguaaccaggagcccggagcugaggcaguuccugcacgugucgcggggccggagaagcuagggccagguauuccagggaugcaagaauccugcaaaucugacguguaaacugcuuccccagccuccaggcgagcccagcuuuugccucagauaggccccuuccuuuuccuucucggggaaucgaccucgggaaggggugugggcaaagagaugaggacucucccucuucgcccaggccaacucgggauaucccggagccucuggggaggcggucacuccgacgucugaggaccugggccuuggacccggacucguuaugaagagcgauucuucgaccucugcagccccccucagggggcucgggggaccccugcgcagcagcgagccggugcgcgcggucccggcccgggcgccggccguggaccuucuggaggaggcggccgaccuccugguggugcaccuggacuuccgggcggcgcuggagaccugcgagcgggccuggcagagucuggccaaccacgccguggcagaggaacccgcgggcacguacgugcugggcucggaaaugaaccgauuuccgggcgcucuugugguggggcucaaggucucaggaguucuguccuucccagauugcccacaaggagcuuuacaccucgcuuucaucagugguuugucuccgagaggguggucgcucaucgugugcccauucuacagagaagggaagucguguaacaaaaacuuaguggggaucccacagccaauuauuugcuccuuguuccaagguacaaugacaugaugggaaggcugaauguguauuaagugcuaaguucugucaguaagcaggugguaaaaguccucucccagguaccuccgcccuccccgccccgcccaagguuguuuauuccugaccuuggcugaugauggggaaugggggucauggcaggagcagcguucugguccaauuagaggacuggauuaaagaauuaauucagggccgggagcuggggcuuacgccuguaaucccagcacuuugggaggccgaggcaggaggauugcuugagcccaggaguucgagaccagccuggguaacauaaugagcccucuucucuaccaaaaagaagaaaaagaaaagaauccggagaaaaaaaccuugggcuugcauugcucuuucuaaugccaccagccucgucuggcaggugagggagucauuucuuugcauuguaaacuuggguuaggccacgcuagggaggugguagguagaauagcuaaaguugaccacaaagaaggaugaucuggagagcccuggcuguguuuuaggggacugggugggagcucauuucagugaaugcagaaggcuuugcuucugggugucuggaggaaccuuacuagguggugccuuuuagccagcuauggagucuauaccuccacucagccagaaaccuugcuccaagcccauuuguucacagagcaaacucuuaguuccagcucucuuuucagccacacaccggugcuguguguuauuucccccucaggauuacccuuccucuucauuuaaaucugauuucaccuggauacaaagaugaacguugagcaacagcugacuugccucuugaaagaggguuacaggaacuuuuaguuccugggggaaagggcagcccaugagaccaauugugaagcccaucuaaauacuaacagggaugagagagaugauggcugcugaguugggagcuggagaggaacagucccaagguggaggugggaauggaaauggaggggaaccacuucuaacugaaauugguuuuucugcugacagcucauuggaggugaagugcucccuguguguuguggggauccaggcccuggcagaaauggaucgguggcaagaaguccucuccuggguccuucaguauuaccaggucccugaaaagcuaccccccaaaguccuggagcugugguaagucuucuuugcugacucaucagaucgguucagaaacgagaggauuuucaucuccucuccuaaauaccuacucuuuuccccuucccuacuauugcccuccagaucggauucuuucccuucacuuuuuuuuccccagacuuccauacauagcaauaaagaauaagggggaggaauuuaggaguagaauagauauaaagaagggaggaaacagggaauaggagcgacgugggaugacagaguggacagagcugaaagagcagcuugcuacguccuaggaauuccuaauucuuaaaaaaaaauuuuguuuuguuuuguuuuguuuuguuuuuugagacggagucucgcccugucgcccagguuggagugcaguggcacagucucugcucacugcaagcuccaccucccggguucacaccauucuccugccucagccucccgaguagcugggacuacaggcgccugccaccacgcccggcuaauuuuuuuguguuuuaaguagagacaggguuuuaccguguuagccaggauggucucaaucuccugaccucgugauccaccugccucggcaucccaaagugcugggauuacagaugugagccaucgccccuggccaaaaaauaacaaaguuuuuaaaauugacacuuguacauauuuaugggguaaauuagacauuucaauauaugcuguguauauguuguauaaugaucaaaucaggguaguuagcauauccaucaccucaugcauuuaucauuuguuugugacaggaacauucaaaagccucucuuccggcuauuuuauauauacaauaccuuacuguuaaccauaaccacccuaccgugcaauagaacaccacaacuuauuccuccuaucccaccguaacuuuguacccauugacgaaccucuucccgucuuccuuuucuuccuuccuuucccagucucugguaaccaccguucuaccgucugcuucuaugauaucaacuuuuuuuuuuuuuuaaagauucacaugagugaaaucauguaguauuuaucuuucugugccuggcuuauuucacuuaacaugaugucccccagguccaccuguguugucaugaaugacaagauuucauucuuuuuuauggcuauauaguauuccauuauauauauauauauauauauauaugcguguguguauauauauacacauauauaaacacauauauacacauaauauacauauauguacacauauacacacacacacacacacacacacacacacacacauuauccauucaucuguuguuggacacuuagguugauuccauaucuuggcuguugugaauagugcugcauuaaacaggggagauaauggauugcuagaucaugugguaguucuauuuuuauuuuuuucaccuggccauucuuaaguuuauuuugaugacacccggugacaguucccuguaccuagaagaagguguugggacucuugauguuggaguguggcuugugcugaagacacaggaccugguagggcagcaggaacuugaucuuggaauuguggaacugcuugacugucggccgguggcaguaccagaagcgggacuuggcacaacuugcuuaggugcagagauuugcuggcaguagaggggcagcauguggcauuugggggugggcaggcagcaaauacucucucagugugccccaggccuucauggcauucucucagcacuugccaccacuuacaaaaaggaagugccgucuuuccuauuuugaauuuuuuaaaggaaccugcauucuguuuuccauaauggcuguacuaauuuacagucccaccaacaguguguaagugcugccuuucuccacauccucacccgcaccaacacucguuuucuuuugucuuuuugauaagagcuguucuaacuggagcgagguagugucucauugugguuuugauuggcauuucccugaugauuaguaguguugagcauuuuuucauauaccuguuggccaugguacgucgucuucugagaaaugucuguugaggucuuuuucccuuuugaaucagguuuuuuuuuuuuuuuucugcuguuaaguuccugauauauucuggauauuaacgcuuugucagauggauaguuugcaaauauuuucucccauucuguagguuguuucuucacucuuaauugcuuccuuugcugugcagaaguuuuuaguuugaugucauuucauuuguccauuuuugcuuuuguuaccagugcuuuuaaggucuuacugaaaaaaacacuugcucagcccaguguugugaggcauuucuccugugcuuucuucuaguaguuucaugguuuuggauuuuacauuuaagucuugaauccauuuugaguuaauuuuuguauguggggaaagguaggggucuggucuccugcauauggauauccgauuuucccagcaccauuuauuaaagagacugucuuuuccccuguguguguucuuggcaccuuuguugaaaaucaguuggcuguaggugcaugaauuuauuucugggcucucuguucuguucuauuuugucuguuuuuaugccauaacaugcuguuaugguuacuguuauagcuuuguguaguaugguuugaagucagguaauaugauaccuccagcuuuguucuuuuugcucacaacugcuuuagccauuuggggucuuuugugguuccauacgaauuucaggauuguuuuuucuguuucugaagaaugccauugguguuuugauagggauugcauuaaaucuguaaauugcuuuggguauuuuaauaauauucuuccaauuugugaaugaacacgggauaucuuuccauuuuuuguguguccccuucaacuucuuucaucaauguuuuauaguuuucaguguagagaucuuuugccagcuugguuuaauuuauuccuagguaucuuauuuuuuugguagcuauuguaaaucgaauuguuuucuugaucucuuuuccaaugguucacugucacguauagaaacgcuguuuuuuguacauugauuuuuguaucccacaacuuuacugaauccguuuauuaguucugucugcaaacagggauaacuugacuuccuccuuuccaauuuggauaccuuuuauuucuuucuguugcccgauugcucuggcuaugaccuccaguacuauguugaauaaaaacggucaaaguaggcaucuuugucuugcuccugaucuuagaggaaaggcuuucagcuuuucccauugauuaugcuguuagugaugggugugucguggggaauucccaugagcaucaucauuucaucggaaagggcucgaggacacagugaggaggggcuggauaggagaagcauaguggucaugggaaaugaaccaaucauugagcacugacucuucuuuuguugggauuggguuuuuuggggacugcagcauucuuuuauacagcaaaaugcaagagccuggagcugugcuggauguggugggugccuggcuccaagacccagccaaucaaaaccuuccagaauauggagccuuggcagaauuucacgugcagcgggugcugcugccucugggcugcuuaucggaggcugaggagcuaguggugggcucugcagccuuuggugaggagcggcgacuggauguacuucaggccauucacacagcgaggcagcagcagaaacaggaacacucaggcucugaggaggcccagaagccaaaccuggaagguaggacauuaucccucugcgaccucuguaaaguggacuugcgggcuugcacuguaccucggggucugucgugaaacuccugcgagcuuagaagcaguucuuuguaugaauaacucuugagucacagaauaggaggccuguugauuugcuucacaaagugaaggccagacccucugaaguuggcaguggaaggagaaucuccacaugggaagguguugcugggucuugggaccuugacuugucuuuugaaagucauuuucccauuggaguccucugaugaggucucuugcuuccaccauacuggucugggugggauguccuuccuccuuuaaaugcuggccccaauacagacacagcugagaucugcugggauagccaaaggaauaucagaaacuaauuugcagacccuuucccuggucgcugaaucuuuuccgcccuuuuccuugagugaugaucuagucuaguugugaauacuucaaggacagaaagucaccaucucucucucuuuuuuuuuuuuuuuuuuuuuguuugagacggagucucgcucugucgcccaagcgggaaugcagugaugcgaucuccgcucacugcaagcugcaccucucagguucacgccauucuccugccucagccuccugaguagcugggacuacaggugcccgccaccacaccuggcuaauuuuuguauuuuuaguagagacgggguuucaccguguuagccaggauggucucaaucuccugaccucgugaucuggcugccuuggccucccaaagugcugggauuacuggcaugagccacugcgccuggccugaaagguucugaaagguuuuaaaaaacuuuuacaaagaugcauucaauauaguaaauaauauauagucaaaauaaguaauaaacacgaggaaaacaauuuauauucaugagauuugcaagaguaugugcaguuaaggaaugaaggcuuuagccaauaccuaauacccuuuuacuaaacucuuuuuuuuuuuuuuuugagacggaguuuugcucuuguugcccaagcuggagugcaauggcacgaucuuggcucacugcagccuccaccucccagauucaagugauucucgugccucaggcucccaaguagcugggacuacaggcgcacaccaccacgccuggcuaauuuuuguauuuuuaguagagacgggguuucaccauguuagccaggauggucucgaucuccugaccuugugauccaccugccucagccucccaaagugcugggauuacaggcaugagccacugcgccuggccugcucaggucuuagaagcaagcacagaggucggggucagggaagcugauucccaugacaucccugaagcugugcucugucucccuggccaggcucugucucccacaaguuccugucacuaccgauguugguucgccagcuuugggacucugcggugagccacuucuuuucucugcccuucaaaaagagucuccuggcugccuugauccucugucuccugguggugagauuugauccagguaagagguggagacucuccccuguccuuccugggaagggguuguugccagggcugggccugugggaguggguguuugucagaguccuacuggggaggggagucucuccuaugacauuuccccugagucuguuccacaaggaggaauugcuagacugggcaugagccagccccacccauaaggagaggccaguccuggagucuaugagagcagccaggagaaaguccacuuggcccugcugacuccugaacauggacugagucauaguccuccacuuuuucuagggcugaacucugacuagaaccucagaauuuaaaaaaacuuccucuuggccaggcacgguggcucacgccuguaaucccagcacuuugggaggccaaggcaggcagaucacaaggucaggaaaucgagaccagccuggccaacaugguaaagccccaucucuacuaaagauacaaaaaaaauuagccagguguaguggcacaugccuguagucccagcuacuugggagguugaggcaggagaauagcuugaacccgggaggcggagguugcagugagccaagaucgcacugcugcacuccagccugggcaauagagcgagacucugucucaaaacaaaaaacaaaaaacaaaaaaacuuccgcucaucagaauaucuacaaaaguguuaauucaaguauuaaugucucaugaaguguuaauucaaagcaaguuguaaaugaaaaacucauacauuuuagaaaauguggaaaauaggccggacaugguggcucacaccuguaaucccagcacuaugggaggccaaggaggguggaucaccugaggucaggaguucgagaacagccuggccaauauggugaaaccccgucucuacuaaaaauacaaaaauuagccaggugugguggugcgugccuguaaucccagcaacuggggagggugaggcagggagcauugcuugaacccaggaggcggagguugcagugagccaagauugcacuguugcccucuggccugggcuacaagagcgaaacucugucucaaaaaagaaaaaaaaauguggaaaauagagaaaaguauaaagaagggcauagaaaucugcuacucugcugugcuuucagucuuuuucuauggauauagagauuguaggcaguuacaugucacacauaugcuuucaagcauggccuuaaaucgcuaacuauuccaguucacaggaaugccccuaaguaauuuaacaaccccuauuauugaacauuugggugauuauucuguuuucugccucgcugugaagaaggaaugagcucccuaagugauauuugggaacaaccccaguuauuuccugaggauugaccccucaggugcaugaagccaaacuuggcacucgcucuuuuagauuuuuuuguguuacucagugugaguuauguucuaaucucuacucuucucaugaauuuagacuuagaauaugauuaaauaaguuucaaaauuuaagaggaaaucagaaacccuuauacuggucccuucaaaugguuugucuauuuugagaagugccauuuguuaacuuagucuuuagauucucccuguuuccccauuucucuuucucuuauucagugagcuuuuuuaaaauauuuauuuauuuauuuuuauuuuuauuuuauuuuauuuauuuaguuuuugauacugggucuuucucuguugcccaggcuggagugcaccggcgugaucuuggcucacugcaaccucugccuccuaggcucaagcgaucuucucuccucagccucccaaguaacugggacuacaggcaugugccuccaugcccggcuaauuuuuuauuuuuauuuuugagacagagucuugcucuguugcccagguugcaguggcgugaucucggcuuacugcaaccuccgccuccuggguucaagcgauucuccugccucaguaucccaaguagcugggauuacaggcacacaccaccaugccaggcuacauuuuguauuuuuaguagagacgggguuucgccauguuugccaggcuggucuccaacuucuggccuuaagugauccucucaccucagccucccacagugcugggauuauaggcacaagccaucaugccuggccagcgagguuuccgucacauagcucagaguuguccuucuaacccgucugcugaaugcugagcagggauccccuguggacgacucuguuugcuuuacaaagaagucacgaguuagcgcucggaaugcucaguaucaucagcguucaucccuggccaccuccugacugauacagauuuagaaacucuuuaugauucuuuaugguucccguaagcccuuuagucucguaaacccuggucuccuaguggggauggcaugaggacauuugagccugcucuuuccaaggcugcuucagaagggccuggcccaguggcccugacccucagcagcaggcccgacucauuggagugaugauggugggggaggagaaccugcaccugcaggcugaggaucgcaugagccccagagauugaggcugcagugagcugaacacagacugcacuguacucuagccuaggugacagagcgagacccugucucuaaaaaaaacaaaacaaaaccaacuauguguaauugguaguggagucucccagggugggagauggcagagugacaggugagaggggugggacguucacuguagucucccucugcccugcagcuuccccuuccucccugcacuuccucuacaagcuggcccagcucuuccgcuggauccggaaggcugcauuuucucgccucuaccagcuccgcauccgugacugagggucccugcgcaccacagccucucugcuccucacguccguggccacagaagcagagcgacagagcgacacauccacaggcgccccuggggaaaugggaccagccuaaucucgcggagugcacugugucuugcugccugggugcccucuccuuugcacccuacuucggcuggucgcgguagaugauguggaaacaaagcaggaccagcaggcacagcaccuccagaacagugccccggaugaccagaggccccuugaaaaggagggguuuggggacagggacuguguccaugaaacauuccaucuucuuggugaaggcaagggguugguucuucaggucaggauguuaauggagcuggaaguucagaaaaagccuggugaagugacccuuggccuuucacuucuugagaaacauacuucuuugcugggcauggugacucacgccuguaaucccagcacuuuggaagggugagguggguggaucacuuguggccaggaguucaaaaccugccuggccaacauggugaaaccccaucucuacuaaaaauacaaaaauuagcuagauguggugcacgccuauaguccuagcuacuugggaggcugaggcaggagaaucacuugagccagggaggcaaaaguugcagugagcugagauugugcuaccgcacucucucaaaacaaacaaaaaaacaugccccacaggacaguaccuuaauuagcuagaguagaucugagagggccucuucuugccugcacugugcuccccagagcugaucuaauucuguaucaauaggcuguucccauggucuugccaugcgcuugaagcugcaggagccuucucacuguucaggcuggggugugguuuucagaaccaccggguugacuacugaaaaccaagugagccuuacagcucuuaucgcuggguaaagugaucuugccuggugccucuuggucuucagcucaauuuuccagguuguccuggccaagucuugcucuguuacgcucagugccucugcccacucuuuccccgccagcccuucccucccgcccugcaaacuugucccuuggcuguuucaccagguucugccuguauccuugccuccuugguacacaccauuucagguucuucccuuucugugucccauuguccuaguuauguucuguuguuuguguaaugcccaaauuuuucugcucguguggccuugaaaaguaggccagccucagaggcugcugagcugaaaauggaacugaguaaucaggugagcuggaagggauguggggggcggggcagacgggagacauggguuuugaaggcagugaacaauaaaaccuuagggagguggcaccgaggccuuagcauuugaggagcugaaauguuucaguguuguuuucucaccagccacaagcaucuuaugaguuucugugcaaggaagcguagagcacugcugugcugucaggaugaagaagggcuuucugcaggggcuggccuuucucuacccagaggccaagcaggcugcccugcacuguguccuugguguugaugcccaaaauagagaaggugcuugcuagcuuuuccuugguacauuuucggggguugcaaggcaacaaguuuucuuuuguuuuguuuguuuguuuguuuguuuguuuuugagauggagucucugucacccaggcuggagugcaguggcgugaucucagcucacugcaagcuccgccucccggguucaugccauucuccugccucagccucccgaguagcugggacuacaggugcccaccaccucgccuggcuaauauuuuuguauuuuuaguagagucuggguuucacuguguuagccgggauggucucgaucuccugaacuugugauccacccaccuaggccucccaaagugcugggauuacaggugugagccaucgcgcccggccaacuuuucuuuagaaaaaugaguaaaguagguaaacuucacaggccccuuagaauuaaauccuuagggcaugguucaagucuguaggaagcaaaucuauacuuuuuuauaugggcuuuuaaguaaagcuuagaacccuggggggagaaaagcagucaggugagguuugagauuccuucuauagaaugauuucuuaaaaugaaaaucugggcccacuuaacuacccuagauaaaacgcuucaauggcuucccauggcucacuggauaacaucuaaauucuucauggaauugaaggccccuaugugcugguuuuggcuaagaucuccccuuugauguggguccccuguugauuauaugugcggccuuccagcugcccaccaucacagcuacagcucgcuccccuuggccucugugccuuggcucgcacuguuccuacugaaggccuagcaccugcucuuggccuggugagccccuccaccuuccaggcuuacucaaagaauucuuucugccccucccugugucccgggaccuguuucauaucgcuucuguggucgugaccccauggucuuguaauugugaacuucuuugcugccccuucgaagcuggggagugcuuguugcagaugcauccaagagggguaauugcguaucaacaguggauuugcugguuguuucuacaggguucugaagcaugcaacauagaacagauaccuuuaaauuuaggggcgcuaaggaaagcaggaaccaguaauccucuucuguggugggaugggagggugggggagagggguggaauggagaggaaacaggcuauuguuggccagcccuggguggaggugggugcaagcaggacagauagugccugggggugggggcggaggguucgccucuaggaaggggcuagaagggaugaggaaauaguucauagcuucgugcaggugaucccuauucugcguguauguguuugcacaugaguguuuguagaccauagaccauuaaaaaauacggaauucaaaaguuacaaaaagggua

SEQ ID NO: 191690 - RNA, 10681 nt, Homo sapiens
agagaaccaucauuaauugaagugagauuuuucuggccugagacuugcagggaggcaagaagacacucuggacaccacuauggacagguaaagaggcagucuucucgugggugauugcacuggccuuccucucagagcaaaucugaguaaugagacugguagcuaucccuuucucucauguaacugucugacugauaagaucagcuugaucaauaugcauauauauuuuuugaucugucuccuuuucuucuauucagaucuuauacgcugucagcccaauucuuucuguuucagacuucucuugauuucccucuuuuucauguggcaaaagaaguagugcguacaauguacugauucguccugagauuuguaccaugguugaaacuaauuuaugguaauaauauuaacauagcaaaucuuuagagacucaaaucaugaaaagguaauagcaguacuguacuaaaaacgguagugcuaauuuucguaauaauuuuguaaauauucaacaguaaaacaacuugaagacacacuuuccuagggaggcguuacugaaauaauuuagcuauaguaagaaaauuuguaauuuuagaaaugccaagcauucuaaauuaauugcuugaaagucacuaugauuguguccauuauaaggagacaaauucauucaagcaaguuauuuaauguuaaaggcccaauuguuaggcaguuaauggcacuuuuacuauuaacuaaucuuuccauuuguucagacguagcuuaacuuaccucuuaggugugaauuugguuaagguccucauaaugucuuuaugugcaguuuuugauagguuauugucauagaacuuauucuauuccuacauuuaugauuacuauggauguaugagaauaacaccuaauccuuauacuuuaccucaauuuaacuccuuuauaaagaacuuacauuacagaauaaagauuuuuuaaaaauauauuuuuuuguagagacagggucuuagcccagccgaggcuggucucuaaguccuggcccaagcgauccuccugccugggccuccuaaagugcuggaauuauagacaugagccaucacauccaauauacagaauaaagauuuuuaauggaggauuuaauguucuucagaaaauuuucuugaggucagacaaugucaaaugucuccucaguuuacacugagauuuugaaaacaagucugagcuauagguccuugugaaggguccauuggaaauacuuguucaaaguaaaauggaaagcaaagguaaaaucagcaguugaaauucagagaaagacagaaaaggagaaaagaugaaauucaacaggacagaagggaaauauauuaucauuaaggaggacaguaucuguagagcucauuagugauggcaaaaugacuuggucaggauuauuuuuaacccgcuuguuucugguuugcacggcuggggaugcagcuaggguucugccucagggagcacagcuguccagagcagcugucagccugcaagccugaaacacucccucgguaaaguccuuccuacucaggacagaaaugacgagaacagggagcuggaaacaggccccuaaccagagaagggaaguaauggaucaacaaaguuaacuagcaggucaggaucacgcaauucauuucacucugacugguaacaugugacagaaacaguguaggcuuauuguauuuucauguagaguaggacccaaaaauccacccaaaguccuuuaucuaugccacauccuucuuaucuauacuuccaggacacuuuuucuuccuuaugauaaggcucucucucucuccacacacacacacacacacacacacacacacacacacacacacacaaacacacaccccgccaaccaaggugcauguaaaaagauguagauuccucugccuuucucaucuacacagcccaggaggguaaguuaauauaagagggauuuauugguaagagaugaugcuuaaucuguuuaacacugggccucaaagagagaauuucuuuucuucuguacuuauuaagcaccuauuauguguugagcuuauauauacaaaggguuauuauaugcuaauauaguaauaguaauggugguugguacuaugguaauuaccauaaaaauuauuauccuuuuaaaauaaagcuaauuauuauuggaucuuuuuuaguauucauuuuauguuuuuuauguuuuugauuuuuuaaaagacaaucucacccuguuacccaggcuggagugcaguggugcaaucauagcuuucugcagucuugaacuccugggcucaagcaauccuccugccuuggccucccaaaguguugggauacagucaugagccacugcaucuggccuaggauccauuuagauuaaaauaugcauuuuaaauuuuaaaauaauauggcuaauuuuuaccuuauguaauguguauacuggcaauaaaucuaguuugcugccuaaaguuuaaagugcuuuccaguaagcuucauguacgugaggggagacauuuaaagugaaacagacagccaggugugguggcucacgccuguaaucccagcacucugggaggcugagguggguggaucgcuugagcccuggaguucaagaccagccugagcaacauggcaaaacgcuguuucuauaacaaaaauuagccgggcaugguggcaugugccuguggucccagcuacuagggggcugaggcaggagaaucguuggagcccaggaggucaaggcugcacugagcagugcuugcgccacugcacuccagccugggugacaggaccagaccuugccucaaaaaaauaagaagaaaaauuaaaaauaaauggaaacaacuacaaagagcuguuguccuagaugagcuacuuaguuaggcugauauuuugguauuuaacuuuuaaagucagggucugucaccugcacuacauuauuaaaauaucaauucucaauguauauccacacaaagacugguacgugaauguucauaguaccuuuauucacaaaaccccaaaguagagacuauccaaauauccaucaacaagugaacaaauaaacaaaaugugcuauauccaugcaauggaauaccacccugcaguacaaagaagcuacuuggggaugaaucccaaagucaugacgcuaaaugaaagagucagacaugaaggaggagauaauguaugccauacgaaauucuagaaaaugaaaguaacuuauaguuacagaaagcaaaucagggcaggcauagaggcucacaccuguaaucccagcacuuugagaggccacgugggaagauugcuagaacucaggaguucaagaccagccugggcaacacagugaaacuccauucuccacaaaaaugggaaaaaaagaaagcaaaucagugguuguccuguggggaggggaaggacugcaaagagggaagaagcucugguggggugaggguggugauucagguucuguauccugacugugguagcaguuugggguguuuacauccaaaaauauucguagaauuaugcaucuuaaauggguggaguuuacuguauguaaauuauaccucaauguaagaaaaaauaauguguaagaaaacuuucaauucucuugccagcaaacguuauucaaauuccugagcccuuuacuucgcaaauucucugcacuucugccccguaccauuaggugacagcacuagcuccacaaauuggauaaaugcauuucuggaaaagacuagggacaaaauccaggcaucacuugugcuuucauaucaaccaugcuguacagcuuguguugcugucugcagcugcaauggggacucuugauuucuuuaaggaaacuuggguuaccagaguauuuccacaaaugcuauucaaauuagugcuuaugauaugcaagacacugugcuaggagccagaaaacaaagaggaggagaaaucagucauuaugugggaacaacauagcaagauauuuagaucauuuugacuaguuaaaaaagcagcagaguacaaaaucacacaugcaaucaguauaauccaaaucauguaaauaugugccuguagaaagacuagaggaauaaacacaagaaucuuaacagucauugucauuagacacuaagucuaauuauuauuauuagacacuaugauauuugagauuuaaaaaaucuuuaauauuuuaaaauuuagagcucuucuauuuuuccauaguauucaaguuugacaaugaucaaguauuacucuuucuuuuuuuuuuuuuuuuuuuuuuuuugagauggaguuuuggucuuguugcccaugcuggaguggaauggcaugaccauagcucacugcaaccuccaccuccuggguucaagcaaagcugucgccucagccucccggguagaugggauuacaggcgcccaccaccacacucggcuaauguuuguauuuuuaguagagaugggguuucaccauguuggccaggcuggucucaaacuccugaccucagaggauccaccugccucagccucccaaagugcugggauuacagauguaggccacugcgcccggccaaguauugcucuuauacauuaaaaaacaggugugagccacugcgcccagccagguauugcucuuauacauuaaaaaauaggccggugcaguggcucacgccuguaaucccagcacuuugggaagccaaggcgggcagaacacccgaggucaggaguccaaggccagccuggccaagauggugaaaccccgucucuauuaaaaauacaaacauuaccugggcaugauggugggcgccuguaaucccagcuacucaggaggcugaggcaggaggauccgcggagccuggcagaucugccugagccugggagguugaggcuacaguaagccaagaucaugccaguauacuucagccugggcgacaaagugagaccguaacaaaaaaaaaaaaauuuaaaaaaagaaauuuagaucaagauccaacuguaaaaaguggccuaaacaccacauuaaagaguuuggaguuuauucugcaggcagaagagaaccaucagggggucuucagcaugggaauggcauggugcaccugguuuuugugagaucaugguggugacaguguggggaauguuauuuuggagggacuggaggcagacagaccgguuaaaaggccagcacaacagauaaggaggaagaagaugagggcuuggaccgaagcagagaagagcaaacagggaagguacaaauucaagaaauauugggggguuugaaucaacacauuuagaugauuaauuaaauaugaggacugaggaauaagaaaugagucaaggaugguuccaggcugcuaggcugcuuaccugagguggcaaagucgggaggaguggcaguuuaggacagggggcaguugaggaauauuguuuugaucauuuugaguuugagguacaaguuggacacuuagguaaagacuggaggggaaaucugaauauacaauuaugggacugaggaacaaguuuauuuuauuuuuuguuucguuuucuuguugaagaacaaauuuaauuguaaucccaagucaucagcaucuagaagacaguggcaggaggugacugucuuguggguaaggguuugggguccuugaugaguaucucucaauuggccuuaaauauaagcaggaaaaggaguuuaugauggauuccaggcucagcagggcucaggagggcucaggcagccagcagaggaagucagagcaucuucuuugguuuagcccaaguaaugacuuccuuaaaaagcugaaggaaaauccagagugaccagauuauaaacuguacucuugcauuuucucucccuccucucacccacagccucuugaugaaccggaggaaguuucuuuaccaauucaaaaauguccgcugggcuaagggucggcgugagaccuaccugugcuacguagugaagaggcgugacagugcuacauccuuuucacuggacuuugguuaucuucgcaauaagguaucaauuaaagucggcuuugcaagcaguuuaauggucaacugugagugcuuuuagagccaccugcugaugguauuacuuccauccuuuuuuggcauuugugucucuaucacauuccucaaauccuuuuuuuuauuucuuuuuccauguccaugcacccauauuagacauggcccaaaauaugugauuuaauuccuccccaguaaugcugggcacccuaauaccacuccuuccuucagugccaagaacaacugcucccaaacuguuuaccagcuuuccucagcaucugaauugccuuugagauuaauuaagcuaaaagcauuuuuauaugggagaauauuaucagcuuguccaagcaaaaauuuuaaaugugaaaaacaaauugugucuuaagcauuuuugaaaauuaaggaagaagaauuugggaaaaaauuaacgguggcucaauucugucuuccaaaugauuucuuuucccuccuacucacaugggucguaggccagugaauacauucaacauggugauccccagaaaacucagagaagccucggcugaugauuaauuaaauugaucuuucggcuacccgagagaauuacauuuccaagagacuucuucaccaaaauccagauggguuuacauaaacuucugcccacggguaucuccucucuccuaacacgcugugacgucugggcuugguggaaucucagggaagcauccgugggguggaaggucaucgucuggcucguuguuugaugguuauauuaccaugcaauuuucuuugccuacauuuguauugaauacaucccaaucuccuuccuauucggugacaugacacauucuauuucagaaggcuuugauuuuaucaagcacuuucauuuacuucucauggcagugccuauuacuucucuuacaauacccaucugucugcuuuaccaaaaucuauuuccccuuuucagauccucccaaaugguccucauaaacuguccugccuccaccuagugguccagguauauuuccacaauguuacaucaacaggcacuucuagccauuuuccuucucaaaaggugcaaaaagcaacuucauaaacacaaauuaaaucuucggugagguagugugaugcugcuuccucccaacucagcgcacuucgucuuccucauuccacaaaaacccauagccuuccuucacucugcaggacuagugcugccaaggguucagcucuaccuacuggugugcucuuuugagcaaguugcuuagccucucuguaacacaaggacaauagcugcaagcauccccaaagaucauugcaggagacaaugacuaaggcuaccagagccgcaauaaaagucagugaauuuuagcgugguccucucugucucuccagaacggcugccacguggaauugcucuuccuccgcuacaucucggacugggaccuagacccuggccgcugcuaccgcgucaccugguucaccuccuggagccccugcuacgacugugcccgacauguggccgacuuucugcgagggaaccccaaccucagucugaggaucuucaccgcgcgccucuacuucugugaggaccgcaaggcugagcccgaggggcugcggcggcugcaccgcgccggggugcaaauagccaucaugaccuucaaaggugcgaaagggccuuccgcgcaggcgcagugcagcagcccgcauucgggauugcgaugcggaaugaaugaguuaguggggaagcucgaggggaagaagugggcggggauucugguucaccucuggagccgaaauuaaagauuagaagcagagaaaagagugaauggcucagagacaaggccccgaggaaaugagaaaauggggccaggguugcuucuuuccccucgauuuggaaccugaacugucuucuacccccauauccccgccuuuuuuuccuuuuuuuuuuuuugaagauuauuuuuacugcuggaauacuuuuguagaaaaccacgaaagaacuuucaaagccugggaagggcugcaugaaaauucaguucgucucuccagacagcuucggcgcauccuuuugguaaggggcuuccucgcuuuuuaaauuuucuuucuuucucuacagucuuuuuuggaguuucguauauuucuuauauuuucuuauuguucaaucacucucaguuuucaucugaugaaaacuuuauuucuccuccacaucagcuuuuucuucugcuguuucaccauucagagcccucugcuaagguuccuuuucccucccuuuucuuucuuuuguuguuucacaucuuuaaauuucugucucuccccaggguugcguuuccuuccuggucagaauucuuuucuccuuuuuuuuuuuuuuuuuuuuuuuuuuuaaacaaacaaacaaaaaacccaaaaaaacucuuucccaauuuacuuucuuccaacauguuacaaagccauccacucaguuuagaagacucuccggccccaccgacccccaaccucguuuugaagccauucacucaauuugcuucucucuuucucuacagccccuguaugagguugaugacuuacgagacgcauuucguacuuugggacuuugauagcaacuuccaggaaugucacacacgaugaaauaucucugcugaagacaguggauaaaaaacaguccuucaagucuucucuguuuuuauucuucaacucucacuuucuuagaguuuacagaaaaaauauuuauauacgacucuuuaaaaagaucuaugucuugaaaauagagaaggaacacaggucuggccagggacgugcugcaauuggugcaguuuugaaugcaacauuguccccuacugggaauaacagaacugcaggaccugggagcauccuaaagugucaacguuuuucuaugacuuuuagguaggaugagagcagaagguagauccuaaaaagcauggugagaggaucaaauguuuuuauaucaacauccuuuauuauuugauucauuugaguuaacagugguguuagugauagauuuuucuauucuuuucccuugacguuuacuuucaaguaacacaaacucuuccaucaggccaugaucuauaggaccuccuaaugagaguaucugggugauugugaccccaaaccaucucuccaaagcauuaauauccaaucaugcgcuguauguuuuaaucagcagaagcauguuuuuauguuuguacaaaagaagauuguuauggguggggauggagguauagaccaugcauggucaccuucaagcuacuuuaauaaaggaucuuaaaaugggcaggaggacugugaacaagacacccuaauaauggguugaugucugaaguagcaaaucuucuggaaacgcaaacucuuuuaaggaagucccuaauuuagaaacacccacaaacuucacauaucauaauuagcaaacaauuggaaggaaguugcuugaauguuggggagaggaaaaucuauuggcucucgugggucucuucaucucagaaaugccaaucaggucaagguuugcuacauuuuguaugugugugaugcuucucccaaagguauauuaacuauauaagagaguugugacaaaacagaaugauaaagcugcgaaccguggcacacgcucauaguucuagcugcuugggagguugaggagggaggauggcuugaacacagguguucaaggccagccugggcaacauaacaagauccugucucucaaaaaaaaaaaaaaaaaaaagaaagagagagggccgggcgugguggcucacgccuguaaucccagcacuuugggaggccgagccgggcggaucaccuguggucaggaguuugagaccagccuggccaacauggcaaaaccccgucuguacucaaaaugcaaaaauuagccaggcgugguagcaggcaccuguaaucccagcuacuugggaggcugaggcaggagaaucgcuugaacccaggagguggagguugcaguaagcugagaucgugccguugcacuccagccugggcgacaagagcaagacucugucucagaaaaaaaaaaaaaaaagagagagagagagaaagagaacaauauuugggagagaaggauggggaagcauugcaaggaaauugugcuuuauccaacaaaauguaaggagccaauaagggaucccuauuugucucuuuuggugucuauuugucccuaacaacugucuuugacagugagaaaaauauucagaauaaccauaucccugugccguuauuaccuagcaacccuugcaaugaagaugagcagauccacaggaaaacuugaaugcacaacugucuuauuuuaaucuuauuguacauaaguuuguaaaagaguuaaaaauuguuacuucauguauucauuuauauuuuauauuauuuugcgucuaaugauuuuuuauuaacaugauuuccuuuucugauauauugaaauggagucucaaagcuucauaaauuuauaacuuuagaaaugauucuaauaacaacguauguaauuguaacauugcaguaauggugcuacgaagccauuucucuugauuuuuaguaaacuuuuaugacagcaaauuugcuucuggcucacuuucaaucaguuaaauaaaugauaaauaauuuuggaagcugugaagauaaaauaccaaauaaaauaauauaaaagugauuuauaugaaguuaaaauaaaaaaucaguaugauggaauaaacuug

SEQ ID NO: 191691 - RNA, 6661 nt, Homo sapiens
auguuuaagcuguauauuuacucauugaaacacucggugaaaucaggguaaaaucaacuaaaggaaaaauaguuguuucauucauuugaacuuaaaccaacuaaagcaguacucaugucauuacgaugcagcaaauacgagaccucuuucuacaaagauuagcacaaccaacaaauuaggggauauagcaaaacagagccaaaaacgguaagaaaucaauuaaguauguuacagcuuaacccuuuaccucaauaguuuuuaaaaaauaagcaaagccucccaaucccaaacaauacgaauacaucuucaucaccaauuuguacuuguauuucuuauucuugagguuagauucuaaacccuaaagauauccaaacuaguauuagaucuacuuaucuauagccagagacggcagccaagguuauuaaaaugucuuuucuaggcagggcgcgguggcucacgccuguaaaucccagcuguuagggaggccgaggcggguggaucacaaggucaggagaucgagaccauccuggcuaacacagugaaaccccgucucuacuaaaaauacaaaauauuagccgggcgagguggcgggcgccuguagucccagcugcucgggaggcugaggcaggagaauggcgugaacccgggagacggagcuugcagugagccaagaccgcgccacugcacuccagccugggcgacagagcaagacuccguuucaaaaaaaaaaaaaaaaaaaguauuuucuccaggaagauccaauaggaaaaaaaaaaaaaaagaaaccucgcugauuaggcuccaaccauacuccacccuccaugagauugacuggaugggcaucauggaaaccagaacacgugguuuccaaacaagaaaaauccuaugagggaugggaggaggggagaggaaggauucagccaguguccagacugaaauugaguaauaucaguuucacucaucuucacacgucuucagguugcauguucauggaguaguuuaggaauaaauccaugguuuguggaguacuaaaauaccuaguggucugcuguauuacauuaaggccuuccccagcagcuuccaaggcagccuccaagucacuggcaggagaauuuggcuggaacugcaugcaggacugcagagauuccucuccacaguuauagaagggacuguuccaggccugauuguuccaggauugggugcaccaggucugaguguuccaggagugguugcuccaggacuggauguucugggucugguugcuccagguugaauuguuccaggucugguugcuccacauuggaagguucccagucggguucaccaggcaucccuggugguaggaagaguaaaggcugggguagguaggugcugaggccuucugaaagagaaggagggauuaacagaaaggguacaaggacaaccagaacugucugugacuggaguuguguguuucagggauggacaagauugaaagaucacugaaaggaaagaacagaaugaaguuuccuguuaccugcgucacaccauugcuauucuucggccaguuguuuuucugccaccucuuagauuucauucucugguucuggaaccaggucuucaccugcaggaaaaaaugauagaaauuguaaaauauucauaauacagagguacuuugaaucaaaguauauugcuaacuuuuauuccuggccaggugccauaucucaugccuguaaucccaacacuuuggaaggccaaggcgggcagauugcuugagcccaggaguucgcuacaggcuagccaacaugaggaaacaccgugucuacaaaaauacaaaaaauuagccggguguaaugcugcacgucuguggucccagcuucucaggaggcugagacgggaggaucgcuugcaccugggaagugaaggcugcagugagccaagauugcaucacugcacuccagcugcgugacaacagaaccagacugucucagaaaaaaagagagaaaugaacauuuuggauagaaaauaaaggcaagggccgggugugguaguucacaccuguaauccuagcacuuuaggaggcagaggcacguggaucacuugaggucaggaguugaaaaccagccuggccaacauggugaagccccaucucuacuaaaaaauacaguaaaauuagccagguguaguggcgggcgccuguaaucccagcuacuugggaggcugaggcaggagaaucccuugaacccaggagguggagguuucauccauuuguacuuaaaccaaguaaugcuaaugucauuaugaugucucauuaugaggccacugcacuccagccugggagacagagugagacuccgucucaaaaauaaacaaaagaaaagaaggaaauaaagccuagaagaggauaagccaauuaaugaaggaaaauggccaacaaguaauaaacaaugauuggccuuauugaaugcacacagauaaaaaacaaaacaagcuggaguugcuggcagaaagaaaaaaaggaaaaaaaaaguuuuuauuuuaaugagaaccagugugaguuaggguuucuccuacccugguaaguggaguuagauacuucuuuuuuauuaaggaaacguuggaaagauuuucacaauauuggucugugcaagaaagugguuaaauuaugacauaauuauucacauaauagaauauuuaaggaaagaaagaggugaaggaaguuacaaaagcauuucaucuucauaaauuauuugcaagaggcgauguacggacacauaguacacacaucuacaugcauccacagaggucuuagccaugcaaauuaguccaauuuuuguucaccuuauuccaaggacaaaacaagccuaccuguuuguagcugagguucaggauguuggagaguucuugcaucugcuggaggcugagguauuucugucucugaaaucuaucauugaguacacacagcuggguggaagagaacacaguucuggucuucuguuucuugaccgggaccuugucuuccuuuuuugcgacacucuucucugcagaaguggguuguuugccuuugggacugguggaagaaucagggcuguccugaauaagcagauccauggaggaaggaagaggagagacuguugggaacaaauaaaaggacacuuuugucuaaaauuuuucaaauauuaaaauauccuuuaaaaaaauuguuuucaaaguacuuugauaauucccagaaccccagaucuaaguaauaagaagcaauuucuuaagcagcccuggcacuuuggcaagcuuuauauaguauuacuccaagaagucuuaucaguaucuccauuuuguacauaauagacugcguugggagagaucuauaaugguggccaaugcauugcugagcggcgcuaccccuuuuuuuuaaaauuaggauggagguucacucuuguugcccaggcugaagugcgauggugcaaucucggcucacugcaaccuccaucuccuggguucaagcgauucuccugccucagccuccugaguagcugggauuacaggcaggcaccaucacgccuggcuaauuuuguauuuuuaguagagacaggguuucucaauguuggugaggcuggucucgaacuccugaccucgugauccgccugccucggccucccgaaguacugagauuacaggugugagccaccucaucaggccggcgcuaccaccuuuugcuuuaaacugaugcucaaaagcucccacacuggguguuaauaggucagaauggagauucaccaauuuucacguauugcaucucacccuaaaucacuuuguuuaugaucuucaucaacaccuacaugauugcuuaaaugccaugauucuggggauucuauaaaaccagcaccucagcuaggugggauggcucaugccuguaaucccaacacuuugggaggccaaggugggcagaucacuugaggucaagaguucaaaaccagcgugccaacauggugaaaccccaucucuacuaaaaauuacaaaaauuagccaggagugguggcgcaugccuguaaucccagcuacuggggagacugaggcaggagaaucacuugaacccaggaggccgugauugcaguaagccgagagugccacugcacuccagccugggugacagagugagacugucucaaaaaaauaaaaaacaaaaccagcaacugacugcccaguucucaaugcuaggaccagcaggauaugugaauccggauaagcuucuguuucaauccaggccuucccuuuacuagcucugaccucaucucuaaaauuauuuuuuuauuaauuaaaaugagguaaccaauugaaauucucuagcauagggccuggcauuuacugauuuuguaacuagaaaugaauaucuagauuuagucaucacuuauauaccuaauugcucugcgguuuucccaguguucaacucucaauucuaccccugcagucacauaacaaagggacaggcucuaaaacagcaaaaauuaacaaucucuucucucuugcaaguagaucugaaaagcagaggaagccuuucaacuaaugauuagaauuggggaaaauccuaaauauuagcuaccuauauaaacugucacuugaugugugcuaaagaaaacacauccccacuugcucauucccaaacccagcaauguauuuuuaacauuugaaauuauaaagguggccaggcgcggugcccagccaaggcaggugaaucacuugaggucaggaguuugagaccagccuggccaacacaccgaaaccccuucucuacuaagaacuacaaaaauuagcuaggcgugguggcauacaucuguaauaccugcuacucgagagacugagacaggagaaaucaccugaaccuaggaggcggagguugcagugagccaagaucacgccacugcacucccgcgugggcaacagaaugagacccugucucaaaaaaaaaaaaagaaagaaagaaagaaagaaauuauaaaggcaagaacauuaaugcauaguuuagaaaaacugggugaauagccaugcagagugggucagcgccuguaaucccagcgacuugggaagcugaggguggaggaucacuugaggucaggaguucaagaccagcccgagcugcaaagugagacccugucucuacaaaaauaauuuuuuaauuagcugggcauagugacacacgccucuuguccuaguaguugggaggcugaggcaagaggaucacuugaucucaggguugaggcugcggugauccaugaucacaccauugcacuccagccuaugugacaaagugagucccugauucuaaaaaagaggaaaagcagggugacauucaaaucugaggcucaaauauagcaaucauguuuacuuauuccuuuuccacaaccuacucuuuacaacuguagucauaauguaaaugcgcuuuuuaagcuauuuuacagcguucaguguuaccaauggcauucuugguaaaguugguucauucucaaguuuuugaaaacuacugaaaaauugauuuucaaaaaagugguagcggcuuuaugaguaucccgaguaucccccaccccuugcagcuaccagucagaagcaugaguacuagcacagguuuugaagccaaacuggacuucuagcuacauucuguuugacugucaguagauuaaacuuucuggaauuaucuuuaccauaaaguugggucaacgcuucccaggacuuaggagaauuagacaugggaggugcucccaaacucagagcugcccaguaacauccacaaacccagagaauggagaagagacagccguuacugacauagaaagaauuacccaaauuauguauuacagaaaucucaucgugauuugccaugccauuuuuggcaaaacaaaaucaugcucaucccugagcuaugacguuaggucuucuggcuaauuagcaauaaaucugcuauuuauucacauguguccagcacuaugugaagauguacacaucaccuucauuuaacuauaacgauacauuuuuguuuccaccaugccuaagcccauagguucucaaacuuacugcacacuguucaacugccgaauucuguguccuucaacucaaugcacacuccugagaccugggacauaguucaaagggcaggugccaccaaguuauaauggaaaaagggguuuccagaggauuaguugauaauaacacuucuuuauaguaaugguccaucauugcucaagagggaaaugaucccuuaacccucucuccuucucucuuuucccuuaaggaacuuggccuuucaaggauaaauuucuuucuuaccagucuccgugugaggcaucucagcagaagacauuugcaaggauggauaguuuucuucaggcccacaaaucacaggcauaggugaagauucuuuacagucggaugcuucaaagcaaggcaagcuuuggggacaagcuggauccacacucauguuaguauagaggaagaggaggaaaaaauuuaagagguggacuggaaaaaagguuaaggcagcuuuaagacuuuucuggaagauguuagagaaauaggaccuccagaaggaaaaguaucaagaaauugggauaaagugaguugccugcauaauaacaugaggcaaccagcucaguccagcagaacguuaaaauccuggagucucuagauuuauaau

SEQ ID NO: 191692 - RNA, 17069 nt, Homo sapiens
ugucguguacauucagaauuuuuauuuuaaaacaaagaaccagaguaacaauagaaaauccauauggaaauauucacaaucuucucagugagaaaugggacccugccuuacugccaaccuacuguuugaggagccagaaguugacaugaaguugcaaggucaccuuuucaagcuaaagcacacuugauagcuaugugcauuuuuuuuuuuuugagacggagucucgcccuguggcccaggcuagagugcaaugaugcgaucuccgcucacugcaaccccugcgucccggguucacaugauucucccgccucagcuucccaaguagcugggauuacaggcgcccgccaccacgcccggcuaauuuuugcauuuuuaguagagacaggguuucacgauguuggccagacuggucucgaaccccugaccgcccgccuaggccucccaaagugcugggauuacaggcgugagccaccgcauccggccucagcuacgugcauuuuuauucaaaggcuccaggagcagagggaacagugagaacuaagaaccaaaauacugucacugacaaggguuuggcuaaagggucugagauguguaagcaccaagaagggaaagggagacugagcaacauaugaaaaaggggcuguaggaacaaacacagagaaaauaagucaacaauaacguacuuccacccagagcaaagugacagugcacauacauucauccucucaagugugggcuacacugcacauugacucauacugucuaaaccugguuuauuggaaagauucaaguccccugagggcauucggcauaggaccacagugacaugguaacagacauacgcaagcgugccgugagccuaaagcaacaacacacuuuagauaauaaucgcucagaaaaaaauccucucccagagcugagguuacaaauuccaaguuugcuauaaacauucuuuggggaauuccuuuaaagguaugaguuaaaauacaacagaaaaucaacaccuaaaaucuccuaaagaacaaaguggaaaaauaaugaaucucuaccaagaaccaauuauuuuagguuucuuauuuggauggcucucccacgagauagguggcgggauuacuucaaaaguaaugagacuacuacaagaaggaguuauuucauccagugaggggaacaggcuuucuagaaaucacuuucucuucccuggacuccauccaaaauuagaacccaucaaccaucauuaacuacaaugcccauauuaguuaauaauccuagauuucaaguacuacuacauguaaacuauuaucuuaaagaaaaaagcuccaaaggaaaucaguagcuuuauuauauagguauaugacuuuuacgagaaguuaaagaguuuccaucugaaggacagaaauuguuaagagguaacguacagaccucaggcaccacaucauuuacccuccaauaaugaacaacauuucucccuaaauucuuauugcaccuuaaccucuccagcaucaaaucuucuacucuauaaccucucuuuaaacaccucccucuaaucucaauuuccuucuguuuuuauuauuuggcaaaauuacgcuuaaaaaaauaaauauuuccaucauggcauauauauaccuauguaacaaaccugcacauucggcacauguauccugaaacuuaaaguuaaaaaaaaaaaauuauguaauuaaaccagaggauaaaauaaauaaaacucaaguuaauuugccacguagagcuguauggaagugaggaaggugcucuuacauaaacacccuccggcuuccacacucauauguaucugcuuccugguaagucugagguugggggaacugcaccuuacuuuuccucuccuauauccccuagugcggcaauaucagaacccaagggaggaaaagcuggcaaaguugucaugugccaagcggccaaucccuccugaaaugaagguagguucacucggucucuccuaagcagaagaggauguccaggaaauaaaauuuaaaaagccauugaagauccaacaaaccgcagccuuggggugcucauggagugcgugggaugagaaaggaauuaaguagcagcauucagaagcguccuggguucauccugaugaggucucucccuuguugagggagagguggcuuucccaugccgggagggagguggaaggaggcacgacuuagacauuggugguggucuccuuagcaggcucgaugcuguucaucuccaugacgccguccuuuccagaucuaucugcaccgugugccugcccuucaaaggcccgugugauauccucaaaaguccugccacgggucucagggacuuugaagaagguaaaagccaagaagguaaugaggaagccggugaagauaauaaaaacguaggcuccuaaauagugcuagagaaaggacagaaaaaaggaagguugauauaaaaaucuggucauugacaaagucaauuuccuucacauucauauuuccaauaggcuucaagcuauaacccuuccauauuuaaugaaaacagguuucuucagauucgcuuaugauuccauugcuaacuuacuguaguucucucuaguuuucuuucugucauuccauuucauuacaguuagaugcuuccaaaugucuacugaguauuuuuggacuuuugaguauuauuuuuaaaaucuguguuucugggccgagugcgguggcucacgcccauaaucccagcacuuugggaggucaaggugggaggaucacuggaacccagcaguuugagacuaaccugggcaacuccaucucuauuuaugaauuuuuuuuuuuuugagacggaaucucgcucugucacccaggcuggagagcagaagguugaucacagcucaccaugaacaccuccuggguuuaagugauucucuugccucagucuucugaguagcuaggacuacaggugugugcuaccgcaauggugugaucucgcucacugggauuacagucaugagccacgacacccggccuaauuuuuguauuuauuguagaaacaggguuucaccaugauagucagguugguccccaacuccugaccucaaguuauccacccgccuaggccucucaaagugcuggaauuacaggcuugagccacugugucuggccgcaaauuaaacuuuaugaauuauuuauuucugcaauuuuccauuuaauauuuuuagacuacagguaacugaaacugaagaagaggagggacugcuguauuuuuuuauuuauuuagggauggagucuugcuuccaucgagcaggcuagagugcaguaacgcgaucucagcucgcugcaaccuccaccucccagguuuaagcgauucuccuuccucgaucucccaaguagcuggaauuacaggcaugcaccaccaugcccagcuaauuuuugaauuucaccauguuggccaggcuggucuugaacuccugaccucaggugauccacccgccucagccucccacagugcuaggauuacaggcaugagccaccaugccaggcccagacuacuguauuauuaaggaguaucuucaugucagcuuacauaggcugguuuuaagauaaggugaguuuacuuacagcagcggaggggaagagcaauccgacuaggaaguuggagguccaguuggagcagccggccacugccaucgcagcugggcgggggcccuggcugaagaguucggccacaauaaaccagggaauggggccugguccaauuucaaagaaggcuacaaagaccaagauagccccaauacagacaaagcucaucccauuauaguuauccuguaagagcaaggaacagagaaaauuaaauuuaaagacaguguaaccuaguaucuagguucccagaagcaauuaacggcaagcuccuccugucccugacguacaauacaaagaguggcuguggagucaaaaggcuuggauuuauuuuuauuuuuauuuuuugagacagggucuuacucuguugcccaugcuggagggcaguggcacuacaauagcucacugcaucaucgaucuccugggcauaagcaauccucccaccucagccucucaaaucgcuuggacuugaagcaugugccaccacaccugccuaauuaaaaaaaaauuuuuuuuuuggccaggagcuguggcucacgccaaggcagguggauuaucugaggucaagaguuggagaccagccuggcuaacauggugaaacacagucucuacuaagaaguacaaaaauuagcugagcgugguggcacgugccuauaaucccagcuaccugggaggcugaggcagcagaaacacuuaagcccaggaggcagagguugcagugagcugagauccugccacugcucuccagccuggugacagagugaaacccugucucaaaaaaaaaauuuuuuuuuguuuuuuuguagagaaaguuucuugccauguugcguaggcuggucuugaacuucugggcucaagcaauccucuaaccuuggccuuccaaaguguugugaugacaggcaugaaccacugcgcccagccaggauuggauuuuuuuuuuuuuuuuugagagagaguuucgcucuugucgcucaggcuggagugcaauggcaccaucucaacuuaccacaaccucugccuccuggguucaagcaauucuccugccucagccucccaaguagcugacauuagaggcaugcaccaccacuccuggcuaauuuucuauuuuuaauagagacgggguuucuccauguuggucaggcuggucuugaacucucgacaucaggugauccgccugccucacccucccagugugcugggauuacaggcgugagccaccgcgcccagcugaggauugaauuuuucaaucccaucuauaugaucucauauaugucacuuuguacugagaccaugucaucaucuauuaagugugauuaccuugauauuauucuaagaauuaaauuagauaauuuauuuuauaagcuauaauaauguucuauaaauguaaggauucuaacaguuuaccuccaguucucugacgacccauguuucuuaaacucugggcauccugcuucucuccucugacuuuauugacaaacugcaaccuuaacaacccaccccuugugucacagaagucaacuguaaccucucuucuuucccccucccuuuuuuuucacccaaagagcaccuaccuuuaauaacaaagaaacagucaugagcguggaacaaaaagccaucccuccaaggccuaucauaugcagaguccuucuuccugcccuuuccaccagaaauagcuggaagaagaauaugacaugaaacuucaguuuuccuuuccaugaaaacagcaucugagcuacuugaaaucugccuuaccaacagcaggacacuuguuauggauaccccuccugugauuuaugauuuuauauacauacauauugugugccauucacagguccuggcucaaaauccccauagcccuugguagagucuuuugucauaauguugggaugcuucaggccucaggagcaggccucagauaacagaauucuucucugacuuucuccugcccucccacuuggcaggacgcuaaucugacugugggucauaaaacccucauuucagagaggguccugccccacacccuagaggaagaaacgcuacagagaggccaacaaaucaucuaagcagacaggcccagcuggguucagaucauucccuuuuuguccaaucacaggucagaacaguuguccaugcuucaaucauggagaaccaauuaagucugcauaaaaggcccaaaaggcaggguauggggagcuuccagauaucugaacccguggaagcugacaggaaggucagcaacaacucaucuaugugcuaggagugcaccccaaccccacagagacagaagcucccaugcucaggaucccuccagaccucgccccgugaaucucuucaucugguuguguauuucugugcuuuaaaauauccuuuaaaucaaacuaggaaacaauuuuccugaguuuugugagccacuguagcaaauuaaucaaacccaaagaggaugucgugggaauccugaucuacagcuggugagucagaagcacagguaaaacaaccuggagcuugugacuggcaucaggaguggggggcagucuugggaacugggccaccaaccugugagaucugaugcuaucuccagguagacagugucauaauuaaaaaaucgcaggacaccuagaugguguccacuacggaacugauugcacaccucacggggaaaaauucucacauauucuggggaucacagauaacuucuguugauuauuguuguuuuaguguaaaaacaguggaguaacagagcuugagaguuuuuccaagcaccuuuccuccaauuccaaguucaaagcauacuauauagucccuucuauacucccuccuuucccauccaucccauauuugcuugaagagugaagacuacauccaacauuaaauuuaucucuuuuucccaaaggaaaauuaagcaacaaaaagguaacuaaaugaugguagggucaugcaauccaucuuugaacaucuguagcaaggauucuuuucuccccucaaaauuaccaaaccauccaacuuacagaaacuacagugaagauaguauuaaccacacccgcgccgaugguggcauagaugggcucuugaacaccugcauccuugaagauuccuguugaguaauagaacaccuaggagaaaagaaaacaugcagcuuugaugcaauucugcacaccaguuacacagaacccucaaaaauaaacuuaaaagucccaguggguaagaaguccuuuuucuagguuuucguucaauacuaauaucccuucugcaaaugaauuaucuucuguaucuuaucuccuagucuggaucugucacccaggcaggagugcaguggcacaaucucagcucacugcuaccuccaccucccagauucaagcgauucuccugccucagccuccugaguagcuggacuacaggugccugcaaccacacgcagcuaauuuuuguaguuuaaguagagauggguuuucaccuuguuggccaggcuggucucguacuccugaccucaagugaccugcucgccuuggccucccaaagugcuaggauuacaggcaugagccaccgcaccuggcccuccuuucucucucuaaauguucuuaauucuagcuacucauuuacauuguuucuucuaaaaaugcuuauucccacuguuccauuuccucuugcuuauguccacuucacuaacuuacauaaagguguaauuccuacuaacugguuucuuuuuuauaaguugagacagcaacucacuguugcccaggcugguccuaaacucuuggucucaagugauccuccugccucucagccucccaaguugcugggauuauaggcaugugccaucaggcccagcuaaaugcuuuuuuaauuggcucuuccccaaacucucaaaacauugauagggacaucgaugucucaauuugauagugaacuaauugaauaaccuuauccugcucauugaauaagcagagguugggcuguauuuccuaggccuaggcccuuuugaaguguuuuaugaaauaauaccagcuacuaaugcaauuuaauauauauuaaauaaauuauuauguuguuugcuaggcacugugcuaaaaucuaaaguugcuauaacuaccauaguuaagagauauuaaaauacuggacucagaccucaaguuaacaagggaacauuaucuagguuaccgagguucacuucaguuuauuucacccagaguauuugccuccauagcaauauuuauuagucuuuuuuaugaauauggaccucuacauugggauuuaccuucucacgaaacaacucuuuaaaucccuaguacguaagauguaaacuauguauauucauauuuucuaaaauaagauaauuguguuuugaaacugagauuuguagagucauuauugaaaaaccugcugcucuagggcuaauuaacacuguuaagaaaucucaacauauuauaugauggcgucaagcuuguggggaaauauauuaggcuagugcaaaaguaauuacuugagcaguuuaaacaagcaauaaauagguaugccaauucuuuuccuuaacauaaugucuacacgucaaaaaccuaauguacauguacucaucucaauaaaauuucucauaguaaaaugacuuugcuaucuagugucaccaagcaagguaaccccuacaucaucucaccuaaauaguuuacucugcuagguaaacaugauacaaugcaaccucuuacccaucugcccauaagggaaauuagaaaucaucauuugugcaaaguagguuggaaaagugauuuccaagccugcugugcaucagauuuauuuuuuuacagacaacuuucaggucucuuacacagagauucucaaauucagcugacucaggaaucccaacccccauaauucugaugcagccagcuuugggugagauuauaccuagcgcaaaaucuacucauugacuaaauugggagccagcuuaguccaacaauaauuaauguacaugccgggcgaggugggucacaccuguaaggccggcacuuuaggagagagagcugagguggguggaucaccugaggucaggaguuugagaccagccuggccaacauggugauaucccucuauucucuacuaaaaauacgaaaaaauaagcaagguaugguggugggcaccuguaaucugggcuguaaucccaccuguaaucucgggagucugaggcaggagaaucauuugaacccaggagauggagguuguggugagcugagauugcgccacagcacuccagccugggugacagaacaagacuucaccucaaaaaaaggaugggccaggcgcaguggcucacgccuauaaucccagcauuuaggaaggccguggcaggcggaucaugaggucaagagaucgagaccauccuggccaacauggugaaaccuguucucuacuaaaaauacaaaaauuagccaggcaugguggcacacgccuguagucccagcuacucgggaggcugaggcaggagaaucgcuugaacccaggagguggagguugcagugagccgagaucgugccacuguacuccagccugggcgaucgagugagacucuguuucaaaaaaaaaaagaauguacacaccauacucugaaauggcaggagucugucccucagacugcucacggaucacuugucauuucucacaggugaucuuuuacugauccuguuuugcagggccuggacuguggugaggcagcuagggaguugccucaggugcauucuuucauucuuucuuuuuucuuuuuuuaaacaggcacagaacuaacgcaagguacauucuuuaaagaggugcucauucucagggcuacacuugcacguagcugccucaccugccuagucccagcucugcugcucuggaaagucucgggagcacauuuuucuccaguaauacguguggccuacauuaucauuuccaaaugaagaaauuugagacugggauucaucaaaaucaccuaggaggcuuuuucuaacuacuguguauuuccucccaaguuuuuuuuuuaaagacagggucauacuauauuucccaggcuugacuccugggccuaagugauauucccaccucagccucccgaguaguagcugggacuacaggcaugagcagccaccacacuuggcuccucauagauucugacauaacagccucuaaccccucauaagaagcacugccacuucaaauacaaauauccuggugugcuagguaggagaaaaguuccaagaaccaacuuacuauuuugagcaucaaaaugcucaaaauaguaaguuuugcaaaaugcuuuguuacaaaauaauuuaaucccauugaucaaagacuaucugaaaacccuuaggggaugaaucaguauuuaaaaaggugggacaagggugcucuuaauauccauauugacuagaaggcacaggaauacucucuuccuacaauccacagucaaaugcaggaagcugauauuugcauggaauacaagggcuaccugccaaaugcuagcuuccguugugccgcccucuuuaaacuaucaucuaucaugcccucuuuaaacuaccaugcucgcuauacuaguuguaaaaacagacugguaaagucaguucacucugaaguugccaguguccuuccagggucuuuuuuuuuuuuccuuuuuuuaaauuucagagacacagucucacucugucucccaggcuggaaugcaguggcauaauuauagcucacugcaaccugaaacuccugagcucaagugauccucuuaccucagccuccugaguagcugggacuacagaggcacaccgccaccaugcccggcauuuuaagugaaauacuuuaagacacguuugacccuaaaguaucacacucacagcauugaucccagagagcugcugagagagcuggagcacaauggaaaugaugaugggcugucgguagcuggacacucuaaagagcucuagcacggugacuugcuuuucuugugacauccuugcacucucaucuuucaucuccuggaugucuugggauacauccugggugccccacaaccgcuggaggacuggugaaaagaagaaagaggaaaggauaaaagagaaugugcugccccaaauucauucuuccuguaaggcagccaggaaagggccgcacgaggugaggugauggguagcauccauuccuuuuuuuuuuuuugagacagaguuucacuuuuguugcccaggcuggagugcaauggcaugaucucagcucccugcaaccuccacuucccggguucacacgauucuccugccucagccucccaaguagcugggauuacaggcaugcgcccccaugcccggcuaauuuuguauuuuuaguagagacaggguuucuccauguuguuucaggcaggucuugaacuccugaccucaggugacccgccucggccucuuauaaugcuggauuacaggcaugagccaucacacccugccugauagcauccauuccuaaacccgccuuuucaccucauucuuuaggggcugaaaauuuuacucaggaguaaucagaacccuccucacuuggauucugagaggcagggaaagaguguaacagaaaguagguccaguacaaucaucccuaaaacaaaccacaaccauauaauucauguaguaaggugugaaggauacucacucugcuuagcauucuccucuucuuuucuguuaaugagcaaaaaucugggacuuucagggcaaaauggaagggcugcacuuuguaggauagcaggaaggaugguaaaacccaguagcagcggccauagcucuucagacccaaggaugaauuccagaccaaagaucuagaaaccacacaaagauaaugcuauaaaccccauacuucacaggccacaaguucauuaaaacacaaaaaguucagaaaaucauacauucuuuuaccaugugaaaaaauaaacaaauuguguuucuuuuccuuucucuacucagcaugguuuuuuuuuuuuuuuuuuuuuugagacggagucuugcucugucacccaggcuggagaucaguggcacaaucucggcucacugcaaacucugccuaccggguucacgccauucucccgccucagccuccggaguagcugggacuacaggugcccgcuaccacgcccgaccaauuuuuuguguuuuuaguagagaugggguuucaccauguuagccaggcuggucuucaucugcugaccucgugaucugcccaccucggccucccaaagugcugggauuacaggcgugagccacagcgcccggccucagccugcuucuucagcuacuaucuauuaucuaaaacuuccauauguaauugaacaugugccagauauucuucagugcuuuaccuauguuaacuuuuuuaaugacccaugaaacuaacacucauuaaguaugagaaguucuagaguaccugggccaccagaauuccaacaacgaugcccagcugguugagagugccaaaggcaccccgcagggcaguaggcgagaucucuccaauguacaugggcacaaaaccugugcagaguccgcagaagaggccaauaaccaagcgacccaggaucagcauuucaaccgacuuagcuacuuuacacagucccauaaagcagccaccagugacagccaacagguugacaaucagcauugaauugcgccuguaagguuaaucaaagacaaaguagaauuagcaaagugagaggcuccuaacuucuccucuguccucauuauucuguucuucuccaggcucauaucaucccuuuuuuuuuuaaucuaacuuuuguuuuucacuuucuauuaucagaacauuucuaguugggaaccaggugugauggugcccgccuguagucccaggcacucagggagcugaggucggaggucgaagcuguagugagcuaugauugggccauuacacuccagcccgggugacagagcaagacccucuuucuugggggguaaaaaaacaaaagaacaacauaaucaaguaaaacagguugcuuuaccgauuuuuaaaugugaauuccaauugcauuucuagaauaucuaauuggcauuuuuuuuuuuuuuuuuuggagacggagucuuggucugucacccaggcuggagugcaguggcaggaucucggcucacugcaaccugcgccucccaggcucaagagauucuccugccucagcuuccaagcagcugggauugcaggcgcaugccaccacgcccggcuaauuuuuuguauuuuuaguagggacaggguuucaccguguuagccaggauggucucgaucuccugaccuuguuaucugcccgccucagccucccaaagugcugggauuacaggcgugagccacggcaccggcuuuuuuuuuuuugagacgggguuuugcucuuucgcccaggcuggugugaaguggccagaucucagcuuacugcacccucugcacccccacugcagguucaagugauuuuccugccucagccuccggaguagcuggaauuauaggugccugucacuacgcccggcuaauuuuuguauuuuugguagagacaggguuuugccauguuggccaggcuggucucgaacuccugaccucagcugauccacuugccucgguuucccaaagugcuaggauuacaggggugagccaccacaccgugccuaauuggcaaauuaaaacaguuccuucauuagucauaaaugaaaauauauucuaccuucuaaaacauauuguuaagcuucuauagaauaagacuuuuuuuuugucauuauccacauuugccauagacaaaaauaauuccuaccaauccuggguaaaauaauaaaaacauuuauaauacaaguaaacaacuucggaccuuguaaauuaaguauguuucuagaaaccccauaguugaguuuacuagggaauaauucugaacuaucccuagcuggacugcaaaggccaaucacucacaguucaucucuugcacagcugggugggagcucuccaggguaguagagcuccaagcaagggcagucauauucggggccaguuggacuagguuucccuugauuagaauucaagguguucuuauucaaaggcaucaucaccucccugcccuaacucuccacacuuguccucaauguggcugguagagcccacuuccuugcccaguuucuagucaauaccugccaaagcgguugacgaagaguccgacggaaaaggagccgaucauacccccgacggaaaauauggccacagacaaggaccagagagacgugagcagcaccucagaggguggggcauuucccuuguccgucaaaguuuuauugauaaauuccuuuaugaucugcaaaauaaaaggguugguggaagaacagacuguuacaguuggaugagaacaaaagacaaacauuagggaucauuuccuuccuagagaaucaagggaauaaauagacaggaauggaaggggcagauaacguauuggaauuuauguuaacucucgcuggaauaguaauucuauuuguccugaaaaucccaguagguggcagcaccgauguucacagucuaccccagcccucugcuaagggaacccagcuucuuuguaacuaaccccuaagggauaauacaggaugugcaucacuaugaggugaaagagugggaggaagaacagcaccgcccagcguuccgggaguaagugagcuuugugcuucgauuagaugaccccacuaauuuuccccaccaauauugucuccaucuucagucuuggacaggauagauacaaaguuugucuuaaaauccccuaguuuggggagggacccucacuaacuguguugcucaggaugguguuuaacuccuggacucaagugaucuuuaagccucagccucaggaguagcugggacuccaggcagaugccaccaugccuggccuuaaauucugaauuccugaaacccuacuuaaaggaauaacuucccuauucuaaauucuaauuauuguggccuggcacucaccuucucaggagcauugaugaccccaguguuguagccaaauuggaaagagccgauuguagcaacugugauggcaaauaucagagcuggggugaccuggagggagggaagacagaggagagaauaguccuuaaaacuugugauugaugacuguuucuuauuaauuauggagcuguauuaggagaauuugaguuaugagugguaugaaaagaacauccaaugagauuuagguaauuaauggggaagacaaaggaauagauuauacuaaagaacuuaucuggagauaagaaugugaaguuaacuugguaaaaaugaaagaaaauuggggaaggaagaaguuaagagaaacuggguuggucaguuuggaaauauuuaaaaacuugcaucaggcaaauguaggcauagaauuccacucacgaacugggagggcagagaaaaagacagucucggguaggauuacuaagaauugaccauucuggaaacaaauacagugcagucugaucuguaccccagacuccacggaagcccacugguggugguggagggggugguaguuugugucuucacugcuggguggcucuuugagucucuuaucucucaggaccauguaaccuacuggaucuacucacugcauccuggccccauuucagucuucguuuauuaaauacaguucugcuaucccuaacucccgcgcaggggaagaaaguacuuacucugaacccaacauauaagggcgaacccaacauauaagagacauuucuuaguggggagaaccggucaucuucaccuugccuggaauaauucagccgggcgagacauuuuccauuucuaccuuggggcagcucaauuuuuauaccugaggccaacuucuacgccauucccccccaccccaccacccaaaaucccuucaaccuuucauaucuuaaacuccuuuccuuucaggucgggcagauuaggcagcaggcugggagcuucagcaggagaagugaccuugccugcagccucccagaugucucagucccagcuaagcaucgguaccccggagggcccugccagugcaaugcucuguuaaaucuuuuuccguuuaguaaaaaucucuucugucuccucucaucauucacuaucuuugagagccuuuucuucuuuagucucauaauuuuccaucccuuucuuauuuuccuacauuuucuuucuuucugcuuuguagagaugggaucucacuauauugcccaaggcuagucucaaacuccaggccucaugugauccuccugccuugguuucccaaaugcugggguuauaggugugacccaccacaccuggccccuuauuuuuaguuaaauuuaucuugguaaaaaaugccuuucuugcugcgcgcaguggcucaugccuguaaucucagcaccuugggaggccgaggccggcggaucgccugaggucgggagucgagaccagccugaccaacauagagaaaccccgucucuacuaaaaauacaaaauuagccgggcccggugguucaugccuguaaucucagcuacucaggaggcugaggcaggagaaucgcuugaacccgggaggcggaggcuguggugagcugcggucgcuccauugcacuccagccugggcaacaagaguaaaacucaaucagaaaaaaaagaaaagccuuucucccugcaaauaaugcauauacaacacucaauauuuuaguauguccugcacucacgauuuuaacccuaauaggaaggacaacuggaauucuuucuccuuagcauccacgaaccccauauguuauaggacaaacagauggccagacccuggccugugccuccaaacacagaccuuuucaaggucuaaugcuuccagagaagucuucacacuggcucugagacccacacuuguaauccauacaaccaagcagcccgauccucuaaacacucaaccaucucguccucaguggcauaugguuaccuaaaauaaaccugagaagcaaacacaacuucuccgggugacuuuccuaugauaaggugaacagaacuguaugacauucaaagagaacugaugaagcggcagcagugcaggcuagagacgaaaugaaaaggccuuaagauagcuuggugacuuaggagaaaauagaacaaggagauuaccauuaauauuugccuuucugaguguaucccaaacaagcaaaaauaaccaguaauuauaucauucuuaccuucuguguccccaucgcuguaaucuaauucaagucuucaagaaagaucuaggggugauuccagaaacagcuuuuucagccaacaaaaccuucaaaauguccuucucagcagcaaguuuucuccacguccucaggaaggauccaaagucuuaccauuacagcaucucugggucucgcugggaucaugacuauuuauaaucuccgcaaaggguggagccugaaagggcgacaagcccccagccccaccccaccccaccccaccccccugaagcaaucu

SEQ ID NO: 191693 - RNA, 17069 nt, Homo sapiens
agauugcuucaggggggugggguggggugggguggggcugggggcuugucgcccuuucaggcuccacccuuugcggagauuauaaauagucaugaucccagcgagacccagagaugcuguaaugguaagacuuuggauccuuccugaggacguggagaaaacuugcugcugagaaggacauuuugaagguuuuguuggcugaaaaagcuguuucuggaaucaccccuagaucuuucuugaagacuugaauuagauuacagcgauggggacacagaagguaagaaugauauaauuacugguuauuuuugcuuguuugggauacacucagaaaggcaaauauuaaugguaaucuccuuguucuauuuucuccuaagucaccaagcuaucuuaaggccuuuucauuucgucucuagccugcacugcugccgcuucaucaguucucuuugaaugucauacaguucuguucaccuuaucauaggaaagucacccggagaaguuguguuugcuucucagguuuauuuuagguaaccauaugccacugaggacgagaugguugaguguuuagaggaucgggcugcuugguuguauggauuacaagugugggucucagagccagugugaagacuucucuggaagcauuagaccuugaaaaggucuguguuuggaggcacaggccagggucuggccaucuguuuguccuauaacauaugggguucguggaugcuaaggagaaagaauuccaguuguccuuccuauuaggguuaaaaucgugagugcaggacauacuaaaauauugaguguuguauaugcauuauuugcagggagaaaggcuuuucuuuuuuuucugauugaguuuuacucuuguugcccaggcuggagugcaauggagcgaccgcagcucaccacagccuccgccucccggguucaagcgauucuccugccucagccuccugaguagcugagauuacaggcaugaaccaccgggcccggcuaauuuuguauuuuuaguagagacgggguuucucuauguuggucaggcuggucucgacucccgaccucaggcgauccgccggccucggccucccaaggugcugagauuacaggcaugagccacugcgcgcagcaagaaaggcauuuuuuaccaagauaaauuuaacuaaaaauaaggggccagguguggugggucacaccuauaaccccagcauuugggaaaccaaggcaggaggaucacaugaggccuggaguuugagacuagccuugggcaauauagugagaucccaucucuacaaagcagaaagaaagaaaauguaggaaaauaagaaagggauggaaaauuaugagacuaaagaagaaaaggcucucaaagauagugaaugaugagaggagacagaagagauuuuuacuaaacggaaaaagauuuaacagagcauugcacuggcagggcccuccgggguaccgaugcuuagcugggacugagacaucugggaggcugcaggcaaggucacuucuccugcugaagcucccagccugcugccuaaucugcccgaccugaaaggaaaggaguuuaagauaugaaagguugaagggauuuugggugguggggugggggggaauggcguagaaguuggccucagguauaaaaauugagcugccccaagguagaaauggaaaaugucucgcccggcugaauuauuccaggcaaggugaagaugaccgguucuccccacuaagaaaugucucuuauauguuggguucgcccuuauauguuggguucagaguaaguacuuucuuccccugcgcgggaguuagggauagcagaacuguauuuaauaaacgaagacugaaauggggccaggaugcagugaguagauccaguagguuacaugguccugagagauaagagacucaaagagccacccagcagugaagacacaaacuaccacccccuccaccaccaccagugggcuuccguggagucugggguacagaucagacugcacuguauuuguuuccagaauggucaauucuuaguaauccuacccgagacugucuuuuucucugcccucccaguucgugaguggaauucuaugccuacauuugccugaugcaaguuuuuaaauauuuccaaacugaccaacccaguuucucuuaacuucuuccuuccccaauuuucuuucauuuuuaccaaguuaacuucacauucuuaucuccagauaaguucuuuaguauaaucuauuccuuugucuuccccauuaauuaccuaaaucucauuggauguucuuuucauaccacucauaacucaaauucuccuaauacagcuccauaauuaauaagaaacagucaucaaucacaaguuuuaaggacuauucucuccucugucuucccucccuccaggucaccccagcucugauauuugccaucacaguugcuacaaucggcucuuuccaauuuggcuacaacacuggggucaucaaugcuccugagaaggugagugccaggccacaauaauuagaauuuagaauagggaaguuauuccuuuaaguaggguuucaggaauucagaauuuaaggccaggcaugguggcaucugccuggagucccagcuacuccugaggcugaggcuuaaagaucacuugaguccaggaguuaaacaccauccugagcaacacaguuagugagggucccuccccaaacuaggggauuuuaagacaaacuuuguaucuauccuguccaagacugaagauggagacaauauugguggggaaaauuaguggggucaucuaaucgaagcacaaagcucacuuacucccggaacgcugggcggugcuguucuuccucccacucuuucaccucauagugaugcacauccuguauuaucccuuagggguuaguuacaaagaagcuggguucccuuagcagagggcugggguagacugugaacaucggugcugccaccuacugggauuuucaggacaaauagaauuacuauuccagcgagaguuaacauaaauuccaauacguuaucugccccuuccauuccugucuauuuauucccuugauucucuaggaaggaaaugaucccuaauguuugucuuuuguucucauccaacuguaacagucuguucuuccaccaacccuuuuauuuugcagaucauaaaggaauuuaucaauaaaacuuugacggacaagggaaaugccccacccucugaggugcugcucacgucucucugguccuugucuguggccauauuuuccgucggggguaugaucggcuccuuuuccgucggacucuucgucaaccgcuuuggcagguauugacuagaaacugggcaaggaagugggcucuaccagccacauugaggacaaguguggagaguuagggcagggaggugaugaugccuuugaauaagaacaccuugaauucuaaucaagggaaaccuaguccaacuggccccgaauaugacugcccuugcuuggagcucuacuacccuggagagcucccacccagcugugcaagagaugaacugugagugauuggccuuugcaguccagcuagggauaguucagaauuauucccuaguaaacucaacuaugggguuucuagaaacauacuuaauuuacaagguccgaaguuguuuacuuguauuauaaauguuuuuauuauuuuacccaggauugguaggaauuauuuuugucuauggcaaauguggauaaugacaaaaaaaaagucuuauucuauagaagcuuaacaauauguuuuagaagguagaauauauuuucauuuaugacuaaugaaggaacuguuuuaauuugccaauuaggcacggugugguggcucaccccuguaauccuagcacuuugggaaaccgaggcaaguggaucagcugaggucaggaguucgagaccagccuggccaacauggcaaaacccugucucuaccaaaaauacaaaaauuagccgggcguagugacaggcaccuauaauuccagcuacuccggaggcugaggcaggaaaaucacuugaaccugcagugggggugcagagggugcaguaagcugagaucuggccacuucacaccagccugggcgaaagagcaaaaccccgucucaaaaaaaaaaaagccggugccguggcucacgccuguaaucccagcacuuugggaggcugaggcgggcagauaacaaggucaggagaucgagaccauccuggcuaacacggugaaacccugucccuacuaaaaauacaaaaaauuagccgggcgugguggcaugcgccugcaaucccagcugcuuggaagcugaggcaggagaaucucuugagccugggaggcgcagguugcagugagccgagauccugccacugcacuccagccugggugacagaccaagacuccgucuccaaaaaaaaaaaaaaaaaaugccaauuagauauucuagaaaugcaauuggaauucacauuuaaaaaucgguaaagcaaccuguuuuacuugauuauguuguucuuuuguuuuuuuaccccccaagaaagagggucuugcucugucacccgggcuggaguguaauggcccaaucauagcucacuacagcuucgaccuccgaccucagcucccugagugccugggacuacaggcgggcaccaucacaccugguucccaacuagaaauguucugauaauagaaagugaaaaacaaaaguuagauuaaaaaaaaaagggaugauaugagccuggagaagaacagaauaaugaggacagaggagaaguuaggagccucucacuuugcuaauucuacuuugucuuugauuaaccuuacaggcgcaauucaaugcugauugucaaccuguuggcugucacugguggcugcuuuaugggacuguguaaaguagcuaagucgguugaaaugcugauccugggucgcuugguuauuggccucuucugcggacucugcacagguuuugugcccauguacauuggagagaucucgccuacugcccugcggggugccuuuggcacucucaaccagcugggcaucguuguuggaauucugguggcccagguacucuagaacuucucauacuuaaugaguguuaguuucaugggucauuaaaaaaguuaacauagguaaagcacugaagaauaucuggcacauguucaauuacauauggaaguuuuagauaauagauaguagcugaagaagcaggcugaggccgggcgcuguggcucacgccuguaaucccagcacuuugggaggccgaggugggcagaucacgaggucagcagaugaagaccagccuggcuaacauggugaaaccccaucucuacuaaaaacacaaaaaauuggucgggcgugguagcgggcaccuguagucccagcuacuccggaggcugaggcgggagaauggcgugaacccgguaggcagaguuugcagugagccgagauugugccacugaucuccagccugggugacagagcaagacuccgucucaaaaaaaaaaaaaaaaaaaaaaccaugcugaguagagaaaggaaaagaaacacaauuuguuuauuuuuucacaugguaaaagaauguaugauuuucugaacuuuuuguguuuuaaugaacuuguggccugugaaguaugggguuuauagcauuaucuuugugugguuucuagaucuuuggucuggaauucauccuugggucugaagagcuauggccgcugcuacuggguuuuaccauccuuccugcuauccuacaaagugcagcccuuccauuuugcccugaaagucccagauuuuugcucauuaacagaaaagaagaggagaaugcuaagcagagugaguauccuucacaccuuacuacaugaauuauaugguugugguuuguuuuagggaugauuguacuggaccuacuuucuguuacacucuuucccugccucucagaauccaagugaggaggguucugauuacuccugaguaaaauuuucagccccuaaagaaugaggugaaaaggcggguuuaggaauggaugcuaucaggcagggugugauggcucaugccuguaauccagcauuauaagaggccgaggcgggucaccugaggucaggaguucaagaccugccugaaacaacauggagaaacccugucucuacuaaaaauacaaaauuagccgggcaugggggcgcaugccuguaaucccagcuacuugggaggcugaggcaggagaaucgugugaacccgggaaguggagguugcagggagcugagaucaugccauugcacuccagccugggcaacaaaagugaaacucugucucaaaaaaaaaaaaaggaauggaugcuacccaucaccucaccucgugcggcccuuuccuggcugccuuacaggaagaaugaauuuggggcagcacauucucuuuuauccuuuccucuuucuucuuuucaccaguccuccagcgguuguggggcacccaggauguaucccaagacauccaggagaugaaagaugagagugcaaggaugucacaagaaaagcaagucaccgugcuagagcucuuuagaguguccagcuaccgacagcccaucaucauuuccauugugcuccagcucucucagcagcucucugggaucaaugcugugagugugauacuuuagggucaaacgugucuuaaaguauuucacuuaaaaugccgggcaugguggcggugugccucuguagucccagcuacucaggaggcugagguaagaggaucacuugagcucaggaguuucagguugcagugagcuauaauuaugccacugcauuccagccugggagacagagugagacugugucucugaaauuuaaaaaaaggaaaaaaaaaaaagacccuggaaggacacuggcaacuucagagugaacugacuuuaccagucuguuuuuacaacuaguauagcgagcaugguaguuuaaagagggcaugauagaugauaguuuaaagagggcggcacaacggaagcuagcauuuggcagguagcccuuguauuccaugcaaauaucagcuuccugcauuugacuguggauuguaggaagagaguauuccugugccuucuagucaauauggauauuaagagcacccuugucccaccuuuuuaaauacugauucauccccuaaggguuuucagauagucuuugaucaaugggauuaaauuauuuuguaacaaagcauuuugcaaaacuuacuauuuugagcauuuugaugcucaaaauaguaaguugguucuuggaacuuuucuccuaccuagcacaccaggauauuuguauuugaaguggcagugcuucuuaugagggguuagaggcuguuaugucagaaucuaugaggagccaagugugguggcugcucaugccuguagucccagcuacuacucgggaggcugaggugggaauaucacuuaggcccaggagucaagccugggaaauauaguaugacccugucuuuaaaaaaaaaacuugggaggaaauacacaguaguuagaaaaagccuccuaggugauuuugaugaaucccagucucaaauuucuucauuuggaaaugauaauguaggccacacguauuacuggagaaaaaugugcucccgagacuuuccagagcagcagagcugggacuaggcaggugaggcagcuacgugcaaguguagcccugagaaugagcaccucuuuaaagaauguaccuugcguuaguucugugccuguuuaaaaaaagaaaaaagaaagaaugaaagaaugcaccugaggcaacucccuagcugccucaccacaguccaggcccugcaaaacaggaucaguaaaagaucaccugugagaaaugacaagugauccgugagcagucugagggacagacuccugccauuucagaguaugguguguacauucuuuuuuuuuuugaaacagagucucacucgaucgcccaggcuggaguacaguggcacgaucucggcucacugcaaccuccaccuccuggguucaagcgauucuccugccucagccucccgaguagcugggacuacaggcgugugccaccaugccuggcuaauuuuuguauuuuuaguagagaacagguuucaccauguuggccaggauggucucgaucucuugaccucaugauccgccugccacggccuuccuaaaugcugggauuauaggcgugagccacugcgccuggcccauccuuuuuuugaggugaagucuuguucugucacccaggcuggagugcuguggcgcaaucucagcucaccacaaccuccaucuccuggguucaaaugauucuccugccucagacucccgagauuacaggugggauuacagcccagauuacaggugcccaccaccauaccuugcuuauuuuuucguauuuuuaguagagaauagagggauaucaccauguuggccaggcuggucucaaacuccugaccucaggugauccacccaccucagcucucucuccuaaagugccggccuuacaggugugacccaccucgcccggcauguacauuaauuauuguuggacuaagcuggcucccaauuuagucaaugaguagauuuugcgcuagguauaaucucacccaaagcuggcugcaucagaauuauggggguugggauuccugagucagcugaauuugagaaucucuguguaagagaccugaaaguugucuguaaaaaaauaaaucugaugcacagcaggcuuggaaaucacuuuuccaaccuacuuugcacaaaugaugauuucuaauuucccuuaugggcagauggguaagagguugcauuguaucauguuuaccuagcagaguaaacuauuuaggugagaugauguagggguuaccuugcuuggugacacuagauagcaaagucauuuuacuaugagaaauuuuauugagaugaguacauguacauuagguuuuugacguguagacauuauguuaaggaaaagaauuggcauaccuauuuauugcuuguuuaaacugcucaaguaauuacuuuugcacuagccuaauauauuuccccacaagcuugacgccaucauauaauauguugagauuucuuaacaguguuaauuagcccuagagcagcagguuuuucaauaaugacucuacaaaucucaguuucaaaacacaauuaucuuauuuuagaaaauaugaauauacauaguuuacaucuuacguacuagggauuuaaagaguuguuucgugagaagguaaaucccaauguagagguccauauucauaaaaaagacuaauaaauauugcuauggaggcaaauacucugggugaaauaaacugaagugaaccucgguaaccuagauaauguucccuuguuaacuugaggucugaguccaguauuuuaauaucucuuaacuaugguaguuauagcaacuuuagauuuuagcacagugccuagcaaacaacauaauaauuuauuuaauauauauuaaauugcauuaguagcugguauuauuucauaaaacacuucaaaagggccuaggccuaggaaauacagcccaaccucugcuuauucaaugagcaggauaagguuauucaauuaguucacuaucaaauugagacaucgaugucccuaucaauguuuugagaguuuggggaagagccaauuaaaaaagcauuuagcugggccugauggcacaugccuauaaucccagcaacuugggaggcugagaggcaggaggaucacuugagaccaagaguuuaggaccagccugggcaacagugaguugcugucucaacuuauaaaaaagaaaccaguuaguaggaauuacaccuuuauguaaguuagugaaguggacauaagcaagaggaaauggaacagugggaauaagcauuuuuagaagaaacaauguaaaugaguagcuagaauuaagaacauuuagagagagaaaggagggccaggugcgguggcucaugccuguaauccuagcacuuugggaggccaaggcgagcaggucacuugaggucaggaguacgagaccagccuggccaacaaggugaaaacccaucucuacuuaaacuacaaaaauuagcugcgugugguugcaggcaccuguaguccagcuacucaggaggcugaggcaggagaaucgcuugaaucugggagguggagguagcagugagcugagauugugccacugcacuccugccugggugacagauccagacuaggagauaagauacagaagauaauucauuugcagaagggauauuaguauugaacgaaaaccuagaaaaaggacuucuuacccacugggacuuuuaaguuuauuuuugaggguucuguguaacuggugugcagaauugcaucaaagcugcauguuuucuuuucuccuagguguucuauuacucaacaggaaucuucaaggaugcagguguucaagagcccaucuaugccaccaucggcgcgggugugguuaauacuaucuucacuguaguuucuguaaguuggaugguuugguaauuuugaggggagaaaagaauccuugcuacagauguucaaagauggauugcaugacccuaccaucauuuaguuaccuuuuuguugcuuaauuuuccuuugggaaaaagagauaaauuuaauguuggauguagucuucacucuucaagcaaauaugggauggaugggaaaggagggaguauagaagggacuauauaguaugcuuugaacuuggaauuggaggaaaggugcuuggaaaaacucucaagcucuguuacuccacuguuuuuacacuaaaacaacaauaaucaacagaaguuaucugugauccccagaauaugugagaauuuuuccccgugaggugugcaaucaguuccguaguggacaccaucuagguguccugcgauuuuuuaauuaugacacugucuaccuggagauagcaucagaucucacagguugguggcccaguucccaagacugccccccacuccugaugccagucacaagcuccagguuguuuuaccugugcuucugacucaccagcuguagaucaggauucccacgacauccucuuuggguuugauuaauuugcuacaguggcucacaaaacucaggaaaauuguuuccuaguuugauuuaaaggauauuuuaaagcacagaaauacacaaccagaugaagagauucacggggcgaggucuggagggauccugagcaugggagcuucugucucugugggguuggggugcacuccuagcacauagaugaguuguugcugaccuuccugucagcuuccacggguucagauaucuggaagcuccccauacccugccuuuugggccuuuuaugcagacuuaauugguucuccaugauugaagcauggacaacuguucugaccugugauuggacaaaaagggaaugaucugaacccagcugggccugucugcuuagaugauuuguuggccucucuguagcguuucuuccucuaggguguggggcaggacccucucugaaaugaggguuuuaugacccacagucagauuagcguccugccaagugggagggcaggagaaagucagagaagaauucuguuaucugaggccugcuccugaggccugaagcaucccaacauuaugacaaaagacucuaccaagggcuauggggauuuugagccaggaccugugaauggcacacaauauguauguauauaaaaucauaaaucacaggagggguauccauaacaaguguccugcuguugguaaggcagauuucaaguagcucagaugcuguuuucauggaaaggaaaacugaaguuucaugucauauucuucuuccagcuauuucugguggaaagggcaggaagaaggacucugcauaugauaggccuuggagggauggcuuuuuguuccacgcucaugacuguuucuuuguuauuaaagguaggugcucuuugggugaaaaaaaagggagggggaaagaagagagguuacaguugacuucugugacacaagggguggguuguuaagguugcaguuugucaauaaagucagaggagagaagcaggaugcccagaguuuaagaaacaugggucgucagagaacuggagguaaacuguuagaauccuuacauuuauagaacauuauuauagcuuauaaaauaaauuaucuaauuuaauucuuagaauaauaucaagguaaucacacuuaauagaugaugacauggucucaguacaaagugacauauaugagaucauauagaugggauugaaaaauucaauccucagcugggcgcgguggcucacgccuguaaucccagcacacugggagggugaggcaggcggaucaccugaugucgagaguucaagaccagccugaccaacauggagaaaccccgucucuauuaaaaauagaaaauuagccaggagugguggugcaugccucuaaugucagcuacuugggaggcugaggcaggagaauugcuugaacccaggaggcagagguugugguaaguugagauggugccauugcacuccagccugagcgacaagagcgaaacucucucucaaaaaaaaaaaaaaaaauccaauccuggcugggcgcagugguucaugccugucaucacaacacuuuggaaggccaagguuagaggauugcuugagcccagaaguucaagaccagccuacgcaacauggcaagaaacuuucucuacaaaaaaacaaaaaaaaauuuuuuuuuugagacaggguuucacucugucaccaggcuggagagcaguggcaggaucucagcucacugcaaccucugccuccugggcuuaaguguuucugcugccucagccucccagguagcugggauuauaggcacgugccaccacgcucagcuaauuuuuguacuucuuaguagagacuguguuucaccauguuagccaggcuggucuccaacucuugaccucagauaauccaccugccuuggcgugagccacagcuccuggccaaaaaaaaaauuuuuuuuuaauuaggcaggugugguggcacaugcuucaaguccaagcgauuugagaggcugaggugggaggauugcuuaugcccaggagaucgaugaugcagugagcuauuguagugccacugcccuccagcaugggcaacagaguaagacccugucucaaaaaauaaaaauaaaaauaaauccaagccuuuugacuccacagccacucuuuguauuguacgucagggacaggaggagcuugccguuaauugcuucugggaaccuagauacuagguuacacugucuuuaaauuuaauuuucucuguuccuugcucuuacaggauaacuauaaugggaugagcuuugucuguauuggggcuaucuuggucuuuguagccuucuuugaaauuggaccaggccccauucccugguuuauuguggccgaacucuucagccagggcccccgcccagcugcgauggcaguggccggcugcuccaacuggaccuccaacuuccuagucggauugcucuuccccuccgcugcuguaaguaaacucaccuuaucuuaaaaccagccuauguaagcugacaugaagauacuccuuaauaauacaguagucugggccuggcaugguggcucaugccuguaauccuagcacugugggaggcugaggcggguggaucaccugaggucaggaguucaagaccagccuggccaacauggugaaauucaaaaauuagcugggcaugguggugcaugccuguaauuccagcuacuugggagaucgaggaaggagaaucgcuuaaaccugggagguggagguugcagcgagcugagaucgcguuacugcacucuagccugcucgauggaagcaagacuccaucccuaaauaaauaaaaaaauacagcagucccuccucuucuucaguuucaguuaccuguagucuaaaaauauuaaauggaaaauugcagaaauaaauaauucauaaaguuuaauuugcggccagacacaguggcucaagccuguaauuccagcacuuugagaggccuaggcggguggauaacuugaggucaggaguuggggaccaaccugacuaucauggugaaacccuguuucuacaauaaauacaaaaauuaggccgggugucguggcucaugacuguaaucccagugagcgagaucacaccauugcgguagcacacaccuguaguccuagcuacucagaagacugaggcaagagaaucacuuaaacccaggagguguucauggugagcugugaucaaccuucugcucuccagccugggugacagagcgagauuccgucucaaaaaaaaaaaaauucauaaauagagauggaguugcccagguuagucucaaacugcuggguuccagugauccucccaccuugaccucccaaagugcugggauuaugggcgugagccaccgcacucggcccagaaacacagauuuuaaaaauaauacucaaaaguccaaaaauacucaguagacauuuggaagcaucuaacuguaaugaaauggaaugacagaaagaaaacuagagagaacuacaguaaguuagcaauggaaucauaagcgaaucugaagaaaccuguuuucauuaaauauggaaggguuauagcuugaagccuauuggaaauaugaaugugaaggaaauugacuuugucaaugaccagauuuuuauaucaaccuuccuuuuuucuguccuuucucuagcacuauuuaggagccuacguuuuuauuaucuucaccggcuuccucauuaccuucuuggcuuuuaccuucuucaaagucccugagacccguggcaggacuuuugaggauaucacacgggccuuugaagggcaggcacacggugcagauagaucuggaaaggacggcgucauggagaugaacagcaucgagccugcuaaggagaccaccaccaaugucuaagucgugccuccuuccaccucccucccggcaugggaaagccaccucucccucaacaagggagagaccucaucaggaugaacccaggacgcuucugaaugcugcuacuuaauuccuuucucaucccacgcacuccaugagcaccccaaggcugcgguuuguuggaucuucaauggcuuuuuaaauuuuauuuccuggacauccucuucugcuuaggagagaccgagugaaccuaccuucauuucaggagggauuggccgcuuggcacaugacaacuuugccagcuuuuccucccuuggguucugauauugccgcacuaggggauauaggagaggaaaaguaaggugcaguucccccaaccucagacuuaccaggaagcagauacauaugaguguggaagccggaggguguuuauguaagagcaccuuccucacuuccauacagcucuacguggcaaauuaacuugaguuuuauuuauuuuauccucugguuuaauuacauaauuuuuuuuuuuuaacuuuaaguuucaggauacaugugccgaaugugcagguuuguuacauagguauauauaugccaugauggaaauauuuauuuuuuuaagcguaauuuugccaaauaauaaaaacagaaggaaauugagauuagagggagguguuuaaagagagguuauagaguagaagauuugaugcuggagagguuaaggugcaauaagaauuuagggagaaauguuguucauuauuggaggguaaaugauguggugccugaggucuguacguuaccucuuaacaauuucuguccuucagauggaaacucuuuaacuucucguaaaagucauauaccuauauaauaaagcuacugauuuccuuuggagcuuuuuucuuuaagauaauaguuuacauguaguaguacuugaaaucuaggauuauuaacuaauaugggcauuguaguuaaugaugguugauggguucuaauuuuggauggaguccagggaagagaaagugauuucuagaaagccuguuccccucacuggaugaaauaacuccuucuuguaguagucucauuacuuuugaaguaaucccgccaccuaucucgugggagagccauccaaauaagaaaccuaaaauaauugguucuugguagagauucauuauuuuuccacuuuguucuuuaggagauuuuagguguugauuuucuguuguauuuuaacucauaccuuuaaaggaauuccccaaagaauguuuauagcaaacuuggaauuuguaaccucagcucugggagaggauuuuuuucugagcgauuauuaucuaaaguguguuguugcuuuaggcucacggcacgcuugcguaugucuguuaccaugucacugugguccuaugccgaaugcccucaggggacuugaaucuuuccaauaaaccagguuuagacaguaugagucaaugugcaguguagcccacacuugagaggaugaauguaugugcacugucacuuugcucuggguggaaguacguuauuguugacuuauuuucucuguguuuguuccuacagccccuuuuucauauguugcucagucucccuuucccuucuuggugcuuacacaucucagacccuuuagccaaacccuugucagugacaguauuuugguucuuaguucucacuguucccucugcuccuggagccuuugaauaaaaaugcacguagcugaggccggaugcgguggcucacgccuguaaucccagcacuuugggaggccuaggcgggcggucagggguucgagaccagucuggccaacaucgugaaacccugucucuacuaaaaaugcaaaaauuagccgggcgugguggcgggcgccuguaaucccagcuacuugggaagcugaggcgggagaaucaugugaacccgggacgcagggguugcagugagcggagaucgcaucauugcacucuagccugggccacagggcgagacuccgucucaaaaaaaaaaaaaugcacauagcuaucaagugugcuuuagcuugaaaaggugaccuugcaacuucaugucaacuucuggcuccucaaacaguagguuggcaguaaggcagggucccauuucucacugagaagauugugaauauuuccauauggauuuucuauuguuacucugguucuuuguuuuaaaauaaaaauucugaauguacacgaca

SEQ ID NO: 191694 - RNA, 57529 nt, Homo sapiens
  misc_feature (2363)..(52362): n is a, c, g, or u
uugcacacuggcauuucucauaaaacuuuauuuggaaaaaguuauauucaaugacccaaugguaucaaaguggaagaggaaagugacaacuagagauugauaacuauauccucugcaauccucagaagaaagaaaggggcccuuuggguuguuucagguaaaguacaucaaugggacuacaggaaagagaauuucacacacggucuuucugcaucaguaauuuuaauagagacucuuagugguuaucaacaacuggucaguuguuuuuuguuuuuuuuuuuccacacugcucucuggauucgaaccuagugaauucugggcucaguccuccuccuccaucucuuucuugauccaguccacguaguugagcacuuugguguagaagccauagccccugcugcacccgaugccccaggacacgaugcccguggccacccagcgaucaguguucgggucccuuacugcaaaaacgcccccacuaucccccuggcaggcguccugcuuuagagauggguguccagcacagaacauguuuugagagaacacauccauccuauucuuuccccggagccaguucucacaggccuguggauuagcuacgggcagacggacaaaccugaggucaugagcaaucuucuccuccaugaccccgaagccacugacauagcccaucaagcccaggucguagaagguaucguugucagggaggcagauggggaggagguugggacccagggugacacuauuuuccagcuccagcagggcgaugucccccucaaaauuguaggacucauccugacgguaguccggguggacgcugacccugcggauggggugauuuccuagcuucaugagcucuuccacauuuguguggcccaggaacacauccaaagaggcguugcuuugcgcuucguguuccuugggauacagggugugggcagcugugaggauccagcggucgcccagcagggccccgcccccgcgcccguggauguuggugaacaccugccaggggaaguugcccaucuuggcuuuuugcccuccgaugaugcgcugccucuguuccacgggguucacgggcuucccacacacugagggagagacagggaagacaagggcaagucaguuccaggucccacaucucuuccuucugcagccagccagcucccuguuugcccucucuuuuuggcuucugucucuuuucucuuucuccucccauccccacaccuccgucauuggccuauugacaggcucuucuuguucuuguuuuuuuuuuuuuuuuaaauuauuauuuuuauuuuuugagacuccuugcucuguugccuaggcuggcaugcaguggcgcgauuucagcucacugcaaccuccgccuccuggguucaagcaauucuugugccucagccacucaaguagcugggacuacaggcaugugccaccaugcuuggcuaauuuuucucuuuuuagcagaggcuggguuucgccauguuggccaggcuggucucgaacuccugaccucaggugauccgcuugccuugaccucccaaagugcugggauuacaggugugagccaccacgucuugccccuuguucuuguuuauuucuuccuagggggucucccauuguuuuuauucccugauuucccaucugcuuagugaaaauggcagcauuucgggacugaauucagcacucugucccucucucccuuucuccugggauguuccccucuucucuccucucucuccuuuuucugggccacacugcuuuugaggcccugcaggcugcuaaagacccugaugauggccccagaggguuuccacucaccuggcaagcaccgaggaaucuucucucccuucuguucauucuuccaaaugcccugugcugugcagguguacaccccugagggcagaggaggcaagaaucaaguuggggggugauggguaagaaaacuagguugcagaggccagcaaguacugagugugcuugauggggagaggggcagggaggagccaacauggcaagggccaaaggucaaaggcucaacucuagaaggaaagaaugucaaguguucagaggcucuagaccuauauuuuguuuuaaugccaaguaaaaaaaucagaaugcuuaacuauuuuuuuuuuugggacggagucucacucuguugcccaggcuggagugcaguggcgcaaucucggcuuacugcaagcuccgucucccagguucaugccauucuccugccucagccucccaaguagcugggacuacaggugcccgccaccaugcccggcuaauuuuuuguauuuuuaguagagacaggguuucaccguguuagccaggauggucucgaucuccugaccucgugaucnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncuugaauccaggagaaacacuugaacuugggaggcggaguuuacagugagcugagaccaugccacugccugggugacagagcaagacucucucucaaaaacaaaacaagacaaaacaaaaagaccaaaaaucauuccauggaguuagcccuggaaaagguuguaagagaauguguaugagaacuagaacgucugaguaaaauguagguaaugugagaaaccgugugacuugcuuuaaauucuaugaugugaauaacaaaugcaaaaguaagggcaguggguggugcaggcaagggaggguuguaauaggagcaaagagguugguagucuccauucuucuggacccaggacacccacccaauccuccugauggagcuggaagcaccuuggaguaaagaacaaugcaucaggugaacucgacuugaugcaacauucaaaugugagcuccacaaaggcugugugacuauguggguuucuuuuuacugaaccucccacaucuaggacagugccugacaguagacacuuaaagugugcauuaaaugaauuaacugugacuuaaggacauauccuaggucucuucuuugauucugauuaaguguuccauguggaccuguugaacaacgaugggauguccagucuugggucucuguccagagacagagauuuuuaguuuaccagcuuuugugagauugaucaauggauaaaaccauauucccuccugaaucugcagagccgaggacaggacggugggcgcagggggagaccaccaacauguguaaaagagccccggagcaggaggcaggagauuggcguccuagucccugccguacacaaucgcuacgugauguugacgagucacuacaucuccacccugccuuuucaguuccuucagcucucuugaguuauuggacuagggcaauaguucuuaaacuuggcugugcauuagaaucaccuggguagcuuuaaauagucuugauguucaggcucuacucuagaucaauggaaucagagucucuguugggggcccucaucuucaguauuuauuugcuuauuuuuauuuuucagagacagagucuugcuauauugcucaggcuggagugcaguggcuauucacaggggccuugaaugaaugggcucaagcaaucuuccaggauuuuaaacucucuguuuuaagugugcagcaaguuugagagcugguggaccaggagacucuuccagcugaaacgucuacgacuccagcuggggugagacuaaauccucugugaacccaccaccugaauuccuccuggggugcugggccggcucucuccccucagcccugggcucuuaccucuaugagcugguagccuugcuugcagguagcaaugaaguagucacggaacugguacugaggcugcagguucuggaugauggugaacucgucuagggucuugggcugggggcacuugaugacuguuggggagaccagggggcauauuuauuucagagccacuuguccuuccuucuuccccccuuuuccccauugcuggccaucgagggaggccugcagggagccuuacucucggugguguagcgcagcuuccagccccggcugucccccgacucaucugugaagaacagcagauccacagcauugcugcuggugucgaggucggggggccuuugcuucccacagaacucgccaauguucuucccguuggcauagaucuaguaggggaggaggguuuuuuuuuuucagcuuggacguuuuuacacagggccaacuggguaguagccugguggccagggugguggugguggugaugaaauccugccuuauguguguuuucaggggaaggugaaaagggauccccaugacccaauucuaguugugugggaacuuacccagcccaugggugauguuggccguuccugccccagcuggccaggggauccaggaggaaguugggacaagaggagccaagugcagacagaaggggaggaaggggucuuucagggguaggacggcuguaccuguagcuggucauaggggcaguguacuugcugguggucaucaauaucaaaaggcuccaggaacuugaggugcagggugaggccccgcuccacccggaugcuguaguugcagcgcaggucagggggguaggaccgaggguacuccaggcuggagauguagccugaugccuccguguacagcucgcugcugcacucagcugugagagcagagccacagggcauuacgggggacuccagcuggcccagcaagcccuggcucaaccccuuccccucugcuacaccacucuggcucacccuggcaggaaugccugucuuccugaagcucauagccuggacggcaggaacagaaguagccuccaacguaguugugacacaggugcuggcacuggggcuggggauccuccuccccugauuugcuccgggaagcacauucaucaaggucuggaaggcauucaggaaggaggguuaagcuucugcugggagaccugaguaguggcucugaucuuagggaggucacucaccagagaccuaaagacaaaggcaucuuuaggccaccuggaccuccaggccucuccaaugcucucuggggacugcuccauggggacagagcccagguugacaggccucguuaggaaaagcucucucgaggggaggaacaaggaaagccaggcuuucggcuucuuugcauucaagauucccuuucuuggccccccauucaauauggcugaggucagagaaaagggaucccuggggggcuacucacccacagcuugguaguaggccaggaagcccuuguagaacaugauggucccauucuccucguuggagaagucuguguggaaggucagcagcaucuuguucccuugggacauaaauuccuucuuucccgggggguugcccaguggagaacccaguugcccacagaaccuccccaggcuuuucuuaucagcagagaucugguggaagaaggacaggggguaggaagaagaucuguugcggaguggcgcacgugguggcucagugaugguccuccuugucucgcccagagugcaucaugcaccacaauggcucuggcuggucacuaccugcugggcucagcugcugcaaacuuccccaugugacuuucagcuguucccugagucucccacugacucacucuuugcguguuguccuggacuggguaccucacccuuucccuguuuucugcuccucuggcagguuucagguccuucuccauccccaccaccuccuauggccuguuccccugggguccugguugucuguacccagccuuuaccugccccucauucccagagcucagacagcuccgcuuuauuuucugucuucagauuccaccucagccuaaucaaaccauucacaccucgagugccuccugaugcccucggcggaacaugagcccugaagcccacccaucucagugucagcaggcacugccucgucccucuuccuuccuccucacagccuccucaaccucuccuugacucugccagcaaacgcccucccccaacacugcacacucgccaagucuucugagccgguaagacgugccauugucauguaauucacgcauaaucuccaggggucuccugggaaugguaguuguuggaccuucgcaggcucugcuugagcccugaaucucauuuuuacuggauagagaaagacaggccugggaagguacccuugguugccacagaggugaggguucugagcacacuguccuugcugaaggcuauuccugugcugccagagcccacauuucuccuccucaugucccuguguuccuguugaagcaggcagccaugucaaucauuuccuuggagacagggaagcugaggcacagugguuucccaaagacucucagcuagacagcagauggggaagguuuuccugacucaguggauguugaauuuccugaguggguccuguccccuuccuucucugugcuucuccccucagugcucaccgagggccucuacaccagugagcgcccauccagggcauccccgggcucucagagaggccguuggccaucagcucuuguggggcugggcugugucugggggugugcaugccauacagaucccagaucccagagggcccaguuuugucuccccucugcccgcccauccugccccuaccuugacauaaucauagaagcagccuucagaaggcuccaggucaaacugcuggaagacgagcuucacccuguaucccguggggacugugaucacagugguuguuucaaaguuguugggguaaggcuuggggaacagaggggaagucaccuccccaaauaacuucugagggaugggaauggagccuccugcccugcagaacagggccggcaccaggagguacaagagccaccugccaaaacaaaagagaguaucuggagcuggagggguucagcacucuugccaugugggcaguggcuguggcaggggaugagacggccauaccacugggcauucuccucucugcccacccugaaccucacagacauguucucagcaggggugcguggguggggaggauggccugugcagcugcugcaucgggucacucuccagggcaguguccaguccagaggccaccacacuccccucacacucccuuuccagccuccuccccugcccggacgcgucccuccccuccccuuccaggaauaggacuggcuugggaccaguuaauggagggugaggguuuccacccgugggucucugaaagggcucccacagguucagcaagagcgucugggagaaaccaucuguggagugggggacacaggcacagagugucccguccugggcaagggguccccuccucucgcugcucccugccaagagcccagagggaagaaaggaccauggcaugagcaucuauguaugaagucuccucugaucccuaggaggagggauggggcguguguuguguguguccacgcgugugcacaguggaacugaugaggugugugaagagagaaggguguuccugucucccugaauugccucccaugcccuggcuucuccccuggcuucucccucccaccugguugcccaucacccuuacucacauuucucaaggcccguguugaauccugggcucucccgacagcgucuucgugcacugugugc

SEQ ID NO: 191695 - RNA, 40496 nt, Homo sapiens
aaugcgcacgccgugggcgggccccgagccggaauugggggugaagcgauagcguuuugcccgcauucggggcgcgcggagcuggggggucccuguggggcucccggaguuaagauggcguccucagcggagggggacgaggggacugugguggcgcuggcggggguucugcagucggguuuccaggagcugagccuuaacaaguuggcgacgucccugggcgcgucagaacaggcgcugcggcugaucaucuccaucuuccuggguaaggacccuccugccucccuccgccccucgcggaguccccggggaguaggggaggaauggggacaggaccucccucucuucccggagccacccgggagggcugugccgggugcgggugugaauccugaagcacaccaacagcuacugagggaagacagaaguccugucucgagucuggggcgcugugcccucugaaccucuucaucuuucucuucaaccccugccaugcccucuggccucucagucgggcccccgcccucuugugccaggcucuacccuugcucccacgaccugucuuuauuugucgcucuguugaguuccacugucuggccauguguccugcucugucauuaauaaccaccccgcacacgcgcgcaucucaucgguaggcauagggccccuaacuuuagcccuuucggccuuuucagccccauauuccauauuucauauucugagcgccuguuuugcuuauugccagcuuauauuauacuuucgucucuuuucugucccaguccuacuauuuucuuuuuauaccauguugcuuuuuuuauuuuccaagccaccuaccugucauuuacccuggaauaucauuuuaaugcuggacuugggaaacaggacuaacaaccuccuuaaaaucgauccauacuauuccaagcguuuauuacacgugugguucaaaggaugugguguaucugaauuuaugccacaacaagcuguauuacaacugguuuauaggcuuuuuuaccgcauccucacuccaugguuuaauacauggagguagcauaguacaauggaaaaaaguauggguuuugaaggcaaacaaaucagauccagccuuguugcugcucacaaacugaaggacccuacgcaggccgcaaaacccucugggccuaauuuccuuaucuaugaaaugaggacaacagugccuaccacauaggauugccauaaaguccuguagaagggccaagauugggaaguaccuguacauauauauacauaaaauuuaagcaguuggaacguuuuaugaagguuauagaacuuuaggagcgggugagugggaaggauuaagcaaaagcuguaaguggugauaaggaaacaggacuggggcuagagcagaggguuagaggucugaaccaugagaaguuugagauaaaguugggcagguguggaaagccuuaaaugccagagagaaguuuggcguuuauccaguauucaguagaaacacugauauauaauaucaccagaggguguuaacccaaucuagauaaugggauaggcauuaauucauauuuaaacaaccuugccuaauagcauuguuacuuuccuauuacauaucaaaccaagaucuuccuuucuuccaaauaaagaucaccuuuuucuuccucuguggaaucguaagauuuuaaagauggaauggaacugggguugugcaguuugcucagugucacccagacaucauccaaauuuaucagcacccuagucuaggcuuauuugcacuacaccagcuuugaacuuccuacucuuucauccuuguuucugacccaguuauuuuugacauuguaauuagcaauuaguguuuacauuugacaggacgcagcggcuuaugcuuauaaucguaacacuuugggaggccaaggugggaggaacgcuugaggccagccugggcaacauuuuauuugucucuacaaaaaauuaggccaggcgcaggggcacaugccuguaauccuggcauuuugggaggccaaggugggcagaucgcuugaggucaggaguuugagaccagccuggccaacauggugaaaccccaucucuccuaaaaguauaaaaauuagcugggcaugguggugggcaccuguaaucccagcuacuugggaggcugaggcaggagaaucacuugaacccuggaggugaagguuguagugagccaaguuagcucuacugcacuccagccugggugacagagcaagacucugucuccaaaaaaaaaaaaaaaauuaauaaaaaaaugagcugggcgugguggcucaugccaugccuguggucccagcuacucccgagauugaggugggaggaucacuugggccuggaaguuugaggcuacagugagccguggcaccacugcacuccagccugaaggauagagcaagacccugucucaaaaaaaaaaaaaaauuguauuacauucauuaguuaggaaacuguugguuucucaacaauaaauucagaauguaacacaaguagcaaccaguuauaaggggcaaucuguuaaauggaguuagggcuggaauuaggacuuggaauucaacuuuuguuuguugacauaaagaauucaacuuuuguuuguugacauaaucacauauugccugugcacuccugcugggcuauugcuguguacugucacggggcauacagaugacuaggaaauuguuuucuccauaucccacuccucuucucucaucuucucucauuaccaccaaucaucaaaguaauaaacacuugguguaaugcaucuaccacacucccgagcccccuugcucauucuaccauuucccacacccugccuuccuaucucacauacccuguugccuucaguaauucauaguauuucucauuuuuagaucaacuuggggcuucaacuugccuccuaucagguauagcucaucauguggacggguaggauuguauuccuaguaggcacaguuuaaauacauacauauaaauauaaauugauuaagcuugaugugugcgugguaggagugcauuuugguuguaaauauguuucccuuacaaagguuauuaccauuucuguguauuguaaccuagaaaccaguagccuuucagcaguggaguuccugguucuugaacccagcucucucagggaacugggauacuggaggaaauccuugcuggagguaccaagaaagccuguaguccaaaaugauuucugguucacuuuccacugauuagauuaauucagguuaaaaacaccucccuaaaugcaaauaccccaagggaagaguuagguauaucauucacauuuucaaguguacguuuuaaucagauagucuaauuacuauuuucuuaacaucuuacuuuuuuuacuucaguucugugugcugaucuugggguggaaugcagagcauuaaagcacuggcuuuuaaaccuuuuugacuaagauccaucguaagaaauauguuuuacauugugacccagaacacacagacuuguauguguauacacguauuugaaacaaguuucaggaaagaauacuugcccuuaauaauaacucacuaaguugauuucaugacuuguuaaugaguuacaacaguuugaaaaaucuugaguuagaggcugcaauuuuuuuuuuuuuuuuuuuuuugagacggagucucgcucugucacccacacuggagugcaguggcucgaugucggcucauugcaaccuccgccucccagguucaagcaguucuccuccucagccuccugaguagcuaggacuauggugcacgccaucauacccggcuaauuuuuguguuuuuaguagagacgggguuucaccauguuggcuaggauggucucaaucuacugacgucgugauccaccugccucggccucccaaagugcuggaauuacaggcgugaaauuacaggcaugagccaccgcgcccagccgaggcugcaauuuuuaauauucaauacuucaaagaaaaaguaagcuuauguggacugcugcacuggaguauuuugagcagucagaagacuguaaaaggaguguguuuauguuugugugguguaugcuugcaaggaguuugauggaaggaugcugaagaggaauuuugccaugagcccuggugcuggcaaauacuaccagaaaacaucuccccuucaacagcuuggaucucaucacuccuuaauguaacuaauaccaugaauugcucauauaaauucaguaacaugcaccuacuacagguaaagcaguauucuuaacccugcaagggcaggagcaguggguguaguaugagucaggagcccugcacucaaagguauuauggucuguuaggguauaggaaaugggccugagauaaguauacuaauaaccccaauaaauuuuaagcaccauaagagagguacagagcuuugugagauuuaaagaugggacauuucauuuaaagaugaguaagguuucagcaugcugagaugguaagacuuaaggaauagcaugagcagaggcacugaggugugaauguggcaacacagccaaggaacagucaguagucuagugugacuaaaacaggacuuuaaagaagugauggaaaaucaggcuggaacuguagguuaaagagccuuuaaagccaagguaaagaguuaguacucacguaggugauagggaacauuggagauuuuugaguggggaauaauauggcuggagcuguauuuaaaaagauaauacagccuggggugauuugaagucagcauagacaaguaguagggaaacuaaggagaaagaagugaucuagagaggaaguuauaaugacuuggaggcaggguggcugugcugagaggagaaagugggcaucuccugugagauggucuaggaauaccggaaccuuuugaaagguagauucuguagacacagucaucuacacagcugcucaugccugaaacccaagaaucagcuuuguugccuuucuucacucacuccccacaucccagucacccaauccuaucaauacaaccucuggauugugucucagauccaucuacuauucuccaucaccacagccacuaaccaucugucaccagcaccacccaaguagccuccugacuagucucuaauucuguucuugcccccucaguccacucuccaaaagcagccagagugauccgauccugugccucuccugcucagaacccuucaggggcuuccauaccuggcugguaagccccugccugcugccccagccucgucccaagcaagcugacaaccuuuuagccacauggccuuuguucaguuccucaggaaaggcaugaaggcuucccuaccucagagccuuugcacacgcuuaccugcugccuggagugcccuucagucaccugacaaacuccuuuucaucuuccucugaguucuuuccugacucucauguucaauuauguccccuguuacacuuucucauacugaccggaauuuccuuccaaguauauauuacacuuuguaauuauauauuuguagaugaggacagaaaccauggaaguuuuguuuaccacaguguacccagaguuuaacacauuacuuggcuuguagaaaaggcucgauaaauacuugaauaggugaauguaugaaugaaugacuuggcaacuuauuagcuggaggauaaagucguaauuuuaaaaagacuccauccuccugccugaguagcuggaaagauaaggguaucuuugaccaaugccagagaucaaguggaggaucagauacucuuaagugccaggaaaugaucugguuugggguucacuuuagguuccaagggcacuuccagguaucuugggaguugugaagccuggucuugagcucaggaaagaagcugggcuaaagacagaguuuuaggagacaguauugguaucauaacugacucagggagggaaugaaaugccauggaaaagguuauacagagaagaggaucuuauucacguugauuggguauguuaauguugcuaccccuugauaauaguaauagcuggcauuuauuaaggauuuucuguguaccagacauuguccuaaauggucaacaggcaguuccccaccuaaaccugccaguuacccgugagguaauuauagugcuguuaagaucuccugguacagauaggaaagucagcccuacaaagauugaguaagucacacugaguucugccugacuccagaguuccugcucuuuaccgcugagauugggaggagcauguggggcuggaaaagauaaaugcccuugguguccuuuucucuuuucacucucagugguuaaaccaagaugcaaucaguauaugagccaccucucaguguccaaagcuagagcuggccaaauggagcagauggccacccugcuuacugugaguguucccuagucuuggccaugaugguggcuuggcuguuagacugaucaaaaauugcagcuggggguaacaauucaucccucagagguucagaauuagcaucacuaaaguuagcgaccuuuaaaaucaaaggagguccugcaguuuaguucccuuuggaccaaagucaggucuggcccuucagaaaaaaauccauuauucagugcagaaagcuuucuucagguagcacuggaaucacaauauaaagagaccaaagguaagcuagaugaaaauuaagcagcauuaaugaaacaaagagacuucugaccauaauacaaagcaggguccaaaaauucuacugcuauaaaauagggagacuguccuaaaugacuuucaaggacccuuccaauuuuaaaagucuagguauauuacuucuacauguuuagacuuuauucuaguucauagccacaaauuucaucauaaucuaaaccuucccguuugggaauuucuuuuucuuucuuucuuuuuuuuuuuuuuuuuuuuugagacaugguguuacucugucauucaggcuggagugcaguggugcaaucucagcucacugcaacgucugcuucccagaucaagcaauucucuagccucagccuccugaguagcuggaacuacaggcgugagccaccaugccuggcuaauuuuuucuguauuuuuuguagaaacaggguuuuaccguguugcccaggguggucucaaacuccugagcucaagcaauccaccagccucagccucccaaagugcugagauuacaggcauaagccauugccccuggccaagaauuucuuuuaaauacaauuuuccaggucaggcacggugcuuacgccuguaaccccagcacuuugggaggccaaagcaagaggaucacuugaguccgggaguucaagaccagccugggcaacauagugauaccucaucucuacaaaaagugaacaaaauuaacugggcuggguggcauaugucuguagucccugcugcuugggaggcugagguggaaggaucacuggagcccgggguccuccgcucaacucaggacguugaggcugcauugagccaagaucauaccucuacacuccagcaugggcaaaagagcaagauucugucucaaaaauaaauaaauaaauuuuguuuuuaauuagccaggcaugauggcaugcaccuguagucccagcuauucaggagaccaaggugggaggaucauuugagcccaggaauuugagacugcagugaacuaugaugaugccacugcauuccaaccuagaugacagaaggagaccucaucucuaaaaauaaauauauauauuuuuuccaaccacuuuuuaucuauaccccaaugucuuacauuccauaaaacaucauguuuugaauuccaguauaacuuuaucguuaaacauguuucuuugcagaagcauguauaaguuaggguccacaagauuauuugcauaagcuaauuuacaaaaaaaauuauauaaucacugacaugaaagcaugucugggcagccaugggagcucauaugaggcguccaguucagucgccuuuuaaaaaugauauuugcauuagcugggcaugguagcaugugucuguagucccagcuacucaggggacugaagugagaggaugcaccagagccccagaagucaaggcugcagugagccaugaucacaucacugcaccagccugggcaacaggagugaggccuugucucagucagucaaucaaucaaucaauaaugguauuuggucuucugaaagaaagugacauuuuagcugggccuuaaaggggaugguaagauucuaguaaaguagagaugaaagcggaggagcuuuccagcuacaaagaguaaucuggagaucaggaagaguaagacccugucugucccugaaucuaaggaaaaagaaaaaaaaauuuugagaaaaaucugaggaacagcaaguaguccucuuuaaccagaacaauagaagaucguaaaagagcaguagagaaaaacaugauaggccuuuuauguagguggaggucaaugacagaguaagguaguaacaugugcauugucuuuagagaucuucuggccuagguucaaaugcuggaucaaauaaauauguacuagcuguuucaccauaagcucauuaccagaguucaaccacccauuucuuuauauucccacaggccaauuuuacuaaagaauugcaaugaagaguuaagcaauuuaucugauaaauauuuuuagauuuauauuucauucauaacuagcagcaguauuuugaaacagaauacaaaauuuauaugaauuuuuaaaguaauacagucaucaaagaaauuuucuauuucuagaagacugcuuaggcauacucuuuugugauguguucauucuccuuuggccuggaaaaguuugagaacuguugcucauugggauguuguaaggacuaaauaagauaaacuauguaaacacuuaaccaugcuugacccaagaucaucuuaaauaauuguucuucccuucccugucaauaaauauuuauuuucucccuuuccaaggagacacaaaguauggucuugugaccaacagcaucuguaucuuaugggagccuguuagaaaugcagauucuuuggucuacuccaaaacuacugauugagaaacucugaggauagugcccaguaaucuguucuagcaagccagguuauacuuauuacucuagaguuugaggauuacuaauuuagcauauuucuuccggugccuauuuuguaguacuugauguccugauaguaccuuuuuggaaugucauuggccaggcgcgguggcucacgccuguaaucccagcacuuugggaggccgaggcaggcagaucaccugaggucaggaguuggagacuagccuggccaacauggugaaacccauuucuauuaaaaagauaaaaauuagcugggcaugguggcacaugccuguagucccagcuacuugggaagcugagacaggauaaucgcuggaacccaggaggcagagguuguagugagccgagauugcaccauggcacuccagccugggugacagaaaaaaaaagaaaggucauuguauccuguacucuuuggaauaaacaaaacucuuagauuccuuaugguuuaguuuuucccauuuguaggccugacagauaggaaaguugggccuacaaaaauugaguaacuugcuuaaagucacauucaguucugccugacuccagaguuccugcucuggauguuaucugaggaauaaagagauguuguuguuauuauguucacauuguuauuauguucacauuguuauuauguucauuaucaugaucaucacauacaccaucuguuucacacuuuugauaagaagguuagauacagaggaguuguguuuuuuguuuuuuuuuugagauggagucucacuuuguugcccaggcuggagugcagagguacaaucucagcucacugcaaccuccaccuccgagguuccagcaauucuccugccucagccuccggaguagcugggauuacaggcgugagccaccacacccagaggaggaauuuuuuuaauaagguuauuggacuaauggcuccaucuuuuuuguguugcaucaaccaccuuaagcaauauagcauucuccugauugaucuccuuacguuucuuaauauaaguaauaaauugugacuuguagcuuuaacaaaaauuagguucccuaguugcagcugccagggaaagcuagucuaauaucaaagcaaaccauccuucuucucaagcacagaguuuuuaagauaggaguguguguguauugacauuuuccuagcaguggcugaagucaaggaccaggagauuuagggcccacuuggaguucuuauggugaaacaguaguagcuuccuagagaccuuuaaagcuuaucuguaauuuguauaguucagaagauacuguauacaucauuauuucucccugcuuucaaaacaggaaggggguguggagaguaacacacuaaaaaaaggauaaguaauuaauuucuggguaagaauuuccuuuuggcuuaaaauggacugaugguguaaguuccucccuuugcaagcagaagcuuugaagauagugagcuagaugaagcucuggacaucuugaaugaaguauucuguauaagaaccaaguguauaauaacuguuaguaauagaggcugcucauagaaaugucauugcauuauaauuguagggacaguuugucagagaguagguagaagauuaucagacccagguuuuguucuuggcucacaugaagucaucaaguaggcuauuuaaaugcuucacuuuaaccauaggcuaagauuaaauuaaaaauaaaaagcuuuugucauggccgggcacaguggcucaugccuguaaucccagcacuuugggaggcugagguggguggaucaccugaggucaggaauuugagacuggucugaccaacauggugaaacccugucucuacuaaaaauacaaaaauuagccgggcacgguggugcacgccuguaaucccagcuacucgggaggcugaggcaggagaaucgcuugaaccugggagggggagguugcagugagccgagaucguaccauugcacuccagccugggggacagagugagacuccgucucaaaaaaaaaaaaaaaaaaagcuuuugucaauuaaagaugcuugucaguacugaguauucauguugcuauggcacuuuuauaagaaaacuguacacggucauaucugcuuccgaaaauaauacauagugagauaguaauuuuacaggcaauuaagaauuugcuggccaggcgcgguggcuuacaccuguaaucccagcacuuuggaaagccaagguggguggaucaccugaggucaggaguuugagaccagccuggccaacauggcgaaacccugucucuacuaaaaaaaaaaauccaaaaaauuagccgggcaugguggcaggcgcuuguaaucccagcaacuugggaggcugaggcaggagaaucacuugaacccgggaggcagagguugcagugagccgagaucgcgccauugcacuccaccugggcaacaagagcaaaaacuccgucucaaaaaaaaaagaauuugcuauaauagaagauccauguguacauucuguaugcaaaucuuaggaagauauuagaucccagaagguuaaaguuccgaucucuauauauuuguauaugcuuuaaggagaaguggcauccauguagaugugguaaauggcuuauaacucucgagguuuccaauuucugcugugguagcaauucuaaacucagauggacuuggacacuacucuggauuacugucccuaaauaucaacuacuguuuauaagccagcagaggccaacugaaauaguacacauaaaguuccuacagcauaucccucagucagaaguggaaaagauugauuaaaguuggaguauaaacauauggggcccugaccaaaaauauugaaccguacuacuagaaauccccauucuuuagcuaaaggauaaucugacuucacuuuuaauucuucauugacuauuggugcucugaaagaauaggaaauaauagcaaaacaugggaacuccuagauagcauacauuuauuuuuaaaauguauaccaucggccaggcaccauggcucacgccuguaaucccagcacuuugggaggccaaggugggcggaucauuugaggucaggaguuggagaccacccugggcaacauggugaaaccccaucucuacuaaaaauacaaaaacuaacugggugugguagcacacaccuguaaucccagcuacucaggaggcugaggcaguagaacugcuugaaccuggaagacagagguugcagggagccaagaucacgccacuguacuauagccugggagaaaacaaacaaaaaacauauggucaacuucccaaguaaacugaccaaugucaguuuagguucagucuuacuguaggagugccugccguaggccagcgccucucaaccuuuccacuaaguacauuaagauccuaacaguaaucauugggaccccaggucaucgucucaacagaagcuccagauuucuucaagucuuggcccucuuguuuuauaucaaaauuuuauguauauuauuuuuauauuuucaaaaauucuccccagaucaucaaguaauauugagaugcugacauagaaaaaaguagauuuccagcugguaugaucagugauaaauuggacuucaucaaaauuaaaagcuuuugugcaccaaaggauacuaucaagaaaguaaaaagcuaucccacagaauaggagaaaauauuuguaaaucauaagucuaguauucagaugucuaaagaacucuuagaauucaacaauaaaaagauaacccaguuuacaaaauggauaugaauagacaguucucuaaaagagacauauacauggccaauaagcucgugaaaagcuguuuaauaucuuuagucauuagggaaaugcaaaucaaaaccacaaugauauaucauuucacaccuacuaggauggcaauaaucaaaaacacacaaacagauguuggugaagauacggagaaauuggaacccucaagcauugcuggugggaauguaaaauggugcagccacuuguggaaaauaguuugucaguuccucaaaaaguucacaguuaccauaugacccagcaauuccauuccuaggguuacacccaagggaacugaaagcauagauucacacaaaaacuuguacacaaauguucauagcuuuauuauaauagccaaaaguggaaacaacccaguuguccaccaauugggacaaauugaaugaauacacaaaauguuauauccacacaauggaauguuauucagccauaagaaaacaaugaaauccugaucacaugcugcgacacagaugaaccuugaaaaauugugacaugaaacaagccagacacaaauggccacauauuguaugauuccauuuauaugaaauacccagaauaagcuaauucguaaagacagaaaauagauuggugguugcuaggggauaagaggaagggugaauugggaauggccacuaugcgguacaggguuucuaauguucuggcauuagauagcagagaugaaaauguucuggcauuagauaguggagaugguugcauaacacugaauauacuaaaauccacugaauuguacacuuaaaaaaaugaagaaagaaggacuaugcaugaucaaagaaaaaaaugcuuugugcucaaguagggauagaauaaacaguaagacuggaaagacugugaagggccuugaauggcaagcuaaggaaguuagcuuucaucuuauagaucguaggaagccaccagaguauuuugagcagggguggcauguuuaagguaguguuauaggaaguuuaauuugugaaaugagaaagagauacuaucagccaggagagguagaagguucuauaaagucaaauugaacacccgaaguuucagauuucaugaaugacccuggguauguguguauacacauauguaugggauuuguagucaucuggggaaggcugaggugcuaauaugaauacugaaaacuagagaggguaauauagcagaguaguuaaaaaugaaaacacucugaacccacaugcugucuggguucaaauuccagcugggcuaccuuccagcacugugaccuuagguaagucacuaacccugucugugcuucagcuuccucuuccguaagauaaggauaccuacucaucaagguuguuuugaggauuaaguggguuaauacauacaaaguguuuacaaugucaagcuuaaagaaagguccccaaaaaugucagcugcuagucugaaacuccagagcagguuugagaguaacccgcuguuguucucugccccggauaaacuaugaaguaacaguccuaaaguguuaaaagacaaaacaaauuuuucuuugugaaaaaugacccuuuaaaaaaacuccaucuacuaauaaugaagcuuaguaguaguaaaaugaugauuuuuagccauaaaacggguuuucuauaucuucacaaauauaguguagaguuucacaauauucuuugauaugaaccagucucucauacuuucuguauagcacugauucgcuaaguaagaugccaaggcaugaccucccuucaggaauugggaaucugcauuuuuaauaagcauccuagguaauucuuuuuuuuuuuuuuuuuuuuuugagacggagucucgcucugucgcccaggccggacugcggacugcaguggugcaaucucggcucacugcaagcuccgcuucccggguucacgccauucuccugccucagccucccaaguagcugggacuacaggcgcccgccaccgcgcccggcuaauuuuuuguauuuuuaauagagacgggguuucaccuuguuagccaggauggucucgaucuccugaccucaugauccacccgccucggccucccaaagugcugggauuacaggcgugagccaccgcgcccggccgcauccuagguaauucuuaugcaugauacagguugagaccagugccauguacagaagugggaaaaauggcuuaugaaacucaguuguauuuagcacacuguguuagacauaaaauuugaaaacccaaccuggacaacacagugagacccagucucuacuaaaauaaaauaaauaagugaacauugaaaaccaauggauaguagaauguauucaguucagugagacaugaaacaauauuuuugcuuaauugaaucaaacauauguuaaaaaaaaaaaaaaaacucacccuacucccaaagcacucaauaaauucuucagagaaaaggaagagcuuuuuguacuacauugccucuaaaaucuucuguaggauaagacauuuuaagaucacuuaaaaucuuguuuuaaguuuuuaagucucauuuuaauaaccaaauaaaaugguuuuuauuugagccaguuucaaguucuuaaagugacacauaggacuuaacaaaauccauuaguugucauuugugcuuugcccauuuuuacugauuucuucauacucugaaggaaaaaaaaugcuacaaauguauguugguauauaagagagugcauuccauaaauauuagaaauuuuuuuuuucuuuuuuugagauggaguuucacucuuucgcccaggcuggagugcaguggugccaucucagcucacugcaaccucugccuuccaguuucaagugauucuccugccucagccuccugagcagcugggauuacaggcgcccgccaccacgcccagcuaacuuuuguauuuuuaguagagaugggguuucaccauguuggccaggcuggucuugaacuccugaccuugugauccacccaccucagccucccaaagugcugggauuacaggcguuagccacugcgcccggccagaaaaauauuuuauagaauucaaacuuguauuuucuuuugaagggauauaaaaagggugagagaacccaacaaccacacuuauucaaauuuauaaggauaauuaggaguauucucaugguuaucuuuagaaucuuagcaggguaaaaaagaguuuauuguuucauuugcugaaacuccugagaagaagucucaccacauuuguauuuacagagauuagauuuggcaacucuaaagacaagagaaauuacucaugauaaguguuuggagggguuggagagaaaacagcuaauuaggcacuuggcaguguggcagggcaaccuuugggcaacccaguccagauuagguuagaagaggagcacggaccuuuuguccacugcaaaccagugccacaaaugaagugggaagagacagguuaccacauacugguuggacuugagagagaaccagaaaguguacaaucccauaagcauaaaaaauggggauaaaacuucaaguguauauaaggguaagaacaggaggaagcaguaacagagagggcaggagagaaagaucagaaggaaucggacgccugagaagaggaacugggggcugaguccuguccuggccuggccgcuccccauuccucccucugccucugagggcuucaguuuucccaagugagaaacagcugugcuagauugcuucuacaguccuuuccacuccuggaccgaaacaguugccccugcaucuaaaauacguagcucuagcauauaaaaugcagguuaccucaacucccccccgacucccacaucucacucccuuccuuucccugccugcccuaauucuggcugcguucuguucuugccucauauggacucuuuuucuccuccccuucuuuuccaaugucaugcagucucuuaacacuggguuucaaccacuauacagaaaaauguuagugaaaaaggaagagggguuccaugcugcuugauucucccuaaccaggcacacuaaacuaggggugacaguguaucacaaaguccagacucacagucuugcugccccuucuccucuucaaaguuuguuuccgaaguaccaccccuugcaccucacaucccagccaacucugccuaccugucagccccagcccuccucaggccugccucagccucacagccaggauccuaccaacaccaacaccgcgccaaauaaccccucccaaaagccucaccggaacuaaucuggggacucugccuauuauuaggaacaccuuggaugaagccccuacccgcagaauucuggcaguagcagcagaauuuucaggcaugugccuaauuuuguugggguggugguugauuauuuuuuuuaaaucuaggauuucugggaucugaagcuuauacaaucuuggauaucuucuuuaagaaaaagaauacaaaaauaucuucuauaaguuuuacaaaaauauaugaccaugugagcacguugcuagcucccgcccccaccccaccccccagagccuuggaaggggagugaaacugaagcuuuuuuagcuucauggcaaauaugcuucuuccugagaguacuggguacauucacagaccuuuauuuuuuacuuucuauagauuuaauuuaguuaagucaguucgaagcgggcaaaggccaaaauuucucaccccuagguggcucaaauuucugagccugagauuuuauaucuuaaaauccauuaaaagaauacucaauuuucggccgggcgcaguggcucacaccuauaaucccagcacuuugggaggcugaggcgggcagaucacgaggucaggagaucgagacuauccuggcuaacacggugaaaccccgucuccacuaaaaauacaaaaaaauuagccaggcgugguggcgggcaccuguagucccagcuacccaggaggcugaggcaggagaauugcuugaaccugagaggcagagguuucagugagccaagacugcacuacugcacuccagccugaggaacagagcgagacucugucucaaaaaaaaaaaaaaaaaaaaagaauguaaguaauuugcccaagcugcagagcuaaauuuuaaacuagauaauucugauuccaaagcccagauaaucuggcuagaaguugcaccaggggauucacugauuuacaaagaauuagaaugugauaaaauucccugaguacaggcaagugugauuuuuaucuuugcuaguaaagccauuuagaugucuuaaagugccucaaucuguugcaccuguucuacuaaaacaaagaaaugagucaacggccucuuuuagcuuuaacauucucucugucuauacauuuuuauagaauaauuuuuaguuauugcagcagguuucaccagucagccaacggguguguauaacauuaaucacuagcacuacaccucagaagucuugcuuauuaagagcacucagcuuaagugaagaaauuaaagaauuuugguaggccuuugggacaguucaaguuuagguuguuuggcuggguugagagaguaaaaaacuaacauuucuuaaccuaacccuuuuucuuucuuucucacagguaacaacuauccaauagcuuaccuuuaaaauguccccucuauuguuccucccucagacauuuuugaucacuugucccaguuuccaugaguccuguaucacagcugucacaaugcuugagcuauuuagguggagguaacuuucagaaaugaacugcugaagggugcagagugcucaagaauuagauuaacaaagaaaguacaccuaaauuuagcauuaaaaugaacuuuuaaaauauuuuucaauaggaggauaagcaaacauaaaaaugggugugcuuaugucuauaaacaggugcuggagcauagauuguuaucuggacaucaaagaauaauagagcuguagcuuuaaaagagcacacagcugguuauuagugauucacucccaggucacugccaagugccaaggcauguggcaagaauaguagaauggaaaucaggugauguggauucuaauuugagcucugcucuguuaaccuugggcaugccaguuauccccuuuggaccuuagucucuuaucuaccuaaugaaggguuuggagcagguaauucuucaguucuaaguaagaaucuguauucaugaauaacuguucagcauaugacucagcccaagguguacaggauugcuggaguguggaagguauguuggcuccugccuguacuagcaacaaggcuuaaucuagugaacagaaaggaucaaagguggcuauauccccaccuaaauguccaugaucuacaagugcucuucuagcuggcagagugggucaguaaugagauuuuguaucucauuauaugaaguucuaagcacugaaccuaaucaguuacccaucacuuaaguagacagugucaggcagagcuuaacucuccuuccuauuuuccuuugucuuccuuuucucuguaaguucucuaacauaaggaacuuccauuuuggugaaagaauagaaaaguugagggacaggccagguguguuguaaguaagacugauccagcugauugguuugccauuuagauugcauggcagacaucugccauaagcacuuaaaacacaccuucaauaggcauuagaaagcacacacacggccaaacauaguagcucacaccuguaaugccaauacuuugugaggcugaggcaggaggauugcuugagcccagcaguucaagaccagccugggcaauauagcaagaugccaucucuacaaaaaauuuuaaaauuaucugaaugugguaguacauuccuguggucucagcuacucaggggucugaggucggaagaucacuugagcccaggagaucaaggcugcagugagccaugacugugccauugcacuccagccuuugcgacagagcaagacccugccucaaaacacacacacugacuagggaugguggcuuaugcccagcacuuuaggaggcugaggcaggcagaucacuugaggucaggaguuuaagaccagccuggccaacauggugaaacccuacucuacuaaaaauacaaaaaucagccaugcggccaggugcaguggcucucgccuguaaucccagcacuuugggaagcuaaggcaggaggaucaccugaggucaggaguucgagaccagccugaccaacauggugaaauccugucucuacuaaaaauacaaaauuagccccgugugguggcgccugccuguaaucccagcuacuugggaggcugaggcaggagaaucacuugaacccaggaggcagagguuacggugagccgagaucacgccauugcacuccagccugggcaacaagagcgaaacuccaucucaaaaaaaaaaaaagaaaagaaaaucagccaugcauggugacacacaguuguaaucccaucuaccugggaggcugaggcaggagaaucgcuugaaccugggaggcagagguugcaguaagccaagauugcaccacugcacuccagccugggcaacagagugagacugugucuugaaacacacacacacacacacacacacacacacacacacacacacacacacauaauuugcuguuguuuugggggcauggcggcacauaccuauaguccuagcuacuugggaggcucaggcaggaggaucacuugaacccaggaaguugaaacugcagugagcugugauugugccgcugcacuccagccugggcaacagagugaaguacugucucaagaaaauaaaaaaauaaagaaauaaaaacauaagguuuagauggcaacuuuaaaaugugaaaggaggauauacaguuuuucaaaauucuucuaggagcuaugccagcaaaaagguuugaagaccugaagaccauuauaucaguggcauaaacaucuuuaauuuguccuuuuccuucuccuacaccuagucaauugauuuuuuuuuucccauuuaucaauuucagacucugccugguuuuucacuuucccauccauuuuguuacaauauuuuuccucccuugaaauuagcccagucucuuggagugaaugccccaugcuccuuccuaccgcugugucuuuacuacauuauccucccuuggaaugccgucaucucuucucuguucaagaacuacuucucccgaccacuguggucgagauugauuucucuuuaaccucuacaacauuggcuauuccauacaguuagcccuuagcauagaacaucauuguuugauuuugcuccuuaagaauagaaagcaccucuuaaaauucuaccauauucccccaaugccuaaugcaaugcuaaccacauagugagugcuuaauaaauauuguauugacugccuagaguacagagcacuuguucacucauuguucggccauucagcuaauacuuuuugagaaauuuuguguaccaggaacuguacuaugcacugggguacgguagggacuaaaguagaugauaaucccugcuuugaaagacugaaaaguaagauauaugguaugucaaaagguaauaaguacugagaagaaaaauagaaaaagcaggaaagaagaacaagaagugugugaugggggaggguuacaggguggggagggguaguguuguauacacuucuagauaagauagggaaguccucacugauacuuauggugacauuuuacaaaggaccugagguguaggaaggauuugagcuuaucugugcaaagagccuuccaggcaaggaacuuaccaugugaaggcaccaaggcuggaccugcuuaacauuccaggaagggaaagcuuuggggcuggagcagaaggguagaggccagauugagagaugagucagaggacaguggggcccgggcagagggacagaaccugcgggugcuggcaaucagccuuuugaucugagugagaauagaggccuugagagggcuuugagcagaggagugaccugcugacuuaaguugaauagaacccucuagaugcuucauuaaggcuagacugaagggaggcaaaggcagggugagaucagucaggaggcaaguauauaaugauaauacauugaauauaauaaugauauauuaauaauaauaauccagagauaguggcaacucagaccaggggaagcaguagaggcggagagaaguggucagauuuuggauuuauuuugaagguagaacagacaggauugcugacucuguugaguagucagcugggagcuauugaugguuucugagcaggagcugaaggaagauuaccccgguauaggacugcugggaagacguggugcaggcagagaucagguaggaggccauugcaaggauuuaagggugagauccauaaggguuuuaacugcaaaucagcagaggaaaaagggaguggugauggucauggugacagugauggugagagagacuggaaaggaggaaucaacaggauuucaugacuagauaacagagaaccaauaugaagaaggaaaacacuuuuuuuuuuuuuuugaaacggauucuggcucuguugcccaggcuggaguacagugagacgaucucagcucacugcaaccuccgccuccuggguucaagcgauucuccugccucagccuccugaguagcugggauuacaggcaugcaccaccacgcccggcuaauuuuuguauuuuuaguagagaugggguuucaccauguuggucaggcuggucuugaacucuugaccuggugauccgccugccuuggccucccaaagugcugggauuacagacguggagccaccaugcccuggcaggaaaacacacuuuugaauguugugugaccuggagaaugguaacacuguuaauuuaaaaaaaaaaaaaaagcccagagaaggcugauuuagggagaaauuuaugccuuaguuauacagaguuugagaugguaaugaaauaucaaauuaaaacuguccagcaaggaaguaggaaauguggaacugaaaaagaaguuagaacuaaagauguggaucugucuuuggcauaaagauuauauuaaguuacuugagaguagaugaguuuccaaagaagcaguguagcaagaauaguggagggccaagacuggauccugggggucagcaacaucuaggagccagaaaaaaugccuucggugaaagaaacggaaagaugggucuauucaaauuguagucagccaacccaugccagaaguaagcacagaaaguaagagugaacauuggccaagcacaguggcugaugccuguaaucccaacacuuugggaggccaaggcgggcagauugcuugagcucaggaguucgagaccagccugagcaacauggugaaacuccaacucuacaagaaauuagccgguccugugcacaccuguagucccagcugcuagggaggcucaggugggaggaucacuugaaccuagaaaguugaggcugcagugagcugugagcaugccacugcacuccagcgugggcaacagcccgguggcucacgccuguaaucccagcacuuugggacgccaaggcaggucgaucacuugaggucaggaguucgagacuagccuggccaacauggagaaaccccaucucuacugaaaauacaaaaauuagcugggcaugguggugcacaccuguaaucccagcuacucgggaggcugagacaggagaaucacuugaaccugggaagcggagguugccgugagccaagaucaugccacugcacuucagccuggacaacacagagagacucugucccaaagggaaaaaaaagaaaaagauccaggagauccauuccuagguauauacccaagagaauugaaaacauaaaaacauauguucacacaaaaacuuguacaugggcucauaccuguaauugcagcacucugggaggccaaagcaggaggaucauuugaggccaggaguucaagaccggccuaggcaacauagugagacccugucucuacaaaaugcaugaauguuuguagcagcauucuucauaauguuccuaaaguggaaacaacccaguuguuugucagcugaugaauggguagauuauaugcagaguauccaggcugggcguaguggcucaugccugcaauccuagcacuuugggaagcugagguggacagaucauuugagcucaggaauucaagaccagccugagcaacauagugagaccuugucuauaaaaaauuuuuaaauguuaaaaaaaagaaugcagaguauccauacaacgggauauuauucagccauaaacaggaaugaaguacugauacaugcuacaacauggaugaaccuugaaaacaugcuaagugaaauaagccagacacaaaggucuacacauugccugacgccauuuauaugaaacaccuagaauaggccaaucuauagagacauaaaguagaugaaugguugccaggcucugggaguuaagagagaaugggaaaugacugccaacauguaugggguuucuacuugaggugaugaagauauucugaaauuagauagauaguggggauggcugcacaaccuuuuuuuuuuuucuuuuugagauggagucucgcucuguugccaggcuggagugcaguggcgcaaucucagcucacugcaaucucugccuccuggguucaagcaauucuccucccucagccuccugaguagcugggacuacaggcaggcaccaccacgcccagcuaauuuuuuguuaguagagacaggguuucaccauguuggccaggauggucuugaucuccugaccucgugaucugcccuccuccggcucccaaagugcugggauuacaggcauaagccaccaugcccggcgacaaccuuuugaauauacuaaaaaacauuacauuuuacacuuugaagggugaauuuuaugguaaauuauaucucaguagaaaaaaauccaggaaacuguguauagucagcccuccauauuuguggguuccacauucauggauucuaagcuaaauaauaauacaauaauaaaaauauaaauaaaaaacaauaugcuauauagcagcuauuugcauugcauuuacauuauauuagguauuaugaguaauccagagaugauuuaaaguguaugugaagaugugcauagguuacaugcaauacuacaccauauuauauaagggacuugagcaucuguggugucugcugcgaguacuagaaccaauccuucauggacaccaagagauaacuguauucaaaaccaaugaaaccagugaaagagaaguuucaaaaagauugaaaacacagcagggcagucaaggaaaccagggagaaaggaaagacuaguggauuuggguauuagaagaugaaagauuaaaacaaaucauuccauaucagcaugcaguccauagacuacuccuaaaaguuccugagacuucuuuaaggaaucucuuugggguaaaaauuauuuucaugauacuacuaagauguauuugucuuuucccuauguugacacuugcacugauguugcaaaauggugguaaaacugcuggcgccuuagcacaaaucaggacggugacaccaaacuguaccaguggucacugcauucuuuacugccaugcacucacaaucaaaacagagccaguuucacuuaagaaucguugaugaagugguaaauuuuuuuuguuuuuuuuuuuugaggcagggucuuacccaggcuagagugcggugggggcaucacagcucacugccgccucaacuuccugggcucaggugaugcuaccucagccuccugaguagcugaggcuacaggugugcaccaccacaccuggcuaauuuuuguuuuuguuuuguuuuguuuuguuuuuagagaugggguuucacucugucgcccaggcuaaauauuguuaauuguaucaaaugucaguccuugaauaaaucuuuuuuuuuuaacugguaugcaccaccacacccagcuaauuuuuguauuuuuaguagagacgggguuucgccauguuggccaggcuggucuggaacuccugaccuaaagugaucuacccgucuuggccucccagagugcugggaggugugggccaccaugccugauccugaguacaucuuuuuaaacuuguuugaagaaaugggaaauaugcauaaaccgccucugcugcacacugguagaguacggugguugucacaaggaaaagcauuugggcgauuauucaaguugcauauugauuuagcagcuucuuuuuucaccgaccaccauuuuuacuugaaagaaugauagacaaacuaugguuuuagacuuaggcaucuggcagacagucucuugaaacuguaugaagugagccugucacuucaagguaaacaaaugacaauauuuguagccagugauaaaauuuacacuuucaaguaaaaauuagaauuuuggaaaacuuguauccacucccaugagcuugaccacuuuucaauauauacagacuuuucugcugaaaucaauggugaaauuuaaggaauaugauuuuuugauauguauucuaaugaaauaugucaguauuuagaagaucugccuaacaacagggaaccaguauuuugcagugaucuaugugugauguuacaaagucaugcaugguaaaauauccauucaaagugcaagagaagccaauggguuuuauuauaacaaaaguuccuaacuguuaagaaacuacuacuugucaaguuuugauguagcgcuaaagaauauccaaaauuaucugaaaaugcagauacuuucucugucuguguaaagccagauuuucuuuguauauuuuaaccaaacuaacauauuacaacagauuaaaugcagaagcagauuugagaauccagucaucuucuauuaagucagacagaggccauaaauuuaugaaaauguaaaacaguggcauucuucucauuagauggcuuuauuucuuugauuguuuugggaaauauagugguuuacauuuaaaguauguuauuuauauuaauauaauguguaguaguuuuacuguuaauauuuuuacugaauuaaucauaucuuuuacuuuuuuuuuaguuuuauuuucuuccuuuuuuuuuuuuuuuugauuuggagucucgcucuguugccuagucuggagcacaguggcgugaucucagcucacuacaacccccaccuccuggguucaagcgauucuccugccucagccucccaaguagcugggaucacaggcgccugccaccaugucuggcugguuuuuguauuuuuaguaggguuucaccauguuggccaggauggucucaaacuccugaccucaagugauccacccaccucggccucccaaagcauugggauuacaggagugagccaccacacccaguuuuuagucuuauuuucuaacacaguagacauugauauauaguucccacauuaacaaaaguuguuuggggugcucaauuuauuuauuuauuuauuuauuuauuuauuuauuuauuuuauuuuaauuuucuuuuugaggcggagucucacugugucgcccaggcuggagugcaguggcacaaucucggcucacugcaagcucugccucccagguucacaccauucuccugccucagccucccgaguagcuggggcuacaggugcccgccaccacacccggcuaauuuuuuguauuuuuaguagagacaggguuucaccauguuaaccaggauggucucgaucuccugaccucgugauccgcccgccucagccucccgaagugcugggauuacaggcaugagccaccgugccccgcuuauauuuuuuuuauuuuuauuuauuuauuuauuuauuuuugagacagggucucaaaaaaaacaacuuuguugcccaggcuggagugcaguggcaucaucguagcucauuguagcuucugucuccccagacucaggugauccuccugccucagccucucaaguagcugggacuacaggcacgcaccacccaccccacccaacuauuuuuuuuauuuuuuguagagacagagucuugcuauguugcccaggcuggucucaaacuccuggguuccagugauucucccgucucagccucccaaagcacugggauuacaggugugagccaccacucccagccaaauuuaccagacuuaauggaaacaguccauuucuguuucuucagaugaaaccucacaacuuuaggauuaauaaguaaucucacaacuauuguacaggaaauaagaaaacguucccgcuaacaaugcacguugugauagaucuggucccugacacaaacagcacuuggaacugagugaaguccagagacugaauaauacaguucuauccacucccugugcuugacuacaaccccugaagagggcuuguacaaauuaaauguaucccagcagcugcuugaaagaccacagcauuggccgggcacggugacucacgcuuguaaucccagcacuuugggaggccgaggcgggcggaucacgaggucaggagaucgagaccacggugaaacccugucucuacuaaaaauacaaaaaauuagcugggcgugauggcgggcgccuguagucccagcuacucggagaggcugaggcaggagaauggcgugaacccgggaggcggagcuugcagugagccgagauugcaccacugcacuccagccugggcgacagagacucugucucaaaaaaaaaaaaaaaaaacacgcauuuugaaugucccuagcauuagggauuauaaaggucccauucuaguagaagauccucagguuuggaguguacuaaaggucaucauccuucgccugcuaauaaauuucugaagucccugcuuuaaacaaacaaucaaaaagaaggaacaguuacagugcugccaaacaaguucuuuuuuuuuuuuugagauggaguuucgcucuuguugccaggcuggagugcaauggcgugaucucggcucaccacaaccuccaccucccagguucaagcaauucugccucagccucccgaguagcugggauuacaggcaugcacuaccacgcccagcuaauuuuguauuuuuuuuaguagagacaggguuucuccauguugaggcuagucucaaacuccugaccucaggugauccgccugccucggccucccaaagugcugggauuacaggcgugagccacggcgcccggccaacaaguucuuacaaaccucuggguuguuacaaacccaucuggugcuaauaaagguaaggcaucaaccccaaucuccaagcugagaauuuuauccucaggacugagcacugcggccugcauucggauguuaguggggcugucagaaccgugucucaugcuguuaaaaguggaaguccuucccacucagacccacggaagccaacucugaugagugggagggugagcagaaggggcuucggucauuuuuuauagauucuucagguaacucuagccaccauauuaagcauuggcucccacaaaaaagcauuaaggcucagaaacaucuuguagggucacacccucccuaaaaacagcacaucccugaagugguggcugggcagccaggcuccaaagcccgcugagcugagcggcagccaagaacaagguuugguguuuacauacucaaaaucagccuggguugucacagcaacucaccucagcacaguucuuccuucuccacggcggcuugcuuccaggcuuugcuguucuccgucaccgucuuaacguuccugcuaaccuggccugcugcauucuuuuuauuuuucucccaauuccuccgccuucuucucauguguuugcuagugugcaauaccucaccuguuuggaacucaacaacguccccuccugcaaaacgcaccugaaaacaagaaauagcacacaaggccucuaaguggccagaacagauguuaccaggccuaaguccauaaggaaagcacccaagccccuugcuuuugucuuaaaucuuuuuuuuuuuacaccuuuaaaauaagguuaugguuucuaaggccugccguaaauuaggaguagggagaggaacuauugccaagcaccccaaaaguucaagaggugacuguugaucccagaguagcaaggaaagggacagacaggcuauaagaaguggacacaagaacucagaacucaggacaguguaggccuuguuagagucaggcagacaauuucacauaccucagaacgucauaaagccaucaugacuuuacucuggaauagauacgauccagacaccuagaaaauguuaaauuagauucaacuuaaagaggcagaguaauaugugugguguuuuuuaauuucgagcauuccaaaugguuaaggguuuucaugcuuaaagagagaaacuuagcuaccuagaacuuauuuaugagugcucuagauaauuaucuacuguuuuauauuuuuuuauuuauaccccguuacuaaaacaaaaguaaaaauaaagcaaaagauugaaggcauugacauuuagucuauauacuuucuaguuccuggcucuaguucuuagcaauauuugcugcuaaccugguguucugucucugccaaauuucugcccaugugaaauauaugagacuugauccuauuuccuugcucauugaucuaccugaaagggucauagaugucuccaccucccuagagcuagugauccuauaucccaucaucucagccagcuagaaaacgaaccaucacaugccaccuccuacccaauuacgugcuucauaaacagaauaccuggcauauagcaggcauuuacuaaacacuuggugaaugaauacaugagccaguaauccauaagauaucuguagaauuaauuacaguugagccuugaacagcgcagguccuaugggaucccaccccuuguacagucaaaaauccucauaaaacuuuuuuuucuuuuuuuuuugagacagaaucuugcucguugcccaagcuggagugcaauggcgugaucucagcucacugccaccuccgccuccuggguucaagcaauucuccugccucagcuucccaaguaggugggauuacaggugccugcaccacgccuaacuaauuuuuguauuuuuaguagagaugggguuucaccauguuggccaggcucgucucaaacuccugaucucaggcgacccacccgccuaagccucccaaaguaggggauuacaggugugagcugccgcacccggccgacagguguaacuuuuuuuuuuuuuuuuuuuuuuuuugagacagagucucacucugucaccaggcuggagugcaguggcucucucugcucacugcaaucucugcucacugcaaccucugccucccagguucaagugauucuccugccucagccuccugaguagcugggauuacaggcacccgccaccacacccagcuaauuuuuuauauuuuugguagagaugggguuucaccauguuggccaguauggucucaaacuccggaucucaagugauccacccaccucagccucccaaagugccuugguuuacaggcgugagccacugcaccagccaguacaguuuuuuguuuuguuuuauuuugguuuuuugagacggaaucucgcucugucgcccaggcuggagugcaguggugccaucucagcucacugcaagcuccgccucccguguucaugccauucuccugccucagccucccuaguagcugggacuauaggcgcccgccaccacacccggcuaauuuuuuuuuuuguauuuuuaguagagacgggguucaccguguuagccaggauagucucgaucuccuguccucaugauccgcccgucucagccucccauagugcugggauuacaggcaugagccaccgcgcccagccuuuuuuuuuuuuuuuuuuuuaauguaugggggaaaaaugacuagaaggacagaaaccaacauauaacaugauugugugcauuuacuuauuuaacaaauaauugagcaauuuauuucuguaugauacuauucuaagcguuuuagaguuaagcaaacucacaguaaacuguauugcccaugauaaaaacugcaguuacauaauuuaaaagcaagaaucgcagcaauucaucaggcacagugacucacgccuguaaucccaacacuuugggaggccaaggcaggaagauuccuugagcccaggaggucaaggccagccugggcaacauagugagaacucauguccacaaaaauuacaaaauagccaggcaugguggcaagcaccuguggucccagcuacucaagaggcugaaguuggaggaucacuugagcccaggaggucaaggcugcagugagcgaugaucgugccacugcacuccagccugggugacagagcaagagacccugucucaaaauaaauaaaaauaaaagcaagaauugcagaaaguauaaaccaugaccaacucaagagaauaaucaaugaaagaauaggcagaaugucuuuccaaaaagcaguugagagauccccauccuccacauaugcacuagugcaguggggauguugccaggcauggccgccagaccucuagauagaacacugaaggugagucugcaguaaagccauggaaugugcuaauuuuaguuuaggaauaccaaauuuuauugaccguuuuuaauucaauaagcaacccuuggccauguauaaucaguucaugacccaucagaagauccucugugguucacucauggccuuuggacuauacucugaaucauggcuuuagaagacauuuuuuuaguauacuuaaauggauuuuauaacuugguugaugcccagauuacagacugugaggaguaucuccacauaacuuguaacugcuauauaugcagucagcaauuccaguauuuagccugauauuaauuuauauuuuuccucauaaucugauaauacagugcuagcaagauagaucacaaaguguaaaugaguguuucuggagcauagauggguacgcucaaaucuuuguaucuuguuuuuuaauagagacgggguuucgcuauguugcucaggcuggugucgaacuccucggcucaagcaauccccuugccucagccucccagagugcugggauuauacaugggagccaccaugccuagcuuccuuguaucauuuuuuaaaauucaaguaagagaaaaugucuggcaauaguucauaagcuauaaaugaaaccuagucuuaggacccagcuuuauauugccucaaucaaauauuaauaucuuuaguucaaaauuuguauuuacaaaaaacuuuugguucuuggggauaccguuauugccuucucuguugccauccauauaauguauguuguuuuuuuuuucucucucccucugggcugcguuucaugccagauaaacuuccaaaccaaacugggauggcaccaggcacaaauaacacucuucuuaucuuuucccccaucuagguuaccccuuugcuuuguuuuaucggcauuaccuuuucuacaaggagaccuaccucauccaccucuuccauaccuuuacaggccucucaauugcuuauuuuaacuuuggugaguaaacuaaauuagcagugacaccgcaauuagugggaaccuggaaggaacagacuugaacaaaauuuccuugagagaaucuaauagguagggaaguuauaaugcucccacuugcaaagaggguuguaugaagaggaacacagcuuaacuuuuccuuuuuuucuuuuauguacauucuucugucagauaaaaacauuuugagggugguuacccuugccauaccucaucaacaaagaauccucaguuucucugugcuguggauguaacugaaugaccgagccaagcaguccccacuuagauucauucuucacuucagacauucaaaaauacaguaacaagcugggugugguagcccggaauucaaggcugcagugagcuaugauugagcuacugcacucaagucuggacaacagagcaagucgcaucucuaaaaaaacaaacaaaaaaagaaaagaaauaaaauaacacccuaauaaucuuuuuuauuuuaauaaauaauuuccauccucuccuccaaaacaugagguuauucugaaaaaaaagauccugaugccaacauuuuuucuuuauauauuacguugugauuggaagucucaggacggugggaguguaaaaaccaggcuaaauucucucuucuugcauccaggaaaccagcucuaccacucccugcuguguauugugcuucaguuccucauccuucgacuaaugggccgcaccaucacugccguccucacuaccuuuugcuuccagaugguaaacgucuuucccuuagcagcucaggcuacagcugacagcgguucaggggacagggguaggcaggggacugugguauagaaauuagcagaccuaauuucuaaccccucucccagcacuuagcaguaugacuucagguagguggcuuaucacaggcccaaguguuccauccacagauuguaaugguaacucuuugccugccucaaggaagggccaccagcuaacccuuugcauacugugccauuaggcucuuugguuuaacccacuauccaggagcagagucacuucaaggcaagacagaaaagcaacuuagaaugaguuaaagaaccuaagccuaggccaggcaaaguggcucacaccuguaaucccagcaccuugggaggccaaggcagucagauugcuugagcccaggaguuugagacuaacccgggcaacauggugaaaccccaucucuacaaaaaaaauacaaaaauuagcccuccagccugggcaacauggugaaacaaaaaaaauuaaaaauuagccgggugggguggcaugcaccuguggucccagcaucuaaauucucaucucaguuuagcccucauuuugccaagaagccuugagcaacgcucuucccauuacagguuuucagcaccuccauuuguaggaauuuauuaaggcuuuuaaugaugggaugaggagaaaggaaaaaggaaagagaacauugaauuucagagcaaggagaagaaauaguagugaugcuagaauaaauacuucugccucuccuaggccuaccuucuggcuggauacuauuacacugccaccggcaacuacgauaucaaguggacaaugccacauuguguucugacuuugaagcugauuggugagugauggucacugccugccuuccuuacauguaggucccucccccaucucacuaaaaacuuccucggcacccccccuccgccccccgccauacacuucuggcugcacucagucuacaggccacauccucaguguccucucccaccacccuacccauccguucucucucugcucagguuuggcuguugacuacuuugacggagggaaagaucagguaaguacccauucaucggcagagagguucaagacuuaaugaaagggaagaaaaaaguuguuaacaaaagacugaacccaaauuccagagcggagcucucccucauuccccagccugugcaaucucccuuucagauagcacugagcaaggaucaacaaaucuaauuugcccaggauccagcucuugcacaaaguccagagaucaaugccagcaaggcauuugcuaaagcagcaacagccagcuaugcacacacauacgcauuuccacaagaagcaacuauuugucaucccccaaagagaaggcuauuugaagaaccccagucaguggggcacacagguggggaacacucaaaguggcucuuguggggagauucaaggcuauccugaaccaugcauucucuucuuggcauagaauuccuuguccucugagcaacagaaauaugccauacgugguguuccuucccugcuggaaguugcugguuucuccuacuucuauggggccuucuugguagggccccaguucucaaugaaucacuacaugaagcuggugcagggagagcugauugacauaccaggaaagauaccaaacagguaauugccccucuugguccagauguuuguguagguauuucacucacucugaagugacucuucugaaagcugcauucuccagcaugacccuggcauagagaccugagucaugcaggcccuggacuguuguaacaggcacucugugccaggagugggcccuuuuuaguuuaggguucuuccaguuauccauucuaacacuaguacaaacauaaaaauccacauuuaugccacaggauuuugccugaaccagucacauuucugccuuuaaagccuauuuucauguauauaugaaauauauuuaugauugauagguagguaggcagguugauagguagguagguagauagaggcugggcacagugguuucaccucuauaaucccagcacuuugggaggccgaggugggaggaucacuugagcccgugaguucuagaccagccuggcaacauagagagacucugucucuacaaaaaaauacaaaaauuaucagacauaguggcaugcaucuguaguccaagcuacauaggaggcugaagugggagaauugcuugaguccaggggaggugggucaaggcugcagugagcuuugaucacaccacugcacuccauucugggcaacauagcaaaauccugucucaaaaauauuuaucaguaggaaaugcaggagggcacaguggcucaugccuguaaugccaacgcucugggaggccaaggcaggaggaucacuggaggccaggaguucaagaccagccugggcaacauagugagaccccaucucuacaaaaaaaaauuauccaggcaaggugguacaugccuauagucccagcuacucagguggccaaggcaaggggaucgcuugagcccaggaguucaaggccacagcgagcaaugacuaugccucuguacucuagccggaguggcagagcaaggcccugacucuagaaaauaaaaauuaaaaugguaaaaaaaaaaaaaaaaaaaaaguuuaauugccagaagaauuccuucacugagaacuuguccauccuguguuucagcaucaauucaaccaagaaaugaaggagcagauucaaagugguuauuuuuauuaucuuaccuccacuggguuuucagucccaauggagauugugagaccuggcaagaccuugagaucaguagcaucccugagggguaaacacaagacugguccacugucugcugcccugacuuuccuacaacucuuaagagguuugcaguccccauuccucauagccagccauagaaaucuuucccugaaacaggaaacacuuugggcagcagagcuucucaucccauuccagguagacaaccacaccccuaaacacuccucuccauaacugaaggucagagggugaagggaauagucucugcucucugugaccaggaacuucacucguuccuuuccagcaucauuccugcucucaagcgccugagucugggccuuuucuaccuagugggcuacacacugcucagcccccacaucacagaagacuaucuccucacugaagacuaugacgugagugucuacuaaagcagcagcagcaugacugcaccagagcuagaaaauggacaggcaaggaucccuacagauagcagagaaguaggaaauaucaucuacaagugcauguugguuuugcucuagaucugugaguugucaaugccagccgugcugggacauguucaucagccagcacugaacaaccuucgcgggcacagggcugugccaggugcacauuuagcacccguugccuucucuaggagccgcuccuagcuugccuuaucacauccacgugaccccucagagcacagcagcuucugauucuccauccuauuuucuucucuugacugauacauuugggcacuucuagggaauucagaaaccaagggaaggggggaagugcuggcuuuugcuccugcccagcugaaaggcuugaaaacaguucaguaauucugggcagguuucucuccuuaaauuaaaauccaauaugggccccucuguacuuaacauuccaaaugcucauuccaaacacuuugccaacgaaggcaaacaguagagaaguuaaauacagugcugcccuugaggcucuccaagggaaaggcgaaugaauauucuccaggcccucugcuuauuccucucugccuauugugaaggcaaucaggccagacuauugagggcaucuggcagcaggacucaggcagguaugaaguagccagccacaagugugaaaaggaagagugcugagagaaacugccuagucaugugauaucccuaaugcacugugcuuucuucccucaagaaccaccccuucugguuccgcugcauguacaugcugaucuggggcaaguuugugcuguacaaauaugucaccuguuggcuggucacaguaaguagaaaaguugaaacaagguccuauuuagacaagccaugggggccaguauggggaguggcaagagcccuaacugagcuauucccucucaggaaggaguaugcauuuugacgggccugggcuucaauggcuuugaagaaaagggcaaggcaaagugggaugccugugccaacaugaagguguggcucuuugaaacaaacccccgcuucacuggcaccauugccucauucaacaucaacaccaacgccuggguggcccggugagcugcugguggggagccuggacccugguuccuuccuuccacugucuucccagauuggagggcagggguguaccaugucaccccuaugcgucuuucccaucugggcagaacccccugucgcucacacugacuuugacccccaccuauaccccccucccaaaaaaaccauuacugucauauuugaaaaaaaggcaagauauaaaagugcguuaagaccuggguguuacuccagcucugccaauggacuuauguccuccacugcccuguuuaucaacagcuuuacuuguuuguccccaccacuagagugugggcagcuugaguagagugucugguucaccacugaucucagcaucagccucagucacugcugcugaaccaaguggcucgugcgcacacggucuccagcuccgccuugggucugcuuuccaucucuaaaaguaaucagucagcacugccuccuguacccucugggggcuacacgugggaacccaccagcacuccaauccaauccucagggugaggacccagaggcagguggcgggaugcaaggaccagucaguuugagggucgccccacccacccuuuucuccagcuacaucuucaaacgacucaaguuccuuggaaauaaagaacucucucagggucucucguugcuauuccuggcccucuggcacggccugcacucaggauaccuggucugcuuccagauggaauuccucauuguuauuguggaaagacagguaggccuccagggugggggugaaggggaauauaagggacaagaugcugaugagcuccuccucccuccccaggcugccaggcucauucaagagagccccacccugagcaagcuggccgccauuacuguccuccagcccuucuacuauuuggugcaacagaccauccacuggcucuucauggguuacuccaugacugccuucugccucuucacgugggacaaauggcuuaaggcaagugaaggccugcuugugagacugggagggacucacugcaaccucaaagguugcaaaggacacuccaggccugucuaccuuaguggccucucucuccacagguguauaaauccaucuauuuccuuggccacaucuucuuccugagccuacuauucauauugccuuauauucacaaagcaauggugccaaggaaagagaaguuaaagaagauggaauaauccauuucccugguaaguuaauacagcuaaacuaaaacuaccaccagguuacagaauagagcaacagacuggaaaaaaacaauaguauuagaaaucuggggugaauuccaaggauuagccuggcuacuaaggaacacaguaugggcaaugacuacugugacuuauugaggcaugcuaggaaacaucuggaagggcuauagaccaggaauuacaggaguaacuaaccagccuuccaaacuccucuugucuugcagguggccugugcgggacuggugcagaaacuacucgucucccuuuucacagcacuccuuugccccagagcagagaauggaaaagccagggagguggaagaucgaugcuuccagcugugccucugcugccagccaagucuucauuuggggccaaaggggaaacuuuuuuuuggagaaggcgucuugcuuugucacccacgcuggaaugcaguggcgggaucucagcucaccgcaaccuccaccuccuggguucaagugauuuuccugccucagccucccaaguagcugggaauacaggcacgccaccaugcccagcuaauuuuuguauuuucaguagaaacgggauuucaccacguuggccaggcuggucucgaacuccugaccgcaagugauccacccgccuccgccucccaaagugcugggauuacaggcgugagccaccgugcccggcccaaaggggaaacucuugugggaggagcagaggggcucacaucuccccucugauucccccaugcacauugccuuaucucuccccaucuagccaggaaucuauuguguuuuucuucugccaauuuacuaugauuguguaugugccgcuaccaccaccccccccauggggggguggagaggggugcaaggcccugccugcuccacuuuuucuaccuuggaacuguauuagauaaaaucacuucuguuuguucaguuuuuca

SEQ ID NO: 191696 - RNA, 23096 nt, Homo sapiens
acucccggaagugacucggcuucugcacgccccucuuucuccauuagcgcccccccuacauugcuauuucccucccuccccccuuuucguuuccggcgcucccgccuucucuccgcagagcucuucucugagccuguuggggggagggaggggggcguggaggaacugggguucgcgggagcacgagcugcagcaccacuuccgggugagugcaaggggagggcagcaaggagggggggccacccacuaccucgcgcccccgcccugcgggugucucgcgcgcguuccgugcgugugagugugugggucugucucgcuccagaagugcgugcccgcgcgcugcgccuugcgcuuuuuccccucccucgccccuuccugguccucccacccuccucggcucccuccuuucccagcaaacgccgccccucccgcgcccuggcucaggcucuggcgccgccgcagccgucgccgcccggugagucucgcgccgcuacagccggcgcgcgccaagcugcuugcuccuccccccuccccuuuuccuugggcaggcggggaaggggggguccacgaugugacuguguguguguccgucccggaaccggaagugguuguggaggagcgggcgaugggaaggaauggggggguuuagggggcgggugccugucugguggguggcagaguucagcucccuggaggggaaggagggacgucccaaggaagggucuuugagaaagggguaggggacgacaucaggagaaggcucccaggaacugucucaggggagcgaagguuuugaggggacagcuggggucuccaguagauagaccacggugcaggcugagggagguacuucuuggcacaaggccucggguaggcagggggcgaaguccucgaagaaguggggggaaggcuagaggaaguggcugggccugaacuggcacugugccugccacaaggucuugugcaucccccagcccucagcuuugccuucugaagccacuccucaggggcacagacccuccuccuccuccaucucuaauguucucugaccccugguuaccuguggccugggaacgaacaaggaccagucucugagccuaggagugaaacccaaacgcuggugauagaauucgucuuaguuucugggaauuggauuuauuucucuuguauccacguagaggguagcacuagacugcuguuauuauauccacccgucuuuggauugcuggcuggggggucugccugccuuccagacugacugcugacaaauaauuccugagguucuccacaguucucugguggcugcacccugccuggccccuguaaccuagacaauuuguuuacagaaaguucaggagcccuggaaaggagaaggaauaagacggcaggaggaagagagagagaggguaagaugauuuuuggguuaauggcuuuucugguuuugggggagaaggggucacaaccaaauggggcguguguguguuucacaaugugauagaauacuuaaaguaauagcaauuguaaugcugagauuguuguggagagaaaucaguuuuuuucuauuaucucuugagggucaggaaguuuuuguguaaaaaguuggcgcuaucccccaucacuuuccauuccuacuaaugcucaucaggaaugaaauaugaaaugcucaggugaagccacugaauaguguugccuuguguccaaaggggaaaucuuuauucugcuuugggacacaaagacccuaaaugccaauauaguccuuauggaauugcuuuccugugucuggaacaagcagagcugaguuuagaauggaguuccuaucccaaauaguccaguggaguguuagaagugggucuguggagugauuagaaucugugacacaggguuauuugaauuugguauggcaagaugaaauuuucaggggaaaaaaaaaacugcuucaugguuagucuggagugaaguggauaaaacuguacggaguagacuccagaaguaggucuggaagaguuucggguagccugaaaaugacagugaguggaccuaaagaguuugaguucagaacuuaugaucccagagguugguuuauaaaaugcccuguggguuucugagccaaguuguugauuaaauauuggguacauaucucuucuucuccagucuuauuuauuuauuuuggccucacauuccccagauccaucauuuauaguggaacagacagggcaaggagaaccaccgugccgucccucccacaggaugcaggguaaagugguccgguggugcccaggcuagaagcuguuggcccagguugccagcuguguggugguagcaguccuguuuaguuuguuuguguauggugugaugauguuucccaguaacauuggggugcauuuguucugaguuacuuguacuuggaagaguuuauggauacuggcgggaaagcgucacauccuacugggauggcccuucuugaaugucuuuagacccugagagaaagagauuuuguuuccuuuuggagaaacaaaaaaaacuuucucuguguuucuucauuucaagucuugagcuaagguaaccuuucugcaguuguguguuuuggaaugguuucucaauagcgucuuaaguucuuucuguaguugaauucaaguugauuguuuuuuuccaucuuuuucuuguugaugcuacuuguagaugauuucuaaaccggaggcuauagauuuguuacuuuuggguaguuccuuuguaauuauguaguccuuauguaauuuucacuaauugucgcuaauaguccucaucuuguggaaguguuucuguaacucuucuuuucaggagcacuuggggcauuucauucuuucucuuuuuugugcugccuuuaucucaucaccauaugccuuacaaacuuauuuauacaggccucauccucuuccauccuccauccugauagaaaccuaguaaaaugguuaauucauccacuuaaauaguuaagagucauccacugauauaggaccuagaauuagaauucacaagucuuggccgggcacgguggcuuacgccuguaaucucagcacuuugggaggcugaggagagcggaucaccugaggucagaaguucaagaccagccuggccaacauagcaaaaucccgucucuacuagaaauacaaaaauuauccagauguguuggcaagcgccuguaaucccagcuacuugggaggcugaggcaggagaauugcuugaacccaggagguggagguugcagugagcugagaucacgccauuacacuucagccugggcaacaaaaugagacucugucucauaaaaaaagaauucagaagucuugauucccaaggccauucucuagcuacugaacuugaugaguguauuucaugguuuucuaaggguugguuguguuaagggaaugcuguuuucuuggggaaagaaaaucaugcuuuauuugaaaaaacaacaguaaaaaaacaauuaguggguucugggaaagagaugguggucuucaccauaucugccaaaaacaccugcuggaggccaugucaucuuuaucccuggaugguugguagcauuacggaaggauguggucagauagacaaagcucugggccaagaguucaaguccuaccguguuucacgacuauuauuaauacuugauagugucucucuucuuuaucuccugagggcuucugagauuugagauuggagaaggaauauguaguuccuugugucucuuaagagaaaauuacucuccaacuuaauuagaguaaaccugccuucuuuuuuuuuuuuuuuuuuuuuuuuugagacugagucucgcucugucgcccaggcuggagugcaguggucugaucuccuuucacugcaaccuccacuccaccucccagguucaggcaauucccugucucagccuccugaguaguugggauuacaggcgcaugccaccaugcccagcuaauuuuuuguauuuuaguagagaugggauuucaccauguugcccaggcuggucuugaacuccuaagcucaggcaguccaccugccucggccucccaaagugcuaggauuacaggugugagccaccucgcccagcaguaaaccucccuuccuauuaacagaacaguugaggcuuggugcaauaguaaaguugauaugagaacccagauuuucagccugccagcauuuuucuuuccaccaaauuauaucuuuccuucucuucuguuuuuucuuuccuuucuauuucuuuuucuuuuuuucuuuuugagacagggucucacucuuuuggccagacuggagugcaguggcgugauaauggcugacugcagccucgacuuccugggcucaagcaauccuccugccucagccucccaaguaacugggacuacaggugugagccaccaugcccggcuacuuuuuuaauuuuuuguagauacagggucucccuauuuugcccagauuguucuugaauuccugggcucaagugauucucuuacuuuggccucccaaaguacuuucuuuaaauauauaggcauaaucauuaaaauuggcacucucuguguagacaugaguuuucuguguaacaucagugggcuucuuugggugauaagaauguugauaugugccugauugaauguugggaugauuuggagaaauuuccuccacgaaagauagaguaagcgguaaaacagacaguaagcagauauuugagugaucuggccccagaacgcccuguuacacaacucuagggggcgccauuuacauuguauucuagcaauaguuuugauucuuagcucuccauugaucucauuucaggaguacaaagaugaagucagccucaucaguagcacaguggcauagcauuucucaggugucauuuugcugguaaagguugcuuauaguuggaugagcaguucucucuguggucucccuuuugggcugaccuauuuaucggaagcugguaacgcauauguagugucuuguccuuggaccagacacaccaguuuauuggaugcaauaaacuaggcauccaaguaaguggaggggcuuuuuauuuauuuuccuuuguaaaguccggccucuuuauucaggcucugucauccuaaaguaaguuaucuugguagcuaagugagguuucacagaauaaggaauaugaccuugaacugcaugucauuuugcuguuaucaaaaacuucaauuuugaaaacauuuuuugagaacuagcuggaaaauaguucauuccuggaaauauucuaaauuuuauuuccuggaucaagccauaacaucagaaaguguguacuacaguuauaugguuuugguuccuuguagaaccccuuuccuuaacuugcccuuuggugccuggauucacauuccugcuuugcuauuuacuguuggacucugugccuccaguuuccucauuucaaaugggaauuacaguaccuaccucauuguugcagggacuaaaugauguaguaguuguaaagugcuuagaacacuaccuugaacacaauaagugcuuaauaaguuuuaaugauaaugauaguggugauauuguccaccaguuuuuuuuuuugagacggauucucacucuguugcccaggcucgagugcaguggugcgaucuuggcacacugcaaccuccaccucccagguucaggugauucuccuuucucagccuccugaauagcugggacuacaggcgugcgccaccaugccuggcuaauauuuguacuuucaguagagacaagguuucaccaucuuggccagacuggucuugaacuucugaccuugugauccaccugccuuggccucccaaagugcugggauugcaggcaugagccaccgugcucagccuccuccuuccuacguuuucacauccauagugcauuuacuuuacuuccuugauucuuuuuuuuuuuuuuuuuuuuugagacagggucuugcucugucacccaggcuggacugugguggugcaaucucgacuuacugcacucaggugauucuccugccucagccucccaaguagcugggacuacaggugugugccaccacaccuugcuaauuuuuguauuuuuauuagagaugggguuuugccguguuggccagggugaucuugaacuccugagcucaagugacccaccuaccucgcccucccaaaguguuaggauuacaggcaugagccaccacacccagccaacuuccuugauucuuuugggaaaauuauacauuggcccuuucuuucguuuauucucccuccuaauuauuauuuuuaaucuuuuuuauuuuauuuuauuuuuuuuuugagacagucuugcucuguugcccaggcugcagugcagugguuagaucucggcucgcugcaaccuccaccuccuggguucaagcaauucuccugccgcagccuccugaguagcugggauuacaggcgugugccaccaugccuggcuaauuuuuguauuuuuaguagagaugggguuucaccauguugaccaggcuggucucaaaguccugaccucaagugauccaccugccucagccucccaaagugcaggaauuacaggcaugagccaccacacccauucucuccaucuuaauucucuacuuaauucccaccauuuaucaccacucuuaucucuugucugucauuucuuuccacuagaagguuagacagggauuaugcauugagacuugaaccccuagcauugucugcaaaaucuauauguagguagucuaccguuguucaauucauuaaauauguaauugugucuuaggugauaaagucguauguuggggauauuuguaagauacagauguaaaagaugugauugcuccuucccaaaaaguuuggcaagauugaauucucuuaaacugugaucugauuguaucuugauucuguugccugaaaacgugagacucccaucuuugcuuuguuuuguuuuuuguuuguuuuugagacaggguuucucucuguuacccagacuggacugcaaucucuacugacuucagccucugccucucgggcuuaaaugauucuccugccuuagccucccaaguagcugggauuacaugcaccugccaccaugccuggcaaauguuuguauuuuuuguagagauaggguuucaccauguugccuaugcugguggacucaagcaaucuguccaccucagccucucaaagcgcugggauuacacacaugagccaccgcaacuugcauguuuuguuuuguuuuguuuuguuuuguuuuguuuuguuuuguuuuguuuuguuuuggaguuggggucuugcucuguuacccagguuagaguacaguaguguguucauagcucacugcagucuugaacuccugggcucaagcaguuuucccaccucagccuuccaaauaccuaggauuauggguaugcacgaccgcacucaccucuuuuuuuuucuuuuucuuuuuuuuuuuucaauuuuuuuuuuuuuagagacacggucucaaauauauugcuuagccuggucucaaacuccagaccucaagugauccuccugcguaggccugccaaaguguugagauuacaagcaugagccaccacacucagccguaagaccccuuuguaaagcuauggcuggaaggaccaaguuaguaccuguaucagauacugauuaguuuuauuguguuuuauaacucagaaaacagaauugauguauacuugaucuuuggucauuuaauagcgagccuguuuaugugaagcuguuguagucacagauuugguacauugcacccucgcuacuuuuuaaaaaggcugaaauacaguuuuucccuuuauagauuuuaugaaaauugggggugcuguuuaauagaacaaaaaaagugauguuuucuauaaaaggauaaggaacagaguuauguuagaguaauuuucagcuucggcgccuuuguugaagauccuucccuguuuccuuaguacuuaaaacugaguuucugugcccagccuacccuuuagcucucaguaucuuaguguuugccuccaguguauccucagugggucaacuugccugucacgggucuuccccaccugaaccuugguugugcuuugcucagaguagcagccugguaauacuguguauuuauguacuuuuuuuguuacucguuuccccauuucaccagucucacacucucuuauuugccuuuuguggggcucuaucuuugcugguccaggauuuugggaagcuacucuugaccaacauacugccaauuaaaccuugccaggagaagugaucagaaugugaaacuggguggugggaugccuguguucuguacccaucuguuauuuguuggcaugauucggagggguuacuuuucuucuuguuucucagaaaguuuuuuuuuuuuuuuuuugagauggcguuucacucuuguugcccaggcaauggcgcaaucuuggcucacugcaaccuccgccuccuggguucaagcaauucucuugccucagccucccaaguagcugggauuacaggcaugcgccaccaugccccggcuaauuucuuguacuuuuaguagagaugggguuucaccauguuggccaggcuggucucgagcuccugaccucaggggauccgccugucuuggccucccaaagugcuaggauuacaggcgugagcuaccaugcccagccggaagcacaguuuuugagaaauaggaagcaggagucuggcacuguguguguauucuggccuacuaucaugccuauucugcaucccuuuggaaaccuggguuacuacuagugccaggacacuuucuaaaacuagaagugcuuugauucucacugcucagcgcggcauguguggugcccaguguagcaccguggguguucuuagaccuuggugggauuggugggguguggucuucagauaguaguugguacucaaaauauguuuugauucugauuuuuuuuuuuuuuuugagacggaauuuugcucuuguuccgcaggcuagagugcaguggcgcgaucucagcuuacugaaaccuccgccucccgguucaagcaguucuccugccucagccucccaaauagcugggaucacaggcaugugccaccacgcccagcuaauuuuguauuuuuaguagagaugggguuucaccauguuggucagccuggucucgaacuucugaggucaaaugauccaccugccucagccucccaaagugcugggauuacaggugugagccaccaugcccagucuucauuuuuuaauuuucuuagucguauuguguucuggccuggaaccuucucaaacuacacagaacuguagacauauugguuggaacucuugaaauuuuuauuggcugggcacagugguucacgccuguaaucccagcacuuugggagacuaaggugggcugaucccuugagccuaggaguucaagaccagccugggcaacauggaaaaaccgugucucuacuuuaaagaaaaaagaaauuagucuggcauagugucacacggccuguaggccuagcucccugggaggcugagccuggaagauugaggcugcagugagcuaugauugugccacugcaguguagccugggugacagaguaagacccugucucaaaaacagaaaaacuaaaauuucuauuucaaggaauauaguuuugaagaauaagagaaagaggagucaugcuagguacuggcaccuggccguuuucaagucagucagugauuuguuuuuugugaccuuagcuacaucaucuccccucucgugagcucaguuucuuuuugccagcaaaggaaaguaauaccaguuuuucuuuagggggcaugaauaacauugugugaguaaaugugauacguauaaguucuuucacagucaugaaguaggauagccucuguuggauggggauacagugacaaggggcucugaccaagggacuaaugugcuagacacuaagucuugacugccaguccccagccaugugaucaggugccagaggagaccaggaacucuucaguuccccuucuccauugcuuagcuuuuucugaguaauuccugagugugacauguucucucauuuuuucuucagguagaauggaagaaucucacuucaauucuaacccguacuucuggccuucuauccccacagucucaggucagguaagugguguugcuuucuugcucucuccaagucucaguaguaaguucuguuacuauggagacugaagguacaccacaugcuguuuuacugggucccccaccccugagaauuaucuaguguuucugccugggcuucucucuagaaggccagagguaugaagugcucauccuugaucccuaaggaggacagacacugaagugugcucacgagcaagcagaaucagccucucaggcugaagagggugcucccguccccuuccuuuucucuuagaucgagaacacaauguucaucaacaagaugaaggaucagcuguugccagagaagggcuguggucuggccccaccucacuaccccaccuugcugacagugccugccucagugucccugcccucaggcaucaguauggacacagaguccaagucagaccagcugaccccacacagccaagcguccguuacccagaauaucacgguggucccugugccgucuacaggacugaugacugcuggugagcaacucugcucuucuccaaucugagguguugaucuuccaugaucaguaccccaggcuggagggcuccaaggacauggggagugggauauguguuugauuauucaaucaaauuuuuauuaagugccuacugugugccuagcaaugugcuaggcauugugggggauacaaagaaguagaagaugcggucccugccuuugaggaggugacauucuuuccuucucugaaucaaggagucuccuguucucagagguggagaagagaagggagucaaucaagggguaaaucucacuguuaccagggggguggggacaaggguuaggagaccauuauuuuucuacaggguuugggauuuccuguguacucuggguugggucggcgggggggugagggguuaauuagacaaugaucugggggaaaugaaauaggauuaggaucaggacugaacaacaugacgccaucuccuuuuucucccaauccuagguccggguuugguaaucacgucccccucaggcucucuugugaccacagcaucaucagcucagaccuuccccauuucggcucccaugauugucucagcucuucccccuggcucacaagcccugcagguugucccugaccucuccaagaagguagcaucgacccuaaccgaggaaggaggcggagguggugguggagguggcaguguggcuccuaagccaccccggggccggaagaagaagcggaugcuggaaucagggcugcccgagaugaaugacccuuauguccucuccccugaggaugaugaugaccaucagaaagacggcaagaccuacagguaagacucagagccaggggcaggauggggcgaggaucccuggcuuggugauucucccuguacccucauuguguucugccccggucaggcgcuacacucugacagcuucccagcucugagccacuugcaugucaggugucccaucauaggauaggaggcagagcugcuagcaucguguuaggaugcaaagacccauuucacccuuuccuuuuuuuaacccuuguuuugggggucguuaacacugacuaauuuuuuaguaacagaguagaauuucucucuuguaauaaggcuuuaugcuggguuugagacucuuggcugcagcuccuuuuugcuuucuacauauuccauuccuauuuuucuaagaaaccuuucuaguaagcaccuaaccuaugugccauccaccaguuccugggucgcauuugaacacugagccugccuuacccugcaugguugggaugaugggaggggccuucauaagaagguaggaggaauaggaugccucccccuuuggaauauguacuuaaagaaugacuuugcucacuuucuaauuuaugaaagucauuuugauucuccacuuccucuaaguuccccuuuaccaaaaagcauuauaugcguauuugcaugugauacucuacaaaaauaauuacauaaguaaacucccugcccuuugaaaguugaacaucuuuuaaucccuuugagaacugucacgugcccuaguggguuuggggaguuugguagcacuguauagagugggauaacuacugucacagcuuugauauagacaggggcagaugugcauggcugggagucugggucuguccuuaguuccuuaguguacccagaugggcaauguuguucccauuuuaggagcgaagggaacugcggcacaggaaauggacagagccuugggcucauggauucaguucccggcuccaccacgaauuugcugugugacccugggcaaguccuuuuccccucucugggccucaguuuccucaucuguaaaauggggauaauucuguuuaugccucccguuuguugggaguauauaucagauaagauuugaaauguugggaacuucaaaagaaaguuaagaaauuaguuauuuagcauuuauuuuuauuuguguuguauaguucuacuauggagaguagccuacagaguguuuaaaccgcucuuuauaaaugaaaaugagaggaguguugcuaugcagaauugagcacugcagaauuccagcucauaauccaaaaguucauugcagcuuuauuauuacagguguaccccacuuuauacaauaaaaguguuccuggaaaauguuuccaucauaucauauuauaaagguaccugacaaguuugauucauuuaaaggcauucucuuauauaucaguucauaaaauuaaaaucccuuuuaaguuaucguauagaaaucuagauuuuuauguguuuguuuaaaaugaggccauugugagauggagauacaucuauauacaauuuguggaaguaguagaaggauccuuuaacacucuauagagcccuucuaauggaucaggguccucucauucugcccuuucuucacugugacccacauuaaagcuaucucuggacuuuccaaacuguauauauuaaaagaaaugcacauauacaguuggaagaaagccucauggggcuuuucacacauucaguauuuuuggaauuccugaaugaccauccacccaggagacuacaaagaacuuugaaauugaagggagacuuauuguauccuagguaaacagaauuucuucagaaacucagaacucuugacauuccaaagaaauuuuuuuuuuuuugagacggagucucgcucugucgcccaggcuggugugcaguggcacaaucucaacucacucuuaacuucugccacccagguucaagcgauucucgugccucagccucccgaguagcugggacuauaggugcgccaccacgcccagcuaauucuuuuguauuuuuaguagagacaggguuucaccacguuggccaggcuggucucgaacuccugaccucaggugaucugccugccucggccucccagagugcugggauuacaggugugagccacugugccuggcaaaagaaaucuuuuuaucacagugaauuucuguuuugaugcaugugugggucagccauacccucuucaguggucaguagcauuugacuggcuauuggggcaguuggguucuguuacucuggucaagucaacguaucucccacucuuuguucccauauauaaaaugggaagaucagccaugccuucaucugucuuguagaaauguuuugaggcaaagucagaauauuugaaauuguuuugagcauuuuaggaaaaauggauaauaauucaaaguggccauacuuguaauuauuauaaucaaggccauugcauugcaugcuuccaaggggucccguucucauuguguuggaugugaauggugccccuggaggaaggcaccccaugauauggaugcuggcuuuucuauccccugcugacugccacgacucuccaaaacuaaauuucuuuccaaccacccagcaccuugcauuagaggacucucuuacuugacuucauaggauuuucaaguuggaaauauuuuaaugaucuccuuggucagucccuuccuggcagaugauuccaaccucugcuugaauaccucugguguuaagaaucuuaaaguaggcuggcaucauggcuuuguagugaauaacugcccuuuggcaaauuacuuacuuucugagucuuuguguuccuuucuguaaaaacauggauaagacuugccagguugugaggaguagaaacaaugugucugaagugccuaaccuagugccuggcacugucaggcauaacaacaaauggcaacuauuaucauuguggucaucaucauuauuauaccuagugucuucugagauugcucauucccuugccagcacauuauaaaugaauuuaaguuuugcaaguucucuuauuggaaacuuugacuaaguggguuauuauuauuuuuuaaaauuaaccuuaauguuaagggcagaauuguguauugaacacccucacacacaaauugacgagauuuuauuuggguuaaaauaaauauguucuaccugucugagaaauuguagcaucaagggaaauuaguuugcaacuuuaguacaguugcccuucaagggacaauguguccagcuucuaacuucagucuuagugaaauauuuacuagcaugagcuuguccaucagcacuaaggcuuaagaugaaugcaguuuuauuacuggagaauacuuggcuuaccuuugacuguccuaggcauuugcucgcccuucugggggcaaaaauuuaucuuuccauuuuacagaccagaaaauugaggucuguuaaugagcaaguuuguaacugaagccugaguagaacccaggcauccugauucccacugguuguguccuuuggauuaugcucacuauaaacagagccucccccucucuccugcaaugauugggcaucucagacaacugccagggaucaauaagcugguaacuaaaaaauucuccugagaugaaaaaagugcagaaaucaugaucccacaccaucugaagccucucuuaagaagauaaguuagggagaacccaaagaagagggacuugugcuaauugccuggcuuccaggccauugccuuuucuaccagcucccauuuuacacuggugaauuguuuacgaaaaugaaagauagcuuuuacucaguaaagucugaauaguuguggcuuaacuugcucagaggccuccuuauugauauuugguggacaauaccagaguggaaaggauuaccagcuugggaugagugaaaguacgaucaggugcuacugaugucaacccagagugcugacacuggcuccaugugcuagggaagaggaaagguuuagcguggaagauagguguuuuguaaucauuuuucucccaaaugcuugagggauggcaccuuccccuagcagcuacguuggucauugcaaaagugguuuucacuugauugucaaggggcugugggcaagggguggguagaugauggaugcaacaucagauaagaggguggagagcagacauaccugguuugaaaaagccccuccaaauaauucugauacuuccucacccccaucccucuaggaaucgcugccaaaaaggaaguaggggaaaaucugagggaagaaaauuaucuauggagacaggagaggauccaguuaguuguuccucauuaucaucucggggucuugaggaauacagaggcaugugcuucauacauaggaacaucagagcaaggaauuccuuaaauguuugaaaucaagcuguaagcagaaggcaaacaaguuaacugauauuccuggcccauugaaauucgcaucugcccagaguucauacuguuucuguuuuaucugguugaaauacauuuuugcacauggaggcaguccagucauucagcaaacauuuauugaauauuuauaaugugcugggcaccauguuagaagcuuaggccauaaagaugaauauauagagcucuacucucaaguuggaguaggagagaccucagauaggugggcuucucuuggaaguagaggggaggguucagccacaccuucuugaugggaaggguucuaaccauugcccucacuuggcucaggugccggaugugcucacugacauucuacuccaagucggagaugcagauccacuccaagucacacaccgagaccaagccccacaagugcccacauugcuccaagaccuucgccaacagcuccuaccuggcccagcacauccguauacacucaggggcuaagcccuacaguuguaacuucugugagaaauccuuccgccagcucucccaccuucagcagcacacccgguaaggcugcucuugguuuaccccaccaccuggccgugaacccuaagaccauguugccugcaccuacuccucucuccacauguauuauucuuucccuuucaccuuugcccauugguagccucaaccuccuauuacugucuguggaaauuauauauccuagcuauuuggggggccuugaaaauuguggucuccaauuccaaagucuggaacaauuuuugugguuucucucugugucuguguuuggaaaucuucugcagagcaggccugcuuuuacuauaugcuucaguucagagccaaggugugcauucaacuucagguccauggggaacaggcgguauuggucuuuguucagauuacuauuuggaagcagggugucuguggugaguguguuaaccuuaggagaaagcggaggguugaugagauugacuacuuuaagguuaccaggagccauggguugcagcucuucaucaucucacugccauucuagccaccgacuuacgaucagcaacaaccuagaucuggguguccucuucauuugccuauccaggcuggaguguuuuugggaggagggaggaagggggugcucucauccgucaagcaacgucauuucacccagcagagagcugagccccuggugucgaacugcuuccuccuccccccuucccuccucuccucuccggcaggauccacuccaagaugcacacggagaccaucaagccccacaagugcccgcacugcuccaagaccuucgccaacaccuccuaccuggcccagcaccuccguauccacucgggggccaagcccuacaacuguuccuacugccagaaggccuuccgccagcucucccaccuccagcagcacacacgguaagggagaguggcgggcuacugaccccgccccgcuggcaugcccuccccacccccgccccggacacacacaacaacccgcaugcggggggcgggggagagaccuggcuggaggagagaccuggcuggcaucugggagaaggaagaccaaacaacacuggagauucaaguggacacagagcuucucuggggcaagagcuacgucggggagcugcagugacuauaugauauucacugauccaugggagacagacacguaccuggaguagaaacaacuuuucucuaauuuuccucccugaaaauacucauguacccaucuuggaagauuugccccuugaugccaaaacagaggcauuugaguggagaagaccauaccucuagcccuuagggcaccaauuaugaacaggaaauaaaaucagacauuagcugggcaccagccuggugacacccacagcaacaagcaaggcucugagggaugccaggaguagagaacaaaagaaaacacguacuaaauguucagagagaaucagcaaacagaaaaugaaaacgcuuaugcuucauaaagaugcccaguguuuaucccgugaaucuggagugacuaggaagaagggaaccugccaacuagaagugaugaucuuuggugcuaucucaaguugaacuggaguccagacuuacaggccauagaccgucucacccggcuucuuguggaugugaugaucucaccuuaaagugaucagacaucuugcuuugagaagaggaggagucaggcuuuccucacaaauaagagacacguccugugauguuuuugagauuuuauaccagaggucccgaaaagcaccuggucauagagaugguucugaagucgcugaugaggagcaggugucacugcacccucaaguccuuggcucaucuuagcagagggcccugugguguuggggagagaggucacauugguacuaaacuaggcauuuccugucauuagggggcugggcugcaaaaagcacuuaguuuucaugaguuuccauuaauaucacuacuacucuccacaaucaguguaacugcuuuucuuuguuaccauaacauucucuggaagugaugcucaaggcugaggggacuguuucuggccauaagguggggccaaggaagacgcguucugcuuuucuuuuuccuugccauuguguuuaucuuguguucuugaauguucguuaggacaguuacuguaggagcugacuugaaugccaaauugugggcugccuguuccuugggugccaaguccucagucucuccucccccagcagagaggagccucagcuugagcugagugaugcaggcauugaccagaagcaaaucaucaguaccugauccacaucagagaggaaggcuggugccucuuggaggcccaucugaugugccuccuuaggagagcaggaugggccuggagaagauuuguugagccaguuccuaaauggucuugcugacauucuuucccuuuuuucucuuauccugugcagaauccacacuggugauagaccauacaaaugugcacacccaggcugugagaaagccuucacacaacucuccaaucugcagguaaauguuccacccuccacacaagaccuugagucugagacauggggccauuugaauaguaucgugguucucaaauguuuucaggacuccuuuacacucaaacauuauugagggacccaaagaguuuuuguuuauguggguaauagcugucuacauagacguuguaaaacugaaaaaccugaaaaauauuuauaauaguaaucuguuuagaaagaacaaaaauaaacccauuguguguuaacauaaauaacauauuccaagacccuccaaaaacaacugagugagaagaauggcauuauuauacauuuuugcaggugucuauuuuuuauuuuugggacaggaccuugcucugucacccaggcugagugcagugguguuaucauggcccacugcagccucagccucccggucucaagugauccuuccaccucagccucccaaguagcugggauucuaggcaugcaccaucacaccuggcuguuuuuuucauuuucguagagauggggucuugcuaucuucccuaggcuggucucgaacuccuggacacaggccauccucccgccucagccuccccaaagugcuaggauugcaagcaugagucaccgcaccuggcacaggggucuuuaaugucuuaagcuagaagaugaguagauucucagaucugcugcaucuggccuauuguguuaucacacaucauguaaccucuguaaggguuacauguaaaacauaaggcacaaugaagccacuugaaauuuugaggggaacaagauuucaguuagguuuuucaucuuuguguuugugugugugugugugugugcgcgcgcgcgugugcguguuugagacagaggcucgcugggucaccuaggcuggagugcaguggugugauuucagcuuacugcaacuucccagguucaagagagacaaaggcaaacauugucuuauuauuuugaaaagauuuggcugggcgcgguggcucacaccuguaaucucagcacuuugggcggcggaggcgggcggaucaccugagcucaggaguuggaaaccagccuggccaacacggugaaaccuugucucuacuaaaaauacaaaaaaaauuagccaggccugguggcaugugccuguagucccagcuacuugcaggcugaggcaggagaaucgcuugaacccgggaagcggagguugcaaugagccgagauugugccgcugcacuccaaccugagcgacagagugagagacuucaucugggaaaaaaaaaaaaaaagaguuuugacccugugggcccccugugaaggucuuaguguucccuaaagauccccaugccucauuuuaagaaccacuggacuggugagacgggcauaagcugucuugggauccugguaugugcuacaugagguaugcuuccacccuuagccuguagcuucucaaguuucauuugaaacaauuucuacuuucuucagauagagggagaagcugggaggccugacaccuaccuuuuugcuuuccaucgaggucaagggggcaggaggaaagaguacaauguauucauucugguuucucccaauuuucucagucccacagacggcaacacaacaaagauaaacccuucaagugccacaacugucaucgggcguacacggaugcagccucacuagaggugcaccugucuacgcacacagugaagcaugccaagguguacaccugcacuaucugcagucgggcauacacaucagugagugcuccguuucuucucuccuuccucauaguccucuaagaguacaguccacuucaccccauuuucuggguagagaucuguugcagugaauacccugccucccuagcuccaacuuagcagaacagguaaauauucagaaauuaauuagacccauucugaggaauuuaggggaugccugaucuccuaauccuauagagacgcauaagcuguaauucuucauuuuacuuaaacauaaggcaaaauaaagccacuugaaauuuugaggggagcuggauuucaguuaggcauuuucuucuucuuuuuuuuuuuuuuuucuuuuugagacacagucucgcccugucacccaggcuggagugcaguggugugaucucggcucggcucacuguaaccuccaccuccuggguucaagcgauucuccugccucagccucccaaguaggugggauuacaggugcauguugccaugcccagcaacuuuuuguauuuuuaguagacaugggguuucaccauguugcccaggcuggucucaaacuccugaccucaagugauccaccuaccucagccucccaaaguacugggauuacaggugugagccaccgcaccuggcccaguuagauauuuuccaugagacuccagaaaagguuguaaaguuguuucauucaggggucuuugaaaaaaauagcagcucauuccuuugccaguugaauguugagugacuucuaaagguuccucucuuuuuuuucucaguagugagccacugaaagugcuacuugaguuuugcucagucuuggcuccagaaaaccaguauaaagcuuacucugcuuacagcagaaucagagccuggggugcuaguuacaaguaaucucuuuuccuuccucuuuaucccucaacuucuuuuuaccaucucccucaggaaacauaccuuaugaaacauaugcgcaaacacaacccgccugaucuucagcaacaggugcaggcagcagcagcagcggcagcaguggcccaggcccaggcucaagcucaagcccaggcucaggcucaggcucaagcccaggcccaggcccaggccucccaggcaucacagcagcagcagcagcagcagcagcagcagcagcagcagcagcaacagccaccaccacacuuccagucuccuggggcagccccccagggugggggugguggggacagcaaucccaacccuccaccccaguguuccuuugaccugaccccguauaagacggcggagcaucauaaggacaucugccucacugucaccaccagcaccauccagguggagcaccuggccagcucuuagagauccgugcugccacccacugggaagaggaagaaguaguccuggugucuucuuucuccaacucuuggugggaaaaguccuuuucuuccuugacaggccuuggcuccaucuccuugggccucugucacggcuuuccuucacaggauaccauccuuuuucugaacucuucuucaaaaggaacaucagcccuccugauugcaaaggaauacugagcugauggugucauccagcagccuccccucccaagcaaagcuucuaaaacugggggucggugcucaagggaaggauuugcuaugaccucauagaaccuuguccaguguggccacuuacccuauccuuacccuccuuauccucaaaguuugggcugauguaagacuagaggcuggcccucccagauaacagagaaaagggagccccaaaugcaaccagccucuuguucuauucuugccugcaaaagaacagagguuucucaaaugccucagucccugagagccauuucuuccccuacaucgucucacuuugcuuccuauugacugcugguagaaggagauuugggguaggggcuagaccuccuuuuauuugaagggggcaagggcugagaugugguccccaaggggccagaaauucccaaguuggucacagguggcuuagaaguguguguuaugguuuuacggauuuccuugaagccucucuccuucucugccuacaaagacccuauacucucagucuccccaacccacccccaaggagcugugggaggcuuuguguuaucugugaaacuccaaaacagggguguugcggagaagggagaguucaaggcaaacgcaaggacuggacuuagcucccuaggugccacagucagaugccggacacggauuuauauauaaauauauauauauaaauauauuauacucacucaucacggccaucuuuguuguaaccauuucuguguuuauaaaugcauuaucucugagaauuuucauauuugauguuuuguuuauuuuuguccuuuuuuucccucucuccaccccuguccucuagccacagcauuuuucuuuuugucuuuuuuuuuuuuuuuuaaaucauggcagauuucagaggaaaggaaauuaaaaaaaaaaucaggaaaccaguuguuauaaaguaauuuaaaaaugaagaaaaaaagaaaaaaacuuauguacaaaccaagggguguuuuuagaacauuguauagaaauaaauucauguaaaagga

SEQ ID NO: 191697 - RNA, 1156 nt, Homo sapiens
uuccaaagaagccccauuuuauuacagagaaaauacaaagccguuuccucacagggaaaaguacaguuucccuucuccagggugacagaugagccuuuuccgaaguucucagcuuucucuucuaucgaaacuucccaugucgguuaaaguguuuguagagauagcggaugcguuuauuaagguugugcaggucaucagcgaacauucuacuuccaaccauuuuccucuuucggauacaacguugcaauucauucccuuuccaaccucgaagccauaugggcccccugaucaguucuuuggggugcuuuucaaaguuuccuguguaaugugagagaacacauuagauccaagacaagagaacucauccuacaccagcuaagcuuucaacccacgguugcaucuugcugagcagcaccuauagacaaggaacauuacaguacagaacaauagcacagacucuggagccagacugcuugggguuaaaauucugaugcugccauuuauuaacuuuggaaaaacuguuuauuuuuacuuaugaaguaaaaauuauacgaggggacucagaacagugccaaacacaauguaaacagcuacauaaguguuugcucuuacuauugagcacaguaccacucucuacacaggaggaaaagauagucguuacagccuaauugccauucugaaauuguguaccacgucgaaggucaagucuuacccaggaucccgauguugucauacacuccgaacauggcccuuuucucguuccaacgaucaaccacuuuggggggcgggagagugagccuuauaccgaucaaucuaggcacaccuggggauggggaagggagggaauuaaucugagccgccuauuauacuacgaagcaguuaucggggugccuacaucagccacuuaccaagagagaagcuucugcacgccagaggcacccagucccacaggcgccuaccugccccggauaagagguucccugccauuucucuagucuccccccuucaacagcacaccaaauaagcccaagaagaugacaggaaccguccccgccaacuucacacgaguacuaaggcgaagacagccaucuugggccuuacccaggcagcugugggcgcaccgcccaccuacgccccauccgcaacagccacgagc

SEQ ID NO: 191698 - RNA, 38457 nt, Homo sapiens
cauuauuaaaauaaauuuuaaaaacaccuucaguguaaacacauucagguuaggggauacuguaugcucucucauuuaauggaaauuaaaaaacaaucacauaucacuuggggucuuuacaauacuuugacauuaaaaaggguccuugucuucuagaacguaugcuagaagugguuugucauaggaaaauucaaacucucuggcauuucagagaauaaauaguauauauaucauuauuaaauauguuuaacaaaaaucaugcucaaguucuaagugacuacauuucucauuuuguaaaucaaggaagaaaauacugcagaauucaaccugaaauguuuuaauaguggaacuguguacaggauccucuaaagagaccgccuggcugggugcucaaaccacaugggccgacccaaaagacgccaaaaccaagagcugcucaggaggcacuaaauguugacggucuuggccggcuucacauccucaauuucagcagacagccagcgguaagugcgaugacgccgcagcaccucaauggccuugaguuccagugguguugccugaauaccaaggucuucuaagccaggcaggugaggcaauuucaugucugugaugugcaucuuuggauaaacaaaggaccacagacaaugcugaaaacuggcugagaacaaagugcuauccuagcaggcacuuaaacauucaagcuggcaugaguccuauuauugagacuuaauugcuuucaaagaauauguggcaauuuucgauucaugcaaaucacuauaaaagcagaacacacaaagagggcuuaagacaaaagagggcgagaucaccaaguaucagaucgagguccccaguggcagccgcgagcacaggauguuggcacuacaugagccauucuauauacagauuucaacagaaauaaaucuagggcagggaagcacaagucaccacacuugccaggggaggcugaacaggaggguuuaggaauaaaaucagggcuuaagcagagcugguccauuccucaguccucucacgccccuguuuucugagcacgggcguucugacucaguuuuaacuuugaauuuaggagauaacacaacauuuguuccuugcccauuaaaaaaaaaaaaaaacaaguaacuuuuuuugcuccagcuguacucaaccugguugacuaaugcucacuguagagcuagaaaaccaaacccaucuuguuuauagggaaagauaaugaacuguaaaguuugcaaacaucccagauuauuauucaaaaccacauaaauagaauccauuugcaccuagagcagcagcaaucccucauccuacccaccugaaagucugcaauucuuuuaccagagggcuguaagccagucugcaaaccaaauccaaaaccuacucaggccacuguaucaacacuuucucaaguauaaacguaagagacacuuuaguguaagauaaacugaagugucugacaaccagcgauccugccugaucuuucauagaccaugucugaagaaaguaugugaguugcccacuuccacauguucccuaagcacuacuuucucaucuucucuacacuuuagcuuucaggcagcauucaggggacaauuuggcuacuucuugccaauauaugguccauaggucuuccaagguagaugugguauugguauaguauuuuuauuuuauuuugcauccucccuagaagcaaaugcacaggcacaugacaugaggucugagaacugaccauuggauguggcagcaaggagacuggagauuguggauaaccuugaaaagagcaauuuuaggggagaaaugggaauaaaagccugacuggaguagguuaaagaaagaaggaagaaacugucaacaguuucuucaggacguuaggaggaaguuaggaggaguuaggaugugaagggacacaacaggaaaguagcuggaagagugaugggaggaagagaggcuuuggcaggggagcuauuaggcaauuuuguguguugacaggagugaucaagcagagaaagaaacacugauaaugacggacagaaaguagggaggagccgcccccuggagcagggcagguggaugagcuucagcgcuaguagaggggcugacugcagacagcaagaacagcaaacagacaagggccgggaaacaagcaagcaggcaaagcaaaauaagucuaacgccucaucaucugcccaggcagacgcuuuccacacauguacucacccgcuccacuuuaucccuuguuauccagggcucaaaugggcuuauuucaaagacucuugcuacccaucuggaaagagaaauacauauagcacaugugauaagcaucucucugcccaagauguaagcuagccuaugagaacugcaggaagacagaccgcuguagagcagucugaacugauuuuuuuuuuuuaagaaaauaaccaccucgaccugugaggcuaccucugcuuuuugguccaucuccucucaagccaacccagucggcugcuguaacugcugguacacuuuguucuccuccaaagaaacaacagaucuuaaacuuaaaaugaaauaaaaccaacaaacaacaaagcaaacagaaaaacuccaguauuuaaucaagucugugaaauucaauuuaaucuaaaccucagauauucaaauaugcugccuuuacagaagcagggcaagcugaaugguguguaaaauauacaacguaaccccugaaagcuggggcccuugaggaaaaaaaaaaaaauccaaaagcaaggagaaggcuaaaaucuacgguucaaaucaggacgacaauauaaaacccaaaacggaaaaggccaccuaucuucauuacugccaucucuucacugcuaaugaaaauugaagggcuccuuacgugccacuugagcucccaucaucaguuaccucagggcagugacuuuuucuuuucuuuccuuguuuuuguuccacagacagggucucacuauguuguccaggccggacucacacucccaggcucaagugauccucccacuucagccucccaaguagcugggacuacagguguacaccacugugcccaguagcaguggguuuucaacuagcaucugaggaacacuaggaauuugcuggggccccacagaguccuggggggccaaggguuugggaguacaugcguugaguaucacccaucacugcaaccagaccagcucuuuuauuggauuuacccagcaggacuugacguaaaacuucagugagcacaggguuccacagccguuuaaaggcuugaaaaacaacauucuaaugcauaguauaaauaaaugaaaaaggaagcuggcuggaauuucuccagcaacauauaaagccucagauuccucaacggcagaaaaaaauaauuuauugggcuaacauagcuuaauaaaaacacucauuacaaaccucuaacucucugugcccucauucuaugcuaacagaucacuucaggucucuauucuaguguccucagugggccaugucaugggcauacauaagccaacucuaacucaauuuuauauacaaccaugaaagugccucacugcaaucuggcuuauaucccuuucacggcacugaagccacggucacaauggucauuuguagacauuuuuugguccuuuaucuuauuugacuuuucuguaagacuucauucuaccaauauuaacagagugccuaauguguaccaggcauuguucuaggggcuugagauacaugugaaugaacagcaauguuccccuucuuaaaacaucgauucucuccugaaaacacuccauucccuuugguaucuagaauuccaaacucucauuucccacuuaaaugccugaucacuuuuuggccuucuuguaaguuucucuuacucuguggccuccucuuccacucacuccacauacucuccuuacuuacuuuauagauaacugaguauuaaaggagacaaagugaauagucugaaagguguaacacucaauaaauaucguuaucacccugcauucuaguggucuauuuuucugguaccccuguuagaccauaagauuuuugaguuuuuguuguaacauucugaccauaagauuuuugaguguuuguuguaaccuucugaguaccuaguacauuaucuaagacauaguaggcauucaauaaacauuuguugaaugaauggaugaaaacccaaaugaagaucaguuuguggcacaauggaugugacagucuccuuaaccagaccacuagggugugacaugguaaguucaagauuuuauuuuauuugguucaaaucaggacaauauaaaaccuaggacgagaaaggagcucccaucaacaguuaccucagggcaguagguuuuucuuuucuuucuuuuuuuuuuuuuuguuccagagacagggucucacuauguuguccaggcuggauucaaacuccugaacucaagugauccucccaccucagccucccaaguagcugggacuauaggugugcaccacugugcgcaguagcagucaccuaggcuggagugcaguggcacaaucucagcucacuggaagccuugaacucccaagcucaagcaauucucuugcaucaccccaccuccaccccaguaggugggacuacaggcagaugccaccacauccagcuaauuugguauguuuuguagagauggggcuucgcuauauugcccaggcuggucucaaacuccugggcucaagcaaucugcccuccuuggccucccaaaguacugggauuauaggcaugagccaccacucccagccaagucaaagauauuuaacccacaaagagaagaaguaaacuaagaagcagggaaagaagagaaggcaaccacaaauccaagucugaauuagccugacuccuuuccccaauagcaugaucagguugauuuaauaaugagcgacaugaaacacaggggaaccugacugccccuuacauaugugccuagcaagauauuucuccaaaauuaaacucgaugguuuuaaauuggagaaagugaagaacugcaucuucacuuuugggaagugggaagauucacuuuugggaauugggaagauuuaauguuccaauauauuuuuuuuuaaccaacacuaaucuauuucugcuucuucucuaugcuaaugucauaacacuaggagaucuggagaccagcccuucacacacccuauaacccuaagggagaacauuaggaacaaguguguggagcuggcuuuuucagaagucacacaaaaggagcacucuacuuaccgauaggcaaaaagcggcaaggggaaugggaggaacaaucugugagccacagcaaagauguacuucaccagguggaaaaggagguaccgacugggacuauaaaaagacaauacacaguucuuucaauuacacgcuucucacaaaguuuccuuuauaacaaaauaacauuuuccuuauaaaaaaggaaacauauaugcacuguaguagauacagaauagcacaaagaaaaaucacccauaaucccauuaugaaagauaguuaauauauuugaucuauauccuucucauccccuuacauauauacauuauucugcuuuuaauaaauacacaauccauucuauuccguaaugucuuuuucauuuaacauuacaucauaaucgucuuuccacaucauuauuuuauugcauguuucaugacaacauauuacacugcauguaaucacaauuauuuuaucaauugccaguuuugagauauuuaugcuauuaaaauuuuuuucuuuuauaauguuuuaaugaacauucuuguaauaaauauuuguacuuauccaugauuacgcauuuagaauauauuuguagaaguggaacugggucaauguagacuuuaaaauuuuaaggcuuuuauugaauacuucuaaacugcuuuucaaaaugguucuaucaauuuauauaaaauguuaaguauauaacauuuuagauaauuauauaaauuauaauuauauauauguaauuauauauaagaaugcccccuccacccgaaaugaguugucauaagaaaauaaaauuuuugccaaucugcuagguuaaaaaaaaaaagguaucucauguuuuaauuauuaugucuuuaauaugagagaucauuucuucacgaauuuuuggucauuuauacaucuaucuuuucuuuccuccuggagucccugucuauaaaaauaauuuguaagaauucucuauauuuuagugauauuguuggaaauaccuuuuauuguuuguauuuuaacuuuuaguguuauuuacaguguuuugugcacauaaaauuuuaacuguuuaauuuaaccaaaacuacugauuuucuuuauggcuuggauucauaguuagaaaauuccucugcagugacauaaauuucuacauauuuugucuaaaccuuauaaaaaagauuuuuuuuuuacuauaaaguuccuucugugacguauuuuuguacauuauauaagguaaacauguaauuauauuuuucccaagauguaagccaauugcuucaaugcuacuuacagaaucauuuacuguacugccucuuucccuauacugaaaugucacccuuaucacauacuauauccuuacauauaaugggacuguuucugaacguuccgcucuauuccauuaaucugaauaguucuguacgauuuuaaccuagcauuaauaaguaucagugcuuauaaugcauuuuaauauuucuuuacccauuuccuaauucauuugcaugcuucaugacaguaaaucugugacaaccaagagcugagugaagguaauucagugagaaccucauuauucugacauacuuuacuaaaaaacaugaaacuaucagccaggagaaauaucagacaaaggccuuagcaggguucuucaaauuccagagggauuuguaaggaucauuacaggacauauaauacaugcuacgccaagagcaacuugaauuuuuacgaugacaaacaaaacugguaucauggguuaacuaacucuacauaauagguuuccuuuucagcuguucugaagcacuuuguguuccaucaagugcaaccggaacacuaguuuaagugcccuuccucacagccaaagguacauugaagcccgcauccucccagcuuagauuucaaggcucagcaucacaguuauuccucugcaaauauccucagcaaaaucuugucucccaggccccuacccacuauacuugcuaagcaaaacucacucugguugacccaaacaugugccuucucugagccugaaaccccagaaggacaaaacuguagacgaaauacaauugaacugauugacuucaccuuauuuuuuuaucaguaauuuccaauggaacacucaguucugcuuggcaaucccacauguucuccuaggaaaugcucuuuccuguucucccagggcauacuuucuaucuucuguccucaaauuuuccacacacuuuucugacccacuccauccugccuuuuagcuaaccucacauuccaacaagaaaagauacuccuaacauucccacagccaaaccuaccugcaucugcauauauccuugaauucuuuuccuuguuaaaguugaagaaauguuugccuuuuacaaaggucaaacccucauuugcacucuguauccaacuccucucaauuccugaaggacuuugcuccuuuucugucggccucaucuccugagucaugaagugacaucucuuuccuggaccauucuuaccaauuuauaaacaagauguaccaucuuccaaauccagggugguaccucccuugacaagacauucauguuucauagccuucucuuuacccguuuccuuugcucccuuuuacagggaaacuucuccaaauaguuaccuaacuguugccuccacuuccuauccugccauucaaaucucacugcaauccaaucugcccuuugccuaauguucaaaugaggucauuaaggugaccaugaaucucuaugcugucacucacucaaccuccuggcagcauccaauauaguugccaacuuccuccuucugguuuucuuuccaauuaacuggacuuuccuuuucggucauuuauuuuaauuauuuugcuuaauuauuacuuaugcaucucaucacuaaucuauaagcuccacaaaggcagaaaucuuacccaugcuauucacuauugugguauaauuuacauacauuaaaauucauccauuuuaagcauauaauucaaugauuuuucauacauuuaccaaguuguacaaucauuaccauaauccaguuuuagaauauuuuuccuuacucuaguaagauccuccacagccauuuaauccuggauuuuacucccaggcucaggcaaucacuaaucuacuuacauuugccuuuuauagauacuucauauaaacggaaucacacaacaugugaucuucuguaucuagcuucuuucauuuaccauguuuuugagguucacacauguaacaugucaauauuucauuccuuuuauuguugaacuucuauuauaugagaaugcuacuauauuuuauuucuccuuucaucaguuaaugaauaugugggauguuuccaauuuuuagcauuuaugauaacgcugcuaugaaaauucaagugcaaaucuuuguguagacacauuuucauuucuuuuggguaaauaucuaggaguaaaauugauaggccauaugguaaauuuaugcuaacuuuuuaagaagaugccaaacuguuuucuaaaguggcuauacaauuuuacaccccuaccagcaauguaugaagguucucauuacuccaugucuuccucaacauuuguuauuuucucucugugaacugguaucucauaaugguuuugauuugcauuuucuguaaugacuaaugauauggagcaucuuuucauauguuuuuuagugauuaaguacaucugcugggcugauaugccuauucaugucuuuugcucauauuaaaaaauggaucaucuucucauugaguucuaagauuucuuuguauauucuagauaguaguccucuaucagauauguaauuaacaaauauuuucccccaaucugugacuuguuuuuucauuuucuuaauggugucuuuugaaacacaagagcuuuaauuuuggugaagucuaauguauccauuuauuuuuuauuuuaugaaauaggcuuuugaugccauagguaaaaaucuucuagaauccaaggucuagaagauuuucuauuuuccuuccaaaauuauuauaguuuuauaacucuuuuauuuauuuuuuuacauuuuuaccaauugaaauuuuuuuuuuaauuauacuuuaacuucugggguacaugugcagaacguacagguuuguuacauagguauacaugugccauggugguuugcugcacccaucaaccugccaucuacauuagguauuucuccuaaugcuaucccuccucuagccucccaccuccagcaggccccagugugugauguucaccucccuguuuccauguguucaacucccacuuauaagugagaacauaugguguuugguuuucuguucuuguguuaguuugcugagaaugaugguuuccagcuucauccaugucccugcaaaggacaugaacucauccuuuucuguauacuggcugcauaguauuccaugguguauauguggcacauuuucuuaauccagucuaucauugaugggcaucuggguugguuccaagucuuugcuauugugaacagugccguaauaaacauacgugugcauguggcuuuauacuagaauaauuuauaauccuuuggguauauauacucaguaaugggauuacugggucaaaugguauuucuacuucgagauccuugaggaauugccacacugucuuccacaaugguuuacacuuccaccaacaguggaaaagcgucacuauuucuccacauccucuccagcaucuguuguuuccugacauuuuaaugauugccauccuaacuggcaugagaugguaucucacugugguuuugauuugcacuucucuaaugaccagugacgaugagcuuuuuucauauguuuguugagcugcauaaaugucuucuuuugagaagugucugcucauaucuuucgcucacuuuuugaugaaguuuuuuucuuguaaaucuguuuaaguucuuuguagauucuggauauuagcccuuuuucagaaggauagauugcaaaaauuuucucccauucuguagguugccuguucacucugaugauaguuucuuuugcugugcagaagcucuuuagauuaauuagaucccauuugucuauuuuggcuuuuguugccauugcuuuugguguuuuaauuacgaagucuuugcccaugccuauguccugaaugguauugccuagcuuuucuucuaagguuuuuaugguuuuaggucuuacguuuaagucuuuaauccaucuugaguuaauuuuuguaucagguguaaggaaaggauccaguuucagcuuucugcauauggcuagccaguuuucccaacaccauuuauuaaacggagaaucauuuccucauugcuuguuuuugucagauuugucaaagaucagaugguuguaaauguguggcauuauuucugagcccucuguucugucccauuggucuauauaccuguuuugguaccaguaccgugcuguuuugguuacuguagccuuguaguauaguuugaagucagguagcaugaugccuccagcuuuguucuuuuugcuuaggauugucuuggcuaugugggcucuuuuuugguuccauaugaaauuuaaaguaguauuuuuccaauucugugaagaaagucaauggaaguuugauggggauagcacugaaucuacaaauuacuuugggcaauauggccauuuucauuguauugauucuuucuauccaugaucauggaauguuuuuccauuuguuuguuuguguccucucuuauuuacuugagcagugguugguaguucuccuugaauagguccuucacaucccuuguuaaguuggauuccuagauauuuuauucucuuuguagcaauugugaaugaaaguucacucaugauuugguucacucaugguuugucuguuauugguguaugggaaugcuugugauuuuugcacauugauuuuguauccugauacuuugcugaaguugcuuaccagcuaaggagauuuggggcugagacaauggaguuuucuaaauauacaaucaugucaucugcaaacagagacaauuugacuuccucuuuuccuaauugaauacccuuuauuucuuucucuugccuaauugucccagccagaacuuccaacacuacguugaacacgaguggugacagagggcauccuugucuugugccgauuuucaaagggaaugcuuccaguuuucgcccaaucaguaugauauuggcuguggguuugucauaaauagcucuuauuauuuugagauauauuccaucaacaccuaguuuauugaggguucuuagcaugaagggcuguugaauuuugucgaaggccuucugcaucuauugaaauauucauguaguuuuugucauugguucuguuuaugugauggauuacauuuauugauuugcauauguugaaccagccuuuuauccccggaugaagccaacuuuaucgugcuggauaaguuuuuugaugugcugcuggauuuuauugaggauuuucgauucaauguucaucagggacauuggccugaaauuuucuuuuuuugcugucucugccagguuuugguauuaggaugaugcuggccucauaaaaugaauuagggaggauucccucuuuuucuauugauuggaauaguuucagaaggaaugguaccagcuccucuuuguaccucuggaauaauucagcugugaauccaucugguccuggacuuuuuuugguugauaagcuauuaauugcugccucaauuucagaacuuguuauaggucuauuaagggauucaauuucuuccugguuuagucuugggaggggguauguguccaggaaccuauccauuucuucuagauuuucuaguuuacugguauagagguguuuauaguauucucugaugguacuuaguauuucugugggaucaguggugauauccccuuuaucauuuuuuauugcaucuauuugauucuucucucuuuucuucuuuauuagucuggcuagcagucuaucuauguuguugaaaaaaaccagcuccuggauucauugauuuuuugaaggguuuuuccugucucuaucuccuucgguucugcucugaucuuagcuauuucuugccuucugcuagcuuuuaaauuuguuuguuccugcuucucuaguucuuuuaaaugugauguuagagugucaauuuuagaucauuccugcuuucucuugugggcauuuagugcuauaaauuucccucuacacacuguuuuaaaugugcuccagagauucuggaauguugugucuuuguucucaucgguuucaaagaacaucuuuauuucugccuucauuucauuauuuagcccguagucauucaggagcagguuguucaguuuccauguaguugugcaguuuugagugaguuucuuaauccugaguucuaauuugauuguccuguggucugagagacuguuaugauuucuguucuuucgcauuugcugagaacuguuuuacuuucaauuauguggucaauuuuagaagaagugcaauguggugcugagaagaaauuauauucuguugauuugggguggagaguucuguagacgucuauuagguccacuugguccagagcugaguucaaguccuggauauccuuguuaauuuucugucucguugaucuuucuaauauugacagugggguguuaaagucucccacuauuauugugugggagucuaagucucuuuguaggucuccaagaacuugcuuuuugaaucugggugcuccuguauugggagcauauauauucaggauaguuagcucuucuuguugcauugaucccuuuaccauuauguaaugcccuugucucuuuugaucuuuguugguuuaaagucuguuuuaucagaguaggauugcaacuccugccuuuuuuugcuuuccauuugcuugguaaauauuccuccaucccuuuauuuugagccuaugugugucuuugcaugugaaaugggucuccugaauacagcaaacugaugagucuugacccuuucuccaauuugccagucugugucuuuuaauuggagcauuuagccaaugcaaggaagccauuuaagguuaauauuguuaugugugaauuugauccugccauuaugaugcuagcugguuauuuugcccguuaguugaugcaguuucuucauagcgucaauggucuuaagaauuugguauguuuuugcaguggcugguaucaguugauccuuuccauguuuagugcuuccuucaggagcucuuguaaggcaggccugguggugaugcaaucucucagcauuugcuugucuguaaaggauuuuauuucuccuucacuuaugaagcuuaguuuggccagaugugaaauucuagguugaaaauucuuuucuuuaagaauguugaauguuggcccccauucucuucuggcuuguaggguuucugcugagagauccacuguuagucugaugggcuucccuuuguggguaaccugaccuuuuucucuggcugcccuuaauauuuuuuccuucauuucagccuuggugaaugugacaauuaugugucuugugguugcucuucucgaggaguaucuuugugguguucucuguauuuccugaauuugaauguuggccugccuugcuaguuggggaaguucuccuggaguuuuccaacuuggcuccugguuccauucuccccaucacuuucaguuacaccaaccaaauguagauuuggucuuuucacacaggcccauauuucuuggaaguuuuguucauuucuuuucacucuuuugucucuuaucuugucuuuucacuuuauuucguugaguuaaucuucaaucucugauaugcuuucuuccaccugaucgauucggcuauugauacuuguguaugcuucacaaaguucucgugcuguguuuuucagcuccaucaggucauuuauguuguucucuaaacugguuauucuaguuagcaauucaucuaaccuuuucucaagguucuuagcuuccuugcauuggguuagaacaugccuacuucugucaaaucgucaaacucauucuccauccaguuuuguuuccuugcuggcaaggaguuguaauccuuuggaggaaaagaggcuuucugguuuuuggaauuuucagccuuucugcccuaguuucuccccaucuucauggauuuaucuaccuuuggucuuugaagucagugaccuucggcuggggucucugaguggacguccuuuuuguugauguugauacuauucuuuucuguuuguuaguuuuccuucuaacaggccccucugcugcaggucugcuggagguccacaccagacccuguuugccuggguaucacuagcagaggcugcagaacagcaaagauuguugccuguuccuuccucuggaagcuucgucccagaggggcaccugccagaugccaaccagaucucccuuguaugaggugucuguuggccccuacagggauguaucucccagucaggauacacgggggcagggauccacuugaggaggcagucugucccuuaucagagcucaaaugcugugcugggagaucugcugcuuucuucagagcugccaggcagggauguuaaaagucugcugaagcugcacccccaacugccccuucccccagaugcucugucccaggaugguggggguuuuaucuauaagucccugacuugggcuacugccuuuuuuucagagaugccuggcccagagaggagggaaucuggagaggcagucuggccacagugucuuccugagcugcagugggcucugcccaguuugaacuuccugguggcuuuguuuacugugaggggaaaaccaccuacucaaaucucagcaaugguggacgccccucccucccaagcucauacgucccagguugaacucagacugcugagcuaggagcgagaauuucaagccaguagaucuuagcuugcugggcucugugggggugggacccgcugagccagaucacuuggcucccuggcuucagcccacuuuccaggggagugaaagguucugucucacuggcguuccaggugccacugggauauggaaaaaaaacuccugcggcuagcccagugucugcccaaacggcugcccaguuuggugcuggaaaaccagggcccugguggcaugggcaccuuagugaaucuccuggucugcggauugcaaagaccaugggaaaagcgcaguaucugggccagagugcaugguacagucccuaauggcuucccuuggcuaggagagggaguuccccgaccccuuaugcuucccgggugaagcgacaccccacccuguuuuggcucacccuccuugggcugcacccaccguccaaccagucccaaugagaugaaccaggcaccucaguuggaaaugcagaaaucacucgccuucugugucaaucuugcuggcagcugcagacugcagcuguuccuauucagccaucuugccaccaauccuuguuuuauaacucuuacacugaagucucugaauuauuuuaauuuuuucauguacagagcaagguaggagucgaaguucaucuuuuuuuuaauguggauaucccaaaaccauuuguugaaaagacuauccuuuccccuuugaaaugccauagcaccuuuuucaaaaaucaauuguccauaaagauuuauuucugaacuaucaauucugguuaauucaucuauacgucaauucuuaugucaguaccauacuaucuugauaauuauagcuauuagguuuugaaauuaugaaacuuaaugguuuugucuauugugggucuuugcauuaccauauaaauuuagaaucaauuuaucaacuucugcaaaaaagucuguuggaauuucgauagaauuaaguugaauuugucaaucaauuugaaggaaauuaucauuuuaaucauacugacucauucaauccaugaacaugguaugucauuacuuauuagguauaauauaauaaauuuaauuguuaaauuuauacuuaaauauucuauuauuuuuuaugcugcugugaauaaaauucuuuucuuaauuuuauuuucacauuguucauuuacuaguauauauugauuuuucuaugcugaucuuauacaucgugauuuugcugaauguguuuauucaucaucacaguuguguguaauguuguaugaguguguaucaauagguauuuuaugaaugaauggcaaauagaauggaccaacauaauauaauucauaauuacaaaaaaccuaggaggaaaauuauagucuuaugccacugccuuagccucaaaauaucagagaaagaagcaaaguuuuuuccuggggcugaagagaugagaaauguguagauaccuaucuacaauuucaagaggaaaaauaucuacacugcaaugucuaguauuauuuuucccaucguuacgccaaacaagaaugacuuacuggagcccagacaaaaggauaauggcugggcaaagguaaaaaggaaaaugugcaacucauccagagcuagagcaaguaaaguucacaaagccauuuccgcucauuuauucccugaaauccuaguccauguaccucuucacuggaacuaaugucuuuuguguaguauuuuaugaaaccuguauugaauauauugaauuguaauucuuaucuagacuauauaacugauugcaugcuaauguaccaaacugggaacugaaaaggagaaauauauuuugcagcugcuaguugacauggaaaaccaagacuuucacacugaaaaaaauuauguauuaaauaauaauaguggaacauaacaauguauagauucagaauucugggaguauauucuaugccucuuggcuuaaagagaacagugucauuuuccucuagaggcaaacauuucuuaugaauuaggcuaucccuuaauuacugagccagauccuuaacuuucauagaugucaagugucacuaguuugcuucacagaaucacaggguuaugaaccacuuaccaggugaauuugauaccucucaacuuggcaaaugaagucuuaguuuuugacuuuuaguuaauucagcaaaaaaauuccuaagcuuagcugucacaugauuuaguaauuucagguaagccacauagcuuaacuguaccccuuuuuucugaaagcaaauuuuagcaaagagcauaaaagaaauaaucaaucucgcacagcacuaguaauugugcuauaaaccacccguuuuucagccucuggaggcauugugauacuccaucaaaauuaaugugguuuuauaaccauacuuacucccuaaaaguguuuuguuuguguuuuagaauuuacagcaauauccuuuuauauauuaaaaacaucacuggaguaguacaaaaccaucccuaagggucacuggacuaaguauauguaauagucuagggcagugguucucagaccuugguaacagaagaaucauucauuaaaguagauuccagguucccucaaauucugauuuaaugcaagcaaugaggagauuuugauauuguaaaagugcaacaaauaaaucuguuaguaacuaauuuagauauugauuccuucauuauaauagcacaauuuaaaauucaaacucuaagcacuuacccaacgaaagcaaaggauuucccauuggcaucaggauccuuaacugcauuaacaauuccuuuggauacaucuacgaccuguaagaaauuauaauauaugucuaaguaauuguugaaaaagagacagaaugggagauggagagauagaaagaaaggaaagaagagaaaaaggaaggaaggaaggaaggagaaaggaggaaggccacacugaucucaacaaagaaaaugugaaguuaaaauaauggcauuaucuauucccagaaagcuucuuaaaagaaugagccuucucaagagcucaaauaaucaccgcuauccaaguauuuuccaaguacgcauaauccaaggcucauccaaguauuuucuguaguaggaaugcacuuaccuucagauagcuugaggccccucugauuugcuuuugcccacaacuugccaagcucaucucuuaccauucccaacucucuuauuaaccaucacaagcuauuaggcuuaaccacauggaauugcuaauauucuaccauuuugauuuucaaaaacaguaauaguaauagugauuuuggcccccaggggacauuugacaacugucuagagucauuuucaguugucacaacugaaggguggugugacuggcgucuaguggcuagaagccaggaaugcugcccaacacccuuuaacaacccccauaacgaagaauuaucuggcucaaaaugucaauagugccacuacugagaaaacuugguucaaucuaacauggaauccaacaugcucuuucaccucugggccccuguauauacuguucccucugcaugcaauacucuuccccaacuccuuucaucaggcuuaccuuuagucaucuuuaagguuuuacccuaaaugcccuuccuuuugaaaugcccaagucuagauuaggugcccuucugauguaauuacauaaaacccucuccuuaucauagcacucaucacguuguacaauaacugcuuuauuuaucugccucagacugaaagcaauuugagaacagcaauuugugucuaucuaguuaauaucuuuauuucccuagugacaugugacauguaugaugugucuagcacauuaugaguucaauaacuuuuucuuaaaugaacaagugaagacacagagaaggcauguaccucuuaaguaaacuaagaggcagcuagcugacacaaguugacaaagaaaaugacagaguuacuaaauuaggacaaaaccagaaacuugaucacucaaaucugaauucaucaaaaaucccuuucugacccccuucauccaaguacuuacauauacugguuguuuaacugucuuccagcccaaggaaccaagggguauaggaccaaaccgaugcauaccuagcggaagaaagaaugagaacuauacugagaaggcuuaaauugcuguaagauccaacagucuuaagauuaacauaauuauugugcauaauagaaauaauauaaugaauguagcugacucugaggaagugaaugcacuuacaaaaggcagucauuaguuuuucagauaauaaacucggaaaauaaaaaggccaaauguuuaaaaccaugaagagcaaagaaaagaggucaaaugucuagacaacuagucugcucugcaaugcuaaaugcaucgcuacgaccaagacuggacucuagcugcacccauucuaaggagaaacauggaacucuuccuccuuaugauacucaucuguugauauggcagaugagcugucuaucuaguuaauaucuagaugaguucugcugcuguaucaacagaugagugauacagcacagauaacccagaaaaagggccugauggaaauauuaguugauauauggugcuggcacaauuauucugcuauuugaaaaaaaggugagauaaugucuuaguucucaccauaaacuaaaacaaaucccaaguaguuuaaauguuagguuaaaaaaguuuuuuuuguuuuguuuguuuguuuuucuuuuuuuuuuaaaccauuuaagaguagaaauuaggccgggcacaguggcucaugccuguaaucccagcacuuugggaggccaagaugggcggaucacaaggucaggaguuugagaccagccuggccaauguggugaaaccccaucucuacuaaaaauacaaaaauuagcugggcgugguggcacacaccuguagucccagcuacuugggaggcugaggccagagaaucgcuugaaccugggaggcagagguugcagugagccgagaucacgccaccgcacuccagccugggugucagagugcgacucugucucaaaaaaaaaaaaaaaaagaguagaaauuauucacaauaguacaauaaagaauaaaauacuuaaaaauaaacuuuaucaaaguggcaaaagacacauaugcugaaaaccacaaaacauugcugaaagaaauuaaaggcacaauuaaauggaaaggcaucccaaguucauggaauggaagacuuaauauuguuaggauguugcuaugguuuaaauauguucccuccaaaguucagauguugccaaugugauaggaacuaagagauaauuaggccaugagggugcucccucaugaauaggauuaaggcccucauaaaggaggcuucaugaagcauucagcuagcuugcucuucuccucuucugccauguggggacauagcauuugucccuuucacccuuccaccuuccaccaugugagcacacagcaagaaggcccucaccagaugacagcaccuggaucuugagauucccagccuccagaacuguuggaaauaaauuucucuucuuuauaaauuacucaacguuuguuguaccccaaaauggacuaagacauaugucaauucuacccaaagcaaucucagauuuaaugcaaucccuaucaaaaucccaauggcuuuuuauuuuugcaaaaauauagaaaacuccauccuaaaauucauaugacauuuaaagggauuccuuuaaauagccaaaacaaucuugaaaaagaacaaauuuuuggaagucucacacacuuucugauuucaaaacuuacuacaaaggcacaguaaucaaaacaguguagugaucaaaacaguggcguaaagaaaaacauacagagcaauggaauagagaaaaauaacucuugcauauauggucaaaugauuucugacaaaagcaccaagaccauucaauggggaaagauaaucuuuucaacauacuggauaaccacaugcaaaagaauaaaauuggacccuuaccucauaccauauacaaaaacuaagucaaaauggaucaaagaccuaaaccuaagagcuaaaacucuaaaacucuuagacaaaaacaaaaggagaaagcuucauggcauuggacuuggcaacgacuccuuagauacaauacuaaaagcacaggcaacaaaaguaaaaauagauaagccugacuacaucaaaauuaaaacuucugugcaucaaagaacacaauuaacagagugaagagacaaacuaaaaaaugagagaaaauuuuacaaaucacauaucugauaaguauuuaauguucugaauaaauaaaaaaacuccuacaacucaauaacaaaaaauaaacaacccaauuuuaaaaauuagccaaggacaugaacagacauuucuccaaauaauaaaguagccaaaaagcacaugaaaagaugcucaacaucacuaaucauuaggaaaacauaaaucaaaaccacauuguugccaggcgugguggcccaugccuauaauccuagaacuuugggaggcuggggcaaaaagacugcuugaggccaggaguuugaguccagcccgggcaagagagcaagaccugucucuacaaaaauauauauauuuuuuaagccagguguggugguacacaccucuagucccaccuauguaggaaacugaggcaagaggauccccugagcccaggaguucaaggcugcagugagcugugauuguaucacugccuaggugacagagcaagacccaaucucaaaaacaaaaacaaaaaaaccacacacaaugaaauaccaccuuagaacuauuaggauggcuauuauaaaaaaaaaaaaaaacagaaaauaacaaauauugacaaagaucuggagaaaguggaaaccuugugcacuguugguggcaauguaaaauggugcagccacuguggaauacacuaugguggcuugucgaaaaaguaaaaauagauauaccauaugcuacagaauuccacuucucaguacauacaccaaauaacugaaaucagggauauuucguacauccauggucauugcagcauuauucacaauagccaaaagugggaagaaauccaaguauccauugauggauggcuuauuaaacaaaaugugguauagacauaucacagaauauuauucagccuucaguaggaaggaaaucacaucacgugguacaacaggaaugcaccuugagcauauuaugcuaagucaaauaagccagcuacgaaaagacaaauacuguaugauuccacuuauaugagguggucaaauucauagaaaccaaaagcagaaugguaguugccaggggcuggggggaaggagggaacagagaguuguuuaagggguacagaauuucaguuuuacaagaugaaaaaguucuggggauugguuguacaacaauguaaauaucuuaauacuacugaacuguacucuuacaaauaguuaaaagggucuuaaucuugucuuagucucaagacucuaaacuccaaagucgcauccaaauauuaucuaaaucagauauagguaagacucaaggugugggucauccugaggcaaaauuccuaacuaugaacaugugaaaccagacaaguuaugugcuuccaaaauacagccgugagacaggcauaagauagacauuccuauucuaaaaggaagacguaagaaagaaaggguaacaacucccaaguaaguccaaaacuuagcaagguaaauucuauuagauuuuagaaucuaauaaaaacacacacacaaugaaacaccaccuauuaggguggcuacuaaaaaucaauaaucuucuuugccuagaugcauugccuucuagauucacagaggugguggucucaccuucaggacccacugaagcgguaguucuaacuucuaggaccuacuggggcagcagccccaccccaauagcucuccugggcagagggucaacaccucaaagguuccagggggcuguagccccaaggaucaggcagcuguaccuccaagacucuggguggucccaccuccaaggccucugacaaaggccaugugguguuuaaacugaggcaauggccccauccuuugaaaccaaagagauaguucuaaacaucucugaaccccuuuuggggucauucuucccuuuucuugaagaauagcucaaauucacagccaaauagcucuguggucugguccuguaggauaucagaagucagacaggcuucuuucauucugccccuucuaguucaaacugguggugacuuugcugauguaaucucaucucuauuccuggcuucugccaagauagcuuguuaguuggugagucgcauccacaaucucuucaucaaaugguuguucagccacacucuuaguguucucuucaaaacaagcuuucucauuuuuugcaauauggauaagcugagaauuuuccaaaucuucagguuccgguuccuuuuugcuuaacaaguccuucuucauuuccucuuucucucuuuuucuauucuguuguaagcagucgggaggaaccaaggcauuucuucaauacuuuguacuuagaaaucuucucagcugaauaaacaauuucaucacucacaaguucuaccuuccacuagaacacacacagaucagccaauuucuuugccauuuuauuauauggaucaccuuuccuccaguuuccaaugacaucuuacucauuuccaucugagaccuuacaaaaaucacccuuaacguccauauuucuaccagguaccucaaaacucuucuagccucuaccuuuacauaguuccaaaggcacguucacauuuuuagguauuugcuacagcagcaccccacuucuugguaccaaaaucuauuuuggucugcucaggcuaccauaacaaaauaccauagacuggguggcuuguacaauaaaaauguauuuucucacaguucuggaggcuggcaaauucaagaucaaagugccagccaguuugguuccugauaagggcucucuuccuggcuuguagacagcagauuucuugcuguguccucacauauggccuuuccucaguaugugcacacagggagagagagaucucucuuuuugccucuucuuauaaggucaccaauccuacugaauuacgaccucacccuuauggccucauuuaaccucaauuuccuccaaaaguccuaacuccaaauaaauucacaaugguguuaaggcuucaacauacgaauuaugagggggcgcaauuuagcccauagcagaugggaaauuuuauacuauguauauuuugccacaauuuuuuuuaaguagaaauuauuacagauguuagguggacacaagcaacagggggaaaaacaagauagaaacaucuaaauuggauaaaccaauauccaauacaauggaauauacacaauggaauacuauuuagcuauauaaagaaaugagcuaucaagcuaugaaaagaaaugaaagaaccuuaaaugcauauugcuaagugaaagaaguccaccuaaaaaggcuacauacugcaaugauucuaaccauauauguaauauccuggaaaaggcaaaacuauagagacaauaaaaagaucagugguugucugggguuagggguggguaggaggguaagaaucaauacauauaacacaggggauuuuaggauagagaaacuauuccaugugauauucgaauauuugccaaggucacagaguuagcugggccaagacuuaaacucaagucucugacucccaaguucaugcucuuuccauuaaucuaaguugcuucuuuugauauggaauauaacaaagacuacauugacuaugaaaauauaaacuuaggggaggaaaaggcaacugggaaagaaaaaauauauccuuagucugucaaucagagaaaacuguuagcuugagcagcuucaacuugguuaaucaguaucccucucuucuaccauuaagaaagaauacguacuugcaaaagaauuaaggaaucuauccucucuuccaaagauguccgacggcuuuacgauaauggcuuccggaaaugcaucucucacuacuuucucuccaacagccuaaacaauaaccaaacaaaccuguuuugaguuuagagacaagugaauaaagcauccauucuuuccacuauuaagacaugacuuguauuucaaaggcgauauuuuccuccagauaaagguaaucauguaauucauaaaacucaguuacacagaacuuuuaaaaaauauaauccacaaaaauguccugcaccuuacagauuggguugggucucuuccaauuuuuuuauuuuaagggaagcuuacauugaagaaggagaaaaaucaaaguagaauuucuucagccuccauuuuuccuucuauuuacagauucucugguuugugucaaccaucuagcagccuguuagaaaaaggacaguaugguggcagcaggcugcaauaauggaagugucaccaguaccuacauauccaaaggagguuggggauagagucacuaauccuccuaaucucaauugcuguaccauccuuacuuguuaucaucuacuagccuccuaggcaagucuucuuguucgaugaagauaucagcaccuaauucagucuuccuuucuacuuccaccaccacuggaggugacaugauguccaagugggcuuggacuucucagguucuugagcugcucaacuccaacgaccuccucuuccuuccaccucuaccacucuuaacuugguuacaccaccuacuguaucaacaucuggaauugcucuucuucugagguauuaaaugaagacauccugcucuuggauguccauuuccuacaauuuccagccugcuuguucuuuguucaucugcuccugggauaccuguuucucaaccuucucaagaacucuagugcacugauucugcuuccccuguaucaacucuuccgacuguuccuguccuucccucugaauuccagauuagguuccauagaccaucuucucaucacucucuugccaauauuguaaacuaccuugucccuuuguccuuuacucuagccaccaggcaaaauucuaauccuagaagaacuccauuggccucccuugggccaugcacucccacugucuugagcagcuggcaggaaaauaaaucaauaaaaaccaugaauugguaccacuauaaauucaugccuccaauuuuaaccaggcccucaacauuucccaaaaaccguguuuuccucuaauuaacuuacuuucccaugagacaauuugaaacauuuucuacuguauucaaauuucagacaucccuuucuuuucucuuccuuccaguaaaugacucugccuucuaauaaaagagaaaauguaagacaguagaggaaaaaccaccucaaguucucaccacuaaaucuacaaaccccgguauauaaagcacaauuuucuccuccucucuuaccugaugggaggaacagugccacuuucaaugcuuuagagcucauguccuuucacuuuuucaggaaccuguccaauuuacucucucuuccacauccucagccucacucuuuuuaccagcaucucccuaccagcauguaaacaauguagauccucuaccuuaaaaaaaaacauaccaacuccacaucccccuccagcuucuauccucucagucuuucaucuuccucuugccagucaagcuaccugaaaauguaccuacccuuaccauucccacuuccucaguuccaacucacucuucacgcacccgcauucuggauucugcuccaaccacugcacucaaucuauucuugauaagaucaccaaugaccuccaugucaguagauccaaggagacuuuacaguuaacauuugcuugacuucucaauggcauucauaaguauucacuuccuccugugagacugucuggccauggcuucccuagcacuguacucuccugguuucccuuccgccuuaucauguccugcuuagucuuucuguuugauugguuuggguuucugcaggugccuccuucucuaccagauuacuaaccauugguauguucugggcccaaucugaaacuaccuucucaaucuucagccaucuuauccucucucaucacuuaaauuaacaacaaaugcugguaacucccacauuucugucuccaacccagaccucucuucugaccuccaggaucagaaacccuauauaccaguuacuuggaagauugacacacaucugaaaugcaccugaaacgugaguccaaaacucaaucaucuuccauucucucaaguaaaauagugcuccucaaucuuugcugcacucagaauuaccuagacagaguuaaaaaauacuggugcugaaguugcaaccccagaaauuguuuuaauuggucuggagcgcagccuaggcaucagaauuuuuaaaagcucccucagugguuuuaaugugcaacuaaggcuaagacucacugcccuacagccuagucccucccaagcauuucccaucuuauucaacaguacuaucaucuacccaguggcuucagccagagggcuggacaucuuugacucuucucucuuccucaccauugacaccucccauucccuuccagucaugaaauucugaugauuuuaugaauguuugggcagaggcaggcacaagcauucucucucuuauuuucucucuauuuacuaccguagccacagugcuuaacacaauaugugacacacaguaggugcuuaaugaauaguuuauccaguaaacuaauguggugagucaaaaacuuggaaccauuaucaaggaacucucuuguccuuaucaguaugacuccaaacaggcuuccauauggcagaauccaaauguuaagcgcacggccagacacugauaucccuucugcgucccugauaaugaacacguuucacuuaggcuacagacugacuccaaacuacaguggucagucucuagguauggcauuucugggaguaaaaggagcauaagcacugugugaauaggcaucuucccuggcaaauauuaaucccugucauucugagccuucacauugccccuuuaagaguggcacaaaaccacugcagugcaaggggugagaaagaaagaugguccuuuaaccaugguagaugacacagguaugauuccuuuggcagaaaucugugaugguuucuguauaauucaaugaugccccaaagaaacuuuaaguaucugaaugccaacaguaacauggucuagccaacuccgaagccccauagcacaguucccugcaaacagaaggcaaucaaucaaaacgucaaaacaucacacacaccccuaguucuggaugcagggaaucagaaaaccuuuuaauucuacauaugucugugauaaacccuucucacugaaaucauguuucaaauggcccaagaaacucuggcucugugaaccacuucccagaucaauuuguuacuuaccuuauuucucaaauaucuagaagagcuuuuaauauucgcauucagaugugaaacaugaaugaauuuuucaacuccagcuuccuuggacaguugagcaauugcuuggggaaucuucacaaaaacauccucaaaaucaaaguuucuggaagauaaaaaauaaaaggauugguuaagaacuccacacacaggaucucaaagcuuuacgugauaagaugguuuucauaacaguacugaaauucacacuacuuaaacuuuuaaacagcaaugauuuaacuuaaagcuaaauuuggccaggugugguggcucaugccuguaaucccagcacuuugggaggccaaggcgggugaaucauuugagcccaggaguucaagaccagccugcacaaaacaguaaaacccugucucuauuucuaaaaaaagaaaaaaaauuuuuaauuuuuuuaagcuaaaauuauuuuuuuaaaaaaguugacagcucugcugucauuacucuacacaauuuaaggacuacuuuaaguuagaaauccaguauacuucauguucugcauuaucagggaauccugaggcugaggcccuuuaaagaaaccuggccguacuggcugcugaaguguuaggaaucacuucuuaccccgggacuuuguuucccgcaagggaaaaaaaagaaacuaaaaacaagucagucaacaauuucauucgguaacguuaacuaaauguuuacucuguacaauacacuauguuaaucauuaggggggauaaaaaguugaauaagacccccaagucaucaaagaauuuauaaaauauuugaugagaagacacauauuaaaaaacuaagucaaauuuuaacacuauaaaaagagguguaaacaaaguguuguggacuauaggauugaaacauuauuuguuaauaaacaauccauacaaagaacuguucaaauuaguccucacgccaccuccaauuaacaaugcagaaaagacaucuagaacacugucuacacaagaaaaaccaaaguucagcuugcuaaacagcagaacaggcaaaauccuauuucuuaaccccaucccauagggacugauccaaguacaggaccaacagcagccacaccaauaccaccuacuggcuuuuuaugggcaguauaucacacugcugacuuauaccagacuuaaugucagcuacaucuccucaggggugucacuggguaugcaagugguuguucaaccaacccuuauucacuaauugaaaaugucacugugauagcuggcacauaaaaggugcccagcgaagguccauuaaacccuaagaaagacuuaagcaaagaagaaacaagagucaaagacuuacuugguuucccagucucguccaauaagauugaugaccacauugcuguguuguacuacucgucggauagaaucuuuaucucucgcgucccauuccuauaauagcagaaagcaaucggaugaaaacauagggguauaccucagcacucaacacuucugcagccuccucaaugcaaguuucaaaaugggccaucugcuguagucauaauauagugccauuucauccaagcuccauuuauuacaacagaaaugacaucucagacucccugcugauucccucacucuuuccgagacaaacagguaacaguacacuuuacucagguaaucaaaugacagagcuaaaaaggaggcuauugauuuuuaauggagcauauuaguuuuuguccacccaacuacuccuuacuaaguuugaaaagaaacccaggaaaccaagucuccaauccugaaauacagacaaagaagcaaggaucauuagggagauagacuuucccuucuugacagcaaccacuuacagacugaagauaggaagagugucuuuuaaagacuaguguuaguuggggccauucaugacuauuuucuuauuucuuuuuaauucuuuccucuuuuauaaccccagaucuaguaauuucuccauuaacaacauaaaaacaagagucaaagagaacuaccuaaaacuucagggugagccaagggcagguuucuauaagcauuucaauggaagauaacaaguaauaagaauuucuuagcaccaaauaauaagugcacaugcaugagucagugcaauaggaaggagacagagcaagaagggaaaagagaaagaaaguggggaugaaagagaaagagagagaacuaggaugucuguuuaauuuaggaaagagaaaacaaacuauaaaaucagauucaagaacaaaaagaugaagccccagcaggaagaaccaguuaggacugaugauagaaaguggguuaaaagacacagucuaaacaguggcuuuggagucaaacagacaggaaugcaaaucccaguuugccauauacuaacuuuguacaaauuaucucuucaaaccccauguaaaauuagaaaacacaacuuaccucacgagguuauuaugacgauuaagugaaauauacauaaaaucuacagcagugagugauguaauaaaaggaaaccaaauuuucagggcuaaggcccaagggcacacagucaggugggcaaaccaaguggacauucagacagcagaugcaaacaaagacuaaagcggggaaaucagcaccucacaccccaaauaguccuucucgaaaauaaacacauaaacaaacacuaaacauacaagucucugaguucccuguggucuuggucauccaaacgugcucagagcacaggucaaugcuagacauucaggaaauaaaucucugcagaaauaauggaauagaugucauuugguuuaauuccaaugguucaaaaguuuucaccuaucacuuuuuaaauacuucaauuuugaggcucugacaaggugaccaacaaacuugagggacaaagaacuaggaauaagcuaagauucuguaacuuuaauaccaagaauauacuuaauaguaagauuuuggagaagaaaaacauuuuggaaauaagaaauuucugauacaaguauuauacuuagcuugugaacacugagucaagaauaaaugaaaaugugaaaaugaaaugaaaauaaaucaaaauuuaaagggauuacaaauaaucuguaugaauauuaccagagauaguaagaaaguuuagcaaguauuuuuuaaaagggaaaauguauaacuccauuccuuacaggacaacacaaguaggaagucagcuauaagaucaguagauuuaagcaucaaggcccagacaguaucgcaaucaauagcuuggcugcaggcauuuggggcagcacaacucuuuguggaaagagacuguccugugcuccguaggauauuuagcaucccugugccuguaccuaauaaccaggacagcuccccaaucacugugacaaucaaagaguuccauuaaucacucccuuaauggcccuccucuacccucuuuccccugccucaccgcauuggcaacuacugcccuaaagaaccuguagauuaaaggacgacaaagggaaugcucagaaaggacuguucuaaguuaaaucuauacuaaacaaccaaguuauaaaacacccuauuugugauuuuuuuauguuuauagagcacuauucaauagaaauauaacaugaggcacauagguaaaaaagaaacaaguaaaauucauuuuaauaauacauuuuauuuaaccuaauauauccaaaauauuauuuuaauauguaacaaauauaaaaaauuguuaaugaugaaucguauauuguuuucuucauacugagucuuugaaaucuaguguauauuuuauacguacagcauaucucaauucagacuagccacauuucaugugcucaguagccacauguggccaguggcuaccacacuggacagcacaggucuagagcagggauugauaaacuauaguccauaggccaaauucagccugcagccucauuuuguaaauaaaauuuuacugaaaugcagccaugcccauuuguguacauauugucuauggcuacuuccaguuacaagggcagagcugaguaauuaugacaaagacucuacgaccugcaaagccagaaguauuuacucucugucccuucaaagaaaaaguuugccaacugccaaucuagagcuugcaugacaaaggagaugccggaaccuagcugaaagaaugaccugggaacagaggaugccuuugguccauucugggaagaaauuacugcuuuauuauacugccuaucacuccuaaaaaugaccuuaguaauuuauauuugucaacuucauucagucauaaaggcccuuaccagaaacagaagcuggcccaggucacccaugggacgaaggugcaugaugucauauuuaucacaccgauaggguaugauuaccugugaccccaugcguccuaaaagagaauggauugaaaaaaggaucaacauuaacauaauguggauauauuauacaauugugacuugguaaauauuuaaauucuaguaugguaugugaauugauauuauauuugacaaaaagaauauuuugccaugcuaaagaugccauagcuuuucagagucccuuauuccuauccuaauaauuccuauauaggagcaugagugugcucuucaugucacaacaaauaaaaauuacauacauccaagacaggaguaauucauaauacuguuaaaaugaagagaaacauagcucaugcuucucaucaggcaauccugaucaauggcaauggagcauaugaacuuaaggaacuuuacuuaccaaggugguugacaacauaucgccccaggaauccuguugcuccaaacacaguggccacaaucccacugacugaggaacguccaccuuucccaugaggcaugagggcaugaugaagcuggcgacagggugggccgugacacacagauguggcuauugcaguaauggcagaaccuuaaacaaaaccccaaaguauacaagcauggcaaauauuaauauuuuuaaaacugucaacacaaauagcuccuuucucuaaaaacuuguaacauuauuuugcaaucaguacuuuagcaauuuaaguaucaagggcaauaauaaacacaaacuacuacgacacagaauccagaggacaugaggaaauauacucccuacccuauacaauguaacuuaccuaagaagauaagucacauuuuuuaaaaaacauauuaaacagucacaaaguaggaaagcauaagccuauacgguaaaaggaacugagaauauguaauaaaugagcaauaaaucacauuaccaugaggaaguauuccuggauaaaauguuuugagaaaggucuuaaaagaggaaaaaaaaaagaaaggacagaaucccaugaggaacacaucacaaugcagagguagaaugaauaagccuacagcacagggcaacagcaaaagacucuccuggaacagaaucugaaacuggugacuaaugaaaaauaagguugaugauacuggucggaagcagaugauuauuaguacagaacauuaaaaaaaaaaaaaaagaaugcaguucaauaguucagacuuacuauaaaaccacugaagaacaucacaaauaaugauaaaaggagugaagugcuugagaaaagauauucugacuuuuagaaaguuuaacagcaagagacuugucaaacauuccaccauuucuuuuucauugacugagguucuugguacuagaaugaacccucaaaguucauguaccaaugcuuacaucuucucuacagcaugugugcaaagaaaucaucuggcuuuugccugaacaccuguggaguugggaaacucacuacuuccuguagcugcccauucugcuuugagccauucuaacagaaagaaaguucuaccacaaggggaaucagugacugcuucccagaaguuuuuaucccuguguuccuccagaaugacaaagaacaagucuaaucccucuucuacaauuaaguguagcaauuauagccccacuaaauauuuucuucuccagguuaaacauucccuguccugucaaauauucuucauauggcaggaaugagaaucucuuuuggauacauuccaguuuucaaguuauugcuaacuccuuagaauagaauuuuagaguuagcugcucaacuuucauguaaguagaaacaaaaagguuuaaagugcuaacgcacuucugcuccaaucaacaaacuucggagcuuagcauucgugcuuuguacacuugggagaggugaaagacacaaacaggacuuucuuuagaaaaucuguguuuguuucuagggaugacuuucagguggcauucugcccaaaggucauuguucuucccuauccaaaaguauugaauuggagaaauagccuagcucacugauagugacagaaauuaaaaguaaacaucauggaccacacaucauaauaacaaaauaauaacaucauauuaacagcuaccuuuacagagcucuuggcagguguccagcauuauucuaagugcugcauagguauuaucuuuuuuaaugcuaucuuuaucaccacuuuauggauaagguuagugacuagcccaaagcacuaguaaaggagauuaaaaagcagucccaugagguaggagaaaaacucagaaggaaacagaaucuaaaaacccaaaauaagaaacuguuucaaggagagaaugguuaacuuuaccaaaugcugaaagugaaguaggaagaggacagaggaccacagaagcuggaggauguggcuguagguggcauaaauaagagcaauuuuauuggauuagugggacugaaagccagacuggagcaaacaagagaggcugugaggcaaggaaguagaugaggaguauacacaauccuucugaaaaaggagaaauggaacuagagaaaacaaggacaggaauagguuuguuuguuuguuuuaaauaugaguuaacauuuaugugcugauggaaaugacaugauuuccaugguagagguagaaaauuacugauucaggaaagggaaugaauaguugagagaggauaagauugaaugcaaagugaaggaacuggccacagauuggaacagaaggagcucacccacuguaacaagagaaaaggcaaagaauuaucacauaucaacuauuagaguuuauggugggaaaaugacuguucucaucugauuccuuugauuucucuguaaagcugagaaugagacaaaagcacauguuagagguuuuaggaaacucgcuauguuaaguaaugauuauggagacaaggaaaccaaauuuccuagaaaaauguagcacugaaaaucuacuugagauuuguauucaugaauuuaaaauaaggccaguuagucugaaguuuucccuagccccguucuccauugcucaguggcaggcagcaaauuacguggaaaguuuuguuuaaucagggucaauguuuuuuacgacaaugggaguugggcuggggaguugaggaugcauaaaagggaaugauaagagugaagaguaaggaaaugaggacauaggauaagacaggcaaaagauggcagagucaaugaacugggaagaauuacuugaguugaggaauuaauaccucaaaggacuguuaagaggauuaaacauacauaaaccacguagcacauuaccuagagcacauuaagcauucuaugaauaauaguugcuuuuauuacuuugaaauuucucagaagguaaugucacacuaaccucacauggcuauuguuuuuuuuuaauaauuaugggccaagaauuauucuagaaacugugacuaucacaguaaaauacaaaacccuggcuucaugaagcucacaguuuaaaggguuaaugagaauaacauaugggcaagcaucugucacagugccuugcaaauacuaggugcucaauaaauauaaauuauuacucucuuugguuccagccucuccacuuucuuccauuuauuaugaguacuauuagaagaaugauauucuuuauuaauuauauauucauuauauuucucugcuuaaaaaccuacauuaguuuccuacugcaauacccaaaccaauaguccagacauauuugcuugcacacugcauuaauuuuuuuaaguauuuauuuaaaaaauuauaugcacguucuauguaguaccaauaugauauacacauuauaaaucauacauuacuuagaauaguguguggcauacaguuuaaacuacauaaguguuagcuauuauuacuauagaaagcaauuuuuaggaguucuaauuuauauuuccacaacuuauuagguccucuugcacaacucccuuuggagacuaccgaucuaaacucugcuuggcuuucaaaggucuccauugucugaucccaucuaacacauucaaccuccuuuuccacuaucccagauauucagguagucauuucacugccucuugaauaccucaugacuccauucucacccacuugucuuugccagaggacuuuccagaucauaacagcccuaaagagaccagugggagcacuacaauucuccacuggucuuccaaucaucccucaguaccucaaaugauacuaaucuuucccuuuuaugauuuccugugauacuuaauagucuugccacacuuaacuauauauaguugucuuacacaguucuguccuauaguguguggauuauguuacauacuagacuugccucuacagaauuuacucaaaaacuuacuuuaccagacaauaacgcagagugguuaagaacacaagcuauggugucagucagaggaaaguaaguuaaaagaggaaaauuaauaaaaauaccuagaacuggagauugcagauagcagguacucaauaaauagugauuaccauucacaaucuacauuacgucauacaauuguaauaguuuaacaagaaccagcaaaugucuuugcaaagacauugugacuacaaaaccauccacuauaagugaugugcaccaccaccuucccagugguaugcaggaguucuacccaagauggaaaacaaaaaaaaaaggauccucuaaacacuccuaauucuugccucaggcugaacaucaagccuaucuguggugcuuuuaaaaauuuaaggugcaaggagcuaaucucacaaauucugacucaauagcucuacacucaguccucauuucuaauuuuuauaaagcuuuacgagugauucugacaugagccaauuuugaaagcaaaugauauucuguaacgacuaaaauacacuaagaaaaauacaacuuuggggguuugauuggaauauguuuguggaagaguagagggugaaaggacaaugaugaaguguaaccguauuucuaauuuccuugcuuuuuagugaguggaaggacaaauguauguuuucaguuugaggagugggagcagauccaaucagaacagaagagaaacuaaauaaugcuaacaaauucuaacauagccuucauucuucacuuuccuuuccaccaagcuccugauucuucucuccucaaacaucacucucucccccagaccccaacgcacuuugccgaacacauucuacauccguagagacgcuuuuggguaaaaggaugcuuuuacaaauauuagcucauuuaaucuuaucagagacucccugguauuguaauauuaucauuuccauugugcucauaugaauugagacccauuaaggguuugcacaaggucauaaaaucaaucuaagaaaaccucucgccacuagccuuuuuucccucccuuacacauuucuccccccgccccauacaaauauuucucauaacccuaaacccuuacaaccauaucagaauucugauucucucgaucccuaacgugucccccgcauucuccucuucgcuuacagcugcuuaagaucuuuuguccccucccaagguggugcacaauugaauaugugagccggggaagcggaaagcgaaaggagaaaccagacugaggcagcuccaaaccuagagaaaccagagugugccuaggaaguuggcgugaccgcugcagcacggugccacuuccaaaaccuuaaauccccgucucggaaucccgaccaggggccgccguucccgguaacacuuacgugacauugacaggacccggacaacccgggauugugcggcagccgccaucuuuucccacaaucccccacgacagcacu

SEQ ID NO: 191699 - RNA, 38457 nt, Homo sapiens
agugcugucgugggggauugugggaaaagauggcggcugccgcacaaucccggguuguccggguccugucaaugucacguaaguguuaccgggaacggcggccccuggucgggauuccgagacggggauuuaagguuuuggaaguggcaccgugcugcagcggucacgccaacuuccuaggcacacucugguuucucuagguuuggagcugccucagucugguuucuccuuucgcuuuccgcuuccccggcucacauauucaauugugcaccaccuugggaggggacaaaagaucuuaagcagcuguaagcgaagaggagaaugcgggggacacguuagggaucgagagaaucagaauucugauaugguuguaaggguuuaggguuaugagaaauauuuguauggggcggggggagaaauguguaagggagggaaaaaaggcuaguggcgagagguuuucuuagauugauuuuaugaccuugugcaaacccuuaaugggucucaauucauaugagcacaauggaaaugauaauauuacaauaccagggagucucugauaagauuaaaugagcuaauauuuguaaaagcauccuuuuacccaaaagcgucucuacggauguagaauguguucggcaaagugcguuggggucugggggagagagugauguuugaggagagaagaaucaggagcuugguggaaaggaaagugaagaaugaaggcuauguuagaauuuguuagcauuauuuaguuucucuucuguucugauuggaucugcucccacuccucaaacugaaaacauacauuuguccuuccacucacuaaaaagcaaggaaauuagaaauacgguuacacuucaucauuguccuuucacccucuacucuuccacaaacauauuccaaucaaacccccaaaguuguauuuuucuuaguguauuuuagucguuacagaauaucauuugcuuucaaaauuggcucaugucagaaucacucguaaagcuuuauaaaaauuagaaaugaggacugaguguagagcuauugagucagaauuugugagauuagcuccuugcaccuuaaauuuuuaaaagcaccacagauaggcuugauguucagccugaggcaagaauuaggaguguuuagaggauccuuuuuuuuuuguuuuccaucuuggguagaacuccugcauaccacugggaaggugguggugcacaucacuuauaguggaugguuuuguagucacaaugucuuugcaaagacauuugcugguucuuguuaaacuauuacaauuguaugacguaauguagauugugaaugguaaucacuauuuauugaguaccugcuaucugcaaucuccaguucuagguauuuuuauuaauuuuccucuuuuaacuuacuuuccucugacugacaccauagcuuguguucuuaaccacucugcguuauugucugguaaaguaaguuuuugaguaaauucuguagaggcaagucuaguauguaacauaauccacacacuauaggacagaacuguguaagacaacuauauauaguuaaguguggcaagacuauuaaguaucacaggaaaucauaaaagggaaagauuaguaucauuugagguacugagggaugauuggaagaccaguggagaauuguagugcucccacuggucucuuuagggcuguuaugaucuggaaaguccucuggcaaagacaagugggugagaauggagucaugagguauucaagaggcagugaaaugacuaccugaauaucugggauaguggaaaaggagguugaauguguuagaugggaucagacaauggagaccuuugaaagccaagcagaguuuagaucgguagucuccaaagggaguugugcaagaggaccuaauaaguuguggaaauauaaauuagaacuccuaaaaauugcuuucuauaguaauaauagcuaacacuuauguaguuuaaacuguaugccacacacuauucuaaguaauguaugauuuauaauguguauaucauauugguacuacauagaacgugcauauaauuuuuuaaauaaauacuuaaaaaaauuaaugcagugugcaagcaaauaugucuggacuauugguuuggguauugcaguaggaaacuaauguagguuuuuaagcagagaaauauaaugaauauauaauuaauaaagaauaucauucuucuaauaguacucauaauaaauggaagaaaguggagaggcuggaaccaaagagaguaauaauuuauauuuauugagcaccuaguauuugcaaggcacugugacagaugcuugcccauauguuauucucauuaacccuuuaaacugugagcuucaugaagccaggguuuuguauuuuacugugauagucacaguuucuagaauaauucuuggcccauaauuauuaaaaaaaaacaauagccaugugagguuagugugacauuaccuucugagaaauuucaaaguaauaaaagcaacuauuauucauagaaugcuuaaugugcucuagguaaugugcuacgugguuuauguauguuuaauccucuuaacaguccuuugagguauuaauuccucaacucaaguaauucuucccaguucauugacucugccaucuuuugccugucuuauccuauguccucauuuccuuacucuucacucuuaucauucccuuuuaugcauccucaacuccccagcccaacucccauugucguaaaaaacauugacccugauuaaacaaaacuuuccacguaauuugcugccugccacugagcaauggagaacggggcuagggaaaacuucagacuaacuggccuuauuuuaaauucaugaauacaaaucucaaguagauuuucagugcuacauuuuucuaggaaauuugguuuccuugucuccauaaucauuacuuaacauagcgaguuuccuaaaaccucuaacaugugcuuuugucucauucucagcuuuacagagaaaucaaaggaaucagaugagaacagucauuuucccaccauaaacucuaauaguugauaugugauaauucuuugccuuuucucuuguuacagugggugagcuccuucuguuccaaucuguggccaguuccuucacuuugcauucaaucuuauccucucucaacuauucauucccuuuccugaaucaguaauuuucuaccucuaccauggaaaucaugucauuuccaucagcacauaaauguuaacucauauuuaaaacaaacaaacaaaccuauuccuguccuuguuuucucuaguuccauuucuccuuuuucagaaggauuguguauacuccucaucuacuuccuugccucacagccucucuuguuugcuccagucuggcuuucagucccacuaauccaauaaaauugcucuuauuuaugccaccuacagccacauccuccagcuucugugguccucuguccucuuccuacuucacuuucagcauuugguaaaguuaaccauucucuccuugaaacaguuucuuauuuuggguuuuuagauucuguuuccuucugaguuuuucuccuaccucaugggacugcuuuuuaaucuccuuuacuagugcuuugggcuagucacuaaccuuauccauaaaguggugauaaagauagcauuaaaaaagauaauaccuaugcagcacuuagaauaaugcuggacaccugccaagagcucuguaaagguagcuguuaauaugauguuauuauuuuguuauuaugaugugugguccaugauguuuacuuuuaauuucugucacuaucagugagcuaggcuauuucuccaauucaauacuuuuggauagggaagaacaaugaccuuugggcagaaugccaccugaaagucaucccuagaaacaaacacagauuuucuaaagaaaguccuguuugugucuuucaccucucccaaguguacaaagcacgaaugcuaagcuccgaaguuuguugauuggagcagaagugcguuagcacuuuaaaccuuuuuguuucuacuuacaugaaaguugagcagcuaacucuaaaauucuauucuaaggaguuagcaauaacuugaaaacuggaauguauccaaaagagauucucauuccugccauaugaagaauauuugacaggacagggaauguuuaaccuggagaagaaaauauuuaguggggcuauaauugcuacacuuaauuguagaagagggauuagacuuguucuuugucauucuggaggaacacagggauaaaaacuucugggaagcagucacugauuccccuugugguagaacuuucuuucuguuagaauggcucaaagcagaaugggcagcuacaggaaguagugaguuucccaacuccacagguguucaggcaaaagccagaugauuucuuugcacacaugcuguagagaagauguaagcauugguacaugaacuuugaggguucauucuaguaccaagaaccucagucaaugaaaaagaaaugguggaauguuugacaagucucuugcuguuaaacuuucuaaaagucagaauaucuuuucucaagcacuucacuccuuuuaucauuauuugugauguucuucagugguuuuauaguaagucugaacuauugaacugcauucuuuuuuuuuuuuuuuaauguucuguacuaauaaucaucugcuuccgaccaguaucaucaaccuuauuuuucauuagucaccaguuucagauucuguuccaggagagucuuuugcuguugcccugugcuguaggcuuauucauucuaccucugcauugugauguguuccucaugggauucuguccuuucuuuuuuuuuuccucuuuuaagaccuuucucaaaacauuuuauccaggaauacuuccucaugguaaugugauuuauugcucauuuauuacauauucucaguuccuuuuaccguauaggcuuaugcuuuccuacuuugugacuguuuaauauguuuuuuaaaaaaugugacuuaucuucuuagguaaguuacauuguauaggguagggaguauauuuccucauguccucuggauucugugucguaguaguuuguguuuauuauugcccuugauacuuaaauugcuaaaguacugauugcaaaauaauguuacaaguuuuuagagaaaggagcuauuuguguugacaguuuuaaaaauauuaauauuugccaugcuuguauacuuugggguuuuguuuaagguucugccauuacugcaauagccacaucugugugucacggcccacccugucgccagcuucaucaugcccucaugccucaugggaaagguggacguuccucagucagugggauuguggccacuguguuuggagcaacaggauuccuggggcgauauguugucaaccaccuugguaaguaaaguuccuuaaguucauaugcuccauugccauugaucaggauugccugaugagaagcaugagcuauguuucucuucauuuuaacaguauuaugaauuacuccugucuuggauguauguaauuuuuauuuguugugacaugaagagcacacucaugcuccuauauaggaauuauuaggauaggaauaagggacucugaaaagcuauggcaucuuuagcauggcaaaauauucuuuuugucaaauauaauaucaauucacauaccauacuagaauuuaaauauuuaccaagucacaauuguauaauauauccacauuauguuaauguugauccuuuuuucaauccauucucuuuuaggacgcauggggucacagguaaucauacccuaucggugugauaaauaugacaucaugcaccuucgucccaugggugaccugggccagcuucuguuucugguaagggccuuuaugacugaaugaaguugacaaauauaaauuacuaaggucauuuuuaggagugauaggcaguauaauaaagcaguaauuucuucccagaauggaccaaaggcauccucuguucccaggucauucuuucagcuagguuccggcaucuccuuugucaugcaagcucuagauuggcaguuggcaaacuuuuucuuugaagggacagagaguaaauacuucuggcuuugcaggucguagagucuuugucauaauuacucagcucugcccuuguaacuggaaguagccauagacaauauguacacaaaugggcauggcugcauuucaguaaaauuuuauuuacaaaaugaggcugcaggcugaauuuggccuauggacuauaguuuaucaaucccugcucuagaccugugcuguccagugugguagccacuggccacauguggcuacugagcacaugaaauguggcuagucugaauugagauaugcuguacguauaaaauauacacuagauuucaaagacucaguaugaagaaaacaauauacgauucaucauuaacaauuuuuuauauuuguuacauauuaaaauaauauuuuggauauauuagguuaaauaaaauguauuauuaaaaugaauuuuacuuguuucuuuuuuaccuaugugccucauguuauauuucuauugaauagugcucuauaaacauaaaaaaaucacaaauaggguguuuuauaacuugguuguuuaguauagauuuaacuuagaacaguccuuucugagcauucccuuugucguccuuuaaucuacagguucuuuagggcaguaguugccaaugcggugaggcaggggaaagaggguagaggagggccauuaagggagugauuaauggaacucuuugauugucacagugauuggggagcuguccugguuauuagguacaggcacagggaugcuaaauauccuacggagcacaggacagucucuuuccacaaagaguugugcugccccaaaugccugcagccaagcuauugauugcgauacugucugggccuugaugcuuaaaucuacugaucuuauagcugacuuccuacuuguguuguccuguaaggaauggaguuauacauuuucccuuuuaaaaaauacuugcuaaacuuucuuacuaucucugguaauauucauacagauuauuuguaaucccuuuaaauuuugauuuauuuucauuucauuuucacauuuucauuuauucuugacucaguguucacaagcuaaguauaauacuuguaucagaaauuucuuauuuccaaaauguuuuucuucuccaaaaucuuacuauuaaguauauucuugguauuaaaguuacagaaucuuagcuuauuccuaguucuuugucccucaaguuuguuggucaccuugucagagccucaaaauugaaguauuuaaaaagugauaggugaaaacuuuugaaccauuggaauuaaaccaaaugacaucuauuccauuauuucugcagagauuuauuuccugaaugucuagcauugaccugugcucugagcacguuuggaugaccaagaccacagggaacucagagacuuguauguuuaguguuuguuuauguguuuauuuucgagaaggacuauuuggggugugaggugcugauuuccccgcuuuagucuuuguuugcaucugcugucugaauguccacuugguuugcccaccugacugugugcccuugggccuuagcccugaaaauuugguuuccuuuuauuacaucacucacugcuguagauuuuauguauauuucacuuaaucgucauaauaaccucgugagguaaguuguguuuucuaauuuuacaugggguuugaagagauaauuuguacaaaguuaguauauggcaaacugggauuugcauuccugucuguuugacuccaaagccacuguuuagacugugucuuuuaacccacuuucuaucaucaguccuaacugguucuuccugcuggggcuucaucuuuuuguucuugaaucugauuuuauaguuuguuuucucuuuccuaaauuaaacagacauccuaguucucucucuuucucuuucauccccacuuucuuucucuuuucccuucuugcucugucuccuuccuauugcacugacucaugcaugugcacuuauuauuuggugcuaagaaauucuuauuacuuguuaucuuccauugaaaugcuuauagaaaccugcccuuggcucacccugaaguuuuagguaguucucuuugacucuuguuuuuauguuguuaauggagaaauuacuagaucugggguuauaaaagaggaaagaauuaaaaagaaauaagaaaauagucaugaauggccccaacuaacacuagucuuuaaaagacacucuuccuaucuucagucuguaagugguugcugucaagaagggaaagucuaucucccuaaugauccuugcuucuuugucuguauuucaggauuggagacuugguuuccuggguuucuuuucaaacuuaguaaggaguaguuggguggacaaaaacuaauaugcuccauuaaaaaucaauagccuccuuuuuagcucugucauuugauuaccugaguaaaguguacuguuaccuguuugucucggaaagagugagggaaucagcagggagucugagaugucauuucuguuguaauaaauggagcuuggaugaaauggcacuauauuaugacuacagcagauggcccauuuugaaacuugcauugaggaggcugcagaaguguugagugcugagguauaccccuauguuuucauccgauugcuuucugcuauuauaggaaugggacgcgagagauaaagauucuauccgacgaguaguacaacacagcaauguggucaucaaucuuauuggacgagacugggaaaccaaguaagucuuugacucuuguuucuucuuugcuuaagucuuucuuaggguuuaauggaccuucgcugggcaccuuuuaugugccagcuaucacagugacauuuucaauuagugaauaaggguugguugaacaaccacuugcauacccagugacaccccugaggagauguagcugacauuaagucugguauaagucagcagugugauauacugcccauaaaaagccaguaggugguauugguguggcugcuguugguccuguacuuggaucagucccuaugggaugggguuaagaaauaggauuuugccuguucugcuguuuagcaagcugaacuuugguuuuucuuguguagacaguguucuagaugucuuuucugcauuguuaauuggagguggcgugaggacuaauuugaacaguucuuuguauggauuguuuauuaacaaauaauguuucaauccuauaguccacaacacuuuguuuacaccucuuuuuauaguguuaaaauuugacuuaguuuuuuaauaugugucuucucaucaaauauuuuauaaauucuuugaugacuugggggucuuauucaacuuuuuauccccccuaaugauuaacauaguguauuguacagaguaaacauuuaguuaacguuaccgaaugaaauuguugacugacuuguuuuuaguuucuuuuuuuucccuugcgggaaacaaagucccgggguaagaagugauuccuaacacuucagcagccaguacggccagguuucuuuaaagggccucagccucaggauucccugauaaugcagaacaugaaguauacuggauuucuaacuuaaaguaguccuuaaauuguguagaguaaugacagcagagcugucaacuuuuuuaaaaaaauaauuuuagcuuaaaaaaauuaaaaauuuuuuuucuuuuuuuagaaauagagacaggguuuuacuguuuugugcaggcuggucuugaacuccugggcucaaaugauucacccgccuuggccucccaaagugcugggauuacaggcaugagccaccacaccuggccaaauuuagcuuuaaguuaaaucauugcuguuuaaaaguuuaaguagugugaauuucaguacuguuaugaaaaccaucuuaucacguaaagcuuugagauccuguguguggaguucuuaaccaauccuuuuauuuuuuaucuuccagaaacuuugauuuugaggauguuuuugugaagauuccccaagcaauugcucaacuguccaaggaagcuggaguugaaaaauucauucauguuucacaucugaaugcgaauauuaaaagcucuucuagauauuugagaaauaagguaaguaacaaauugaucugggaagugguucacagagccagaguuucuugggccauuugaaacaugauuucagugagaaggguuuaucacagacauauguagaauuaaaagguuuucugauucccugcauccagaacuaggggugugugugauguuuugacguuuugauugauugccuucuguuugcagggaacugugcuauggggcuucggaguuggcuagaccauguuacuguuggcauucagauacuuaaaguuucuuuggggcaucauugaauuauacagaaaccaucacagauuucugccaaaggaaucauaccugugucaucuaccaugguuaaaggaccaucuuucuuucucaccccuugcacugcagugguuuugugccacucuuaaaggggcaaugugaaggcucagaaugacagggauuaauauuugccagggaagaugccuauucacacagugcuuaugcuccuuuuacucccagaaaugccauaccuagagacugaccacuguaguuuggagucagucuguagccuaagugaaacguguucauuaucagggacgcagaagggauaucagugucuggccgugcgcuuaacauuuggauucugccauauggaagccuguuuggagucauacugauaaggacaagagaguuccuugauaaugguuccaaguuuuugacucaccacauuaguuuacuggauaaacuauucauuaagcaccuacugugugucacauauuguguuaagcacuguggcuacgguaguaaauagagagaaaauaagagagagaaugcuugugccugccucugcccaaacauucauaaaaucaucagaauuucaugacuggaagggaaugggaggugucaauggugaggaagagagaagagucaaagauguccagcccucuggcugaagccacuggguagaugauaguacuguugaauaagaugggaaaugcuugggagggacuaggcuguagggcagugagucuuagccuuaguugcacauuaaaaccacugagggagcuuuuaaaaauucugaugccuaggcugcgcuccagaccaauuaaaacaauuucugggguugcaacuucagcaccaguauuuuuuaacucugucuagguaauucugagugcagcaaagauugaggagcacuauuuuacuugagagaauggaagaugauugaguuuuggacucacguuucaggugcauuucagaugugugucaaucuuccaaguaacugguauauaggguuucugauccuggaggucagaagagaggucuggguuggagacagaaaugugggaguuaccagcauuuguuguuaauuuaagugaugagagaggauaagauggcugaagauugagaagguaguuucagauugggcccagaacauaccaaugguuaguaaucugguagagaaggaggcaccugcagaaacccaaaccaaucaaacagaaagacuaagcaggacaugauaaggcggaagggaaaccaggagaguacagugcuagggaagccauggccagacagucucacaggaggaagugaauacuuaugaaugccauugagaagucaagcaaauguuaacuguaaagucuccuuggaucuacugacauggaggucauuggugaucuuaucaagaauagauugagugcagugguuggagcagaauccagaaugcgggugcgugaagagugaguuggaacugaggaagugggaaugguaaggguagguacauuuucagguagcuugacuggcaagaggaagaugaaagacugagaggauagaagcuggagggggauguggaguugguauguuuuuuuuuaagguagaggaucuacauuguuuacaugcugguagggagaugcugguaaaaagagugaggcugaggauguggaagagagaguaaauuggacagguuccugaaaaagugaaaggacaugagcucuaaagcauugaaaguggcacuguuccucccaucagguaagagaggaggagaaaauugugcuuuauauaccgggguuuguagauuuaguggugagaacuugaggugguuuuuccucuacugucuuacauuuucucuuuuauuagaaggcagagucauuuacuggaaggaagagaaaagaaagggaugucugaaauuugaauacaguagaaaauguuucaaauugucucaugggaaaguaaguuaauuagaggaaaacacgguuuuugggaaauguugagggccugguuaaaauuggaggcaugaauuuauagugguaccaauucaugguuuuuauugauuuauuuuccugccagcugcucaagacagugggagugcauggcccaagggaggccaauggaguucuucuaggauuagaauuuugccugguggcuagaguaaaggacaaagggacaagguaguuuacaauauuggcaagagagugaugagaagauggucuauggaaccuaaucuggaauucagagggaaggacaggaacagucggaagaguugauacaggggaagcagaaucagugcacuagaguucuugagaagguugagaaacagguaucccaggagcagaugaacaaagaacaagcaggcuggaaauuguaggaaauggacauccaagagcaggaugucuucauuuaauaccucagaagaagagcaauuccagauguugauacaguaggugguguaaccaaguuaagagugguagagguggaaggaagaggaggucguuggaguugagcagcucaagaaccugagaaguccaagcccacuuggacaucaugucaccuccaguggugguggaaguagaaaggaagacugaauuaggugcugauaucuucaucgaacaagaagacuugccuaggaggcuaguagaugauaacaaguaaggaugguacagcaauugagauuaggaggauuagugacucuauccccaaccuccuuuggauauguagguacuggugacacuuccauuauugcagccugcugccaccauacuguccuuuuucuaacaggcugcuagaugguugacacaaaccagagaaucuguaaauagaaggaaaaauggaggcugaagaaauucuacuuugauuuuucuccuucuucaauguaagcuucccuuaaaauaaaaaaauuggaagagacccaacccaaucuguaaggugcaggacauuuuuguggauuauauuuuuuaaaaguucuguguaacugaguuuuaugaauuacaugauuaccuuuaucuggaggaaaauaucgccuuugaaauacaagucaugucuuaauaguggaaagaauggaugcuuuauucacuugucucuaaacucaaaacagguuuguuugguuauuguuuaggcuguuggagagaaaguagugagagaugcauuuccggaagccauuaucguaaagccgucggacaucuuuggaagagaggauagauuccuuaauucuuuugcaaguacguauucuuucuuaaugguagaagagagggauacugauuaaccaaguugaagcugcucaagcuaacaguuuucucugauugacagacuaaggauauauuuuuucuuucccaguugccuuuuccuccccuaaguuuauauuuucauagucaauguagucuuuguuauauuccauaucaaaagaagcaacuuagauuaauggaaagagcaugaacuugggagucagagacuugaguuuaagucuuggcccagcuaacucugugaccuuggcaaauauucgaauaucacauggaauaguuucucuauccuaaaauccccuguguuauauguauugauucuuacccuccuacccaccccuaaccccagacaaccacugaucuuuuuauugucucuauaguuuugccuuuuccaggauauuacauauaugguuagaaucauugcaguauguagccuuuuuagguggacuucuuucacuuagcaauaugcauuuaagguucuuucauuucuuuucauagcuugauagcucauuucuuuauauagcuaaauaguauuccauuguguauauuccauuguauuggauauugguuuauccaauuuagauguuucuaucuuguuuuucccccuguugcuuguguccaccuaacaucuguaauaauuucuacuuaaaaaaaauuguggcaaaauauacauaguauaaaauuucccaucugcuaugggcuaaauugcgcccccucauaauucguauguugaagccuuaacaccauugugaauuuauuuggaguuaggacuuuuggaggaaauugagguuaaaugaggccauaagggugaggucguaauucaguaggauuggugaccuuauaagaagaggcaaaaagagagaucucucucucccugugugcacauacugaggaaaggccauaugugaggacacagcaagaaaucugcugucuacaagccaggaagagagcccuuaucaggaaccaaacuggcuggcacuuugaucuugaauuugccagccuccagaacugugagaaaauacauuuuuauuguacaagccacccagucuaugguauuuuguuaugguagccugagcagaccaaaauagauuuugguaccaagaaguggggugcugcuguagcaaauaccuaaaaaugugaacgugccuuuggaacuauguaaagguagaggcuagaagaguuuugagguaccugguagaaauauggacguuaagggugauuuuuguaaggucucagauggaaaugaguaagaugucauuggaaacuggaggaaaggugauccauauaauaaaauggcaaagaaauuggcugaucuguguguguucuaguggaagguagaacuugugagugaugaaauuguuuauucagcugagaagauuucuaaguacaaaguauugaagaaaugccuugguuccucccgacugcuuacaacagaauagaaaaagagagaaagaggaaaugaagaaggacuuguuaagcaaaaaggaaccggaaccugaagauuuggaaaauucucagcuuauccauauugcaaaaaaugagaaagcuuguuuugaagagaacacuaagaguguggcugaacaaccauuugaugaagagauuguggaugcgacucaccaacuaacaagcuaucuuggcagaagccaggaauagagaugagauuacaucagcaaagucaccaccaguuugaacuagaaggggcagaaugaaagaagccugucugacuucugauauccuacaggaccagaccacagagcuauuuggcugugaauuugagcuauucuucaagaaaagggaagaaugaccccaaaagggguucagagauguuuagaacuaucucuuugguuucaaaggauggggccauugccucaguuuaaacaccacauggccuuugucagaggccuuggaggugggaccacccagagucuuggagguacagcugccugauccuuggggcuacagcccccuggaaccuuugagguguugacccucugcccaggagagcuauugggguggggcugcugccccaguagguccuagaaguuagaacuaccgcuucaguggguccugaaggugagaccaccaccucugugaaucuagaaggcaaugcaucuaggcaaagaagauuauugauuuuuaguagccacccuaauaggugguguuucauuguguguguguuuuuauuagauucuaaaaucuaauagaauuuaccuugcuaaguuuuggacuuacuugggaguuguuacccuuucuuucuuacgucuuccuuuuagaauaggaaugucuaucuuaugccugucucacggcuguauuuuggaagcacauaacuugucugguuucacauguucauaguuaggaauuuugccucaggaugacccacaccuugagucuuaccuauaucugauuuagauaauauuuggaugcgacuuuggaguuuagagucuugagacuaagacaagauuaagacccuuuuaacuauuuguaagaguacaguucaguaguauuaagauauuuacauuguuguacaaccaauccccagaacuuuuucaucuuguaaaacugaaauucuguaccccuuaaacaacucucuguucccuccuuccccccagccccuggcaacuaccauucugcuuuugguuucuaugaauuugaccaccucauauaaguggaaucauacaguauuugucuuuucguagcuggcuuauuugacuuagcauaauaugcucaaggugcauuccuguuguaccacgugaugugauuuccuuccuacugaaggcugaauaauauucugugauaugucuauaccacauuuuguuuaauaagccauccaucaauggauacuuggauuucuucccacuuuuggcuauugugaauaaugcugcaaugaccauggauguacgaaauaucccugauuucaguuauuugguguauguacugagaaguggaauucuguagcauaugguauaucuauuuuuacuuuuucgacaagccaccauaguguauuccacaguggcugcaccauuuuacauugccaccaacagugcacaagguuuccacuuucuccagaucuuugucaauauuuguuauuuucuguuuuuuuuuuuuuuuauaauagccauccuaauaguucuaaggugguauuucauugugugugguuuuuuuguuuuuguuuuugagauugggucuugcucugucaccuaggcagugauacaaucacagcucacugcagccuugaacuccugggcucaggggauccucuugccucaguuuccuacauaggugggacuagagguguguaccaccacaccuggcuuaaaaaauauauauauuuuuguagagacaggucuugcucucuugcccgggcuggacucaaacuccuggccucaagcagucuuuuugccccagccucccaaaguucuaggauuauaggcaugggccaccacgccuggcaacaaugugguuuugauuuauguuuuccuaaugauuagugauguugagcaucuuuucaugugcuuuuuggcuacuuuauuauuuggagaaaugucuguucauguccuuggcuaauuuuuaaaauuggguuguuuauuuuuuguuauugaguuguaggaguuuuuuuauuuauucagaacauuaaauacuuaucagauaugugauuuguaaaauuuucucucauuuuuuaguuugucucuucacucuguuaauuguguucuuugaugcacagaaguuuuaauuuugauguagucaggcuuaucuauuuuuacuuuuguugccugugcuuuuaguauuguaucuaaggagucguugccaaguccaaugccaugaagcuuucuccuuuuguuuuugucuaagaguuuuagaguuuuagcucuuagguuuaggucuuugauccauuuugacuuaguuuuuguauaugguaugagguaaggguccaauuuuauucuuuugcaugugguuauccaguauguugaaaagauuaucuuuccccauugaauggucuuggugcuuuugucagaaaucauuugaccauauaugcaagaguuauuuuucucuauuccauugcucuguauguuuuucuuuacgccacuguuuugaucacuacacuguuuugauuacugugccuuuguaguaaguuuugaaaucagaaagugugugagacuuccaaaaauuuguucuuuuucaagauuguuuuggcuauuuaaaggaaucccuuuaaaugucauaugaauuuuaggauggaguuuucuauauuuuugcaaaaauaaaaagccauugggauuuugauagggauugcauuaaaucugagauugcuuuggguagaauugacauaugucuuaguccauuuugggguacaacaaacguugaguaauuuauaaagaagagaaauuuauuuccaacaguucuggaggcugggaaucucaagauccaggugcugucaucuggugagggccuucuugcugugugcucacaugguggaagguggaagggugaaagggacaaaugcuauguccccacauggcagaagaggagaagagcaagcuagcugaaugcuucaugaagccuccuuuaugagggccuuaauccuauucaugagggagcacccucauggccuaauuaucucuuaguuccuaucacauuggcaacaucugaacuuuggagggaacauauuuaaaccauagcaacauccuaacaauauuaagucuuccauuccaugaacuugggaugccuuuccauuuaauugugccuuuaauuucuuucagcaauguuuugugguuuucagcauaugugucuuuugccacuuugauaaaguuuauuuuuaaguauuuuauucuuuauuguacuauugugaauaauuucuacucuuuuuuuuuuuuuuuuugagacagagucgcacucugacacccaggcuggagugcgguggcgugaucucggcucacugcaaccucugccucccagguucaagcgauucucuggccucagccucccaaguagcugggacuacaggugugugccaccacgcccagcuaauuuuuguauuuuuaguagagaugggguuucaccacauuggccaggcuggucucaaacuccugaccuugugauccgcccaucuuggccucccaaagugcugggauuacaggcaugagccacugugcccggccuaauuucuacucuuaaaugguuuaaaaaaaaaagaaaaacaaacaaacaaaacaaaaaaaacuuuuuuaaccuaacauuuaaacuacuugggauuuguuuuaguuuauggugagaacuaagacauuaucucaccuuuuuuucaaauagcagaauaauugugccagcaccauauaucaacuaauauuuccaucaggcccuuuuucuggguuaucugugcuguaucacucaucuguugauacagcagcagaacucaucuagauauuaacuagauagacagcucaucugccauaucaacagaugaguaucauaaggaggaagaguuccauguuucuccuuagaaugggugcagcuagaguccagucuuggucguagcgaugcauuuagcauugcagagcagacuaguugucuagacauuugaccucuuuucuuugcucuucaugguuuuaaacauuuggccuuuuuauuuuccgaguuuauuaucugaaaaacuaaugacugccuuuuguaagugcauucacuuccucagagucagcuacauucauuauauuauuucuauuaugcacaauaauuauguuaaucuuaagacuguuggaucuuacagcaauuuaagccuucucaguauaguucucauucuuucuuccgcuagguaugcaucgguuugguccuauaccccuugguuccuugggcuggaagacaguuaaacaaccaguauauguaaguacuuggaugaagggggucagaaagggauuuuugaugaauucagauuugagugaucaaguuucugguuuuguccuaauuuaguaacucugucauuuucuuugucaacuugugucagcuagcugccucuuaguuuacuuaagagguacaugccuucucugugucuucacuuguucauuuaagaaaaaguuauugaacucauaaugugcuagacacaucauacaugucacaugucacuagggaaauaaagauauuaacuagauagacacaaauugcuguucucaaauugcuuucagucugaggcagauaaauaaagcaguuauuguacaacgugaugagugcuaugauaaggagaggguuuuauguaauuacaucagaagggcaccuaaucuagacuugggcauuucaaaaggaagggcauuuaggguaaaaccuuaaagaugacuaaagguaagccugaugaaaggaguuggggaagaguauugcaugcagagggaacaguauauacaggggcccagaggugaaagagcauguuggauuccauguuagauugaaccaaguuuucucaguaguggcacuauugacauuuugagccagauaauucuucguuauggggguuguuaaaggguguugggcagcauuccuggcuucuagccacuagacgccagucacaccacccuucaguugugacaacugaaaaugacucuagacaguugucaaauguccccugggggccaaaaucacuauuacuauuacuguuuuugaaaaucaaaaugguagaauauuagcaauuccaugugguuaagccuaauagcuugugaugguuaauaagagaguugggaaugguaagagaugagcuuggcaaguugugggcaaaagcaaaucagaggggccucaagcuaucugaagguaagugcauuccuacuacagaaaauacuuggaugagccuuggauuaugcguacuuggaaaauacuuggauagcggugauuauuugagcucuugagaaggcucauucuuuuaagaagcuuucugggaauagauaaugccauuauuuuaacuucacauuuucuuuguugagaucaguguggccuuccuccuuucuccuuccuuccuuccuuccuuuuucucuucuuuccuuucuuucuaucucuccaucucccauucugucucuuuuucaacaauuacuuagacauauauuauaauuucuuacaggucguagauguauccaaaggaauuguuaaugcaguuaaggauccugaugccaaugggaaauccuuugcuuucguuggguaagugcuuagaguuugaauuuuaaauugugcuauuauaaugaaggaaucaauaucuaaauuaguuacuaacagauuuauuuguugcacuuuuacaauaucaaaaucuccucauugcuugcauuaaaucagaauuugagggaaccuggaaucuacuuuaaugaaugauucuucuguuaccaaggucugagaaccacugcccuagacuauuacauauacuuaguccagugacccuuagggaugguuuuguacuacuccagugauguuuuuaauauauaaaaggauauugcuguaaauucuaaaacacaaacaaaacacuuuuagggaguaaguaugguuauaaaaccacauuaauuuugauggaguaucacaaugccuccagaggcugaaaaacgggugguuuauagcacaauuacuagugcugugcgagauugauuauuucuuuuaugcucuuugcuaaaauuugcuuucagaaaaaagggguacaguuaagcuauguggcuuaccugaaauuacuaaaucaugugacagcuaagcuuaggaauuuuuuugcugaauuaacuaaaagucaaaaacuaagacuucauuugccaaguugagagguaucaaauucaccugguaagugguucauaacccugugauucugugaagcaaacuagugacacuugacaucuaugaaaguuaaggaucuggcucaguaauuaagggauagccuaauucauaagaaauguuugccucuagaggaaaaugacacuguucucuuuaagccaagaggcauagaauauacucccagaauucugaaucuauacauuguuauguuccacuauuauuauuuaauacauaauuuuuuucagugugaaagucuugguuuuccaugucaacuagcagcugcaaaauauauuucuccuuuucaguucccaguuugguacauuagcaugcaaucaguuauauagucuagauaagaauuacaauucaauauauucaauacagguuucauaaaauacuacacaaaagacauuaguuccagugaagagguacauggacuaggauuucagggaauaaaugagcggaaauggcuuugugaacuuuacuugcucuagcucuggaugaguugcacauuuuccuuuuuaccuuugcccagccauuauccuuuugucugggcuccaguaagucauucuuguuuggcguaacgaugggaaaaauaauacuagacauugcaguguagauauuuuuccucuugaaauuguagauagguaucuacacauuucucaucucuucagccccaggaaaaaacuuugcuucuuucucugauauuuugaggcuaaggcaguggcauaagacuauaauuuuccuccuagguuuuuuguaauuaugaauuauauuauguugguccauucuauuugccauucauucauaaaauaccuauugauacacacucauacaacauuacacacaacugugaugaugaauaaacacauucagcaaaaucacgauguauaagaucagcauagaaaaaucaauauauacuaguaaaugaacaaugugaaaauaaaauuaagaaaagaauuuuauucacagcagcauaaaaaauaauagaauauuuaaguauaaauuuaacaauuaaauuuauuauauuauaccuaauaaguaaugacauaccauguucauggauugaaugagucaguaugauuaaaaugauaauuuccuucaaauugauugacaaauucaacuuaauucuaucgaaauuccaacagacuuuuuugcagaaguugauaaauugauucuaaauuuauaugguaaugcaaagacccacaauagacaaaaccauuaaguuucauaauuucaaaaccuaauagcuauaauuaucaagauaguaugguacugacauaagaauugacguauagaugaauuaaccagaauugauaguucagaaauaaaucuuuauggacaauugauuuuugaaaaaggugcuauggcauuucaaaggggaaaggauagucuuuucaacaaaugguuuugggauauccacauuaaaaaaaagaugaacuucgacuccuaccuugcucuguacaugaaaaaauuaaaauaauucagagacuucaguguaagaguuauaaaacaaggauugguggcaagauggcugaauaggaacagcugcagucugcagcugccagcaagauugacacagaaggcgagugauuucugcauuuccaacugaggugccugguucaucucauugggacugguuggacggugggugcagcccaaggagggugagccaaaacaggguggggugucgcuucacccgggaagcauaaggggucggggaacucccucuccuagccaagggaagccauuagggacuguaccaugcacucuggcccagauacugcgcuuuucccauggucuuugcaauccgcagaccaggagauucacuaaggugcccaugccaccagggcccugguuuuccagcaccaaacugggcagccguuugggcagacacugggcuagccgcaggaguuuuuuuuccauaucccaguggcaccuggaacgccagugagacagaaccuuucacuccccuggaaagugggcugaagccagggagccaagugaucuggcucagcgggucccacccccacagagcccagcaagcuaagaucuacuggcuugaaauucucgcuccuagcucagcagucugaguucaaccugggacguaugagcuugggagggaggggcguccaccauugcugagauuugaguaggugguuuuccccucacaguaaacaaagccaccaggaaguucaaacugggcagagcccacugcagcucaggaagacacuguggccagacugccucuccagauucccuccucucugggccaggcaucucugaaaaaaaggcaguagcccaagucagggacuuauagauaaaacccccaccauccugggacagagcaucugggggaaggggcaguugggggugcagcuucagcagacuuuuaacaucccugccuggcagcucugaagaaagcagcagaucucccagcacagcauuugagcucugauaagggacagacugccuccucaaguggaucccugcccccguguauccugacugggagauacaucccuguaggggccaacagacaccucauacaagggagaucugguuggcaucuggcaggugccccucugggacgaagcuuccagaggaaggaacaggcaacaaucuuugcuguucugcagccucugcuagugauacccaggcaaacagggucugguguggaccuccagcagaccugcagcagaggggccuguuagaaggaaaacuaacaaacagaaaagaauaguaucaacaucaacaaaaaggacguccacucagagaccccagccgaaggucacugacuucaaagaccaaagguagauaaauccaugaagauggggagaaacuagggcagaaaggcugaaaauuccaaaaaccagaaagccucuuuuccuccaaaggauuacaacuccuugccagcaaggaaacaaaacuggauggagaaugaguuugacgauuugacagaaguaggcauguucuaacccaaugcaaggaagcuaagaaccuugagaaaagguuagaugaauugcuaacuagaauaaccaguuuagagaacaacauaaaugaccugauggagcugaaaaacacagcacgagaacuuugugaagcauacacaaguaucaauagccgaaucgaucagguggaagaaagcauaucagagauugaagauuaacucaacgaaauaaagugaaaagacaagauaagagacaaaagagugaaaagaaaugaacaaaacuuccaagaaauaugggccugugugaaaagaccaaaucuacauuugguugguguaacugaaagugauggggagaauggaaccaggagccaaguuggaaaacuccaggagaacuuccccaacuagcaaggcaggccaacauucaaauucaggaaauacagagaacaccacaaagauacuccucgagaagagcaaccacaagacacauaauugucacauucaccaaggcugaaaugaaggaaaaaauauuaagggcagccagagaaaaaggucagguuacccacaaagggaagcccaucagacuaacaguggaucucucagcagaaacccuacaagccagaagagaaugggggccaacauucaacauucuuaaagaaaagaauuuucaaccuagaauuucacaucuggccaaacuaagcuucauaagugaaggagaaauaaaauccuuuacagacaagcaaaugcugagagauugcaucaccaccaggccugccuuacaagagcuccugaaggaagcacuaaacauggaaaggaucaacugauaccagccacugcaaaaacauaccaaauucuuaagaccauugacgcuaugaagaaacugcaucaacuaacgggcaaaauaaccagcuagcaucauaauggcaggaucaaauucacacauaacaauauuaaccuuaaauggcuuccuugcauuggcuaaaugcuccaauuaaaagacacagacuggcaaauuggagaaagggucaagacucaucaguuugcuguauucaggagacccauuucacaugcaaagacacacauaggcucaaaauaaagggauggaggaauauuuaccaagcaaauggaaagcaaaaaaaggcaggaguugcaauccuacucugauaaaacagacuuuaaaccaacaaagaucaaaagagacaagggcauuacauaaugguaaagggaucaaugcaacaagaagagcuaacuauccugaauauauaugcucccaauacaggagcacccagauucaaaaagcaaguucuuggagaccuacaaagagacuuagacucccacacaauaauagugggagacuuuaacaccccacugucaauauuagaaagaucaacgagacagaaaauuaacaaggauauccaggacuugaacucagcucuggaccaaguggaccuaauagacgucuacagaacucuccaccccaaaucaacagaauauaauuucuucucagcaccacauugcacuucuucuaaaauugaccacauaauugaaaguaaaacaguucucagcaaaugcgaaagaacagaaaucauaacagucucucagaccacaggacaaucaaauuagaacucaggauuaagaaacucacucaaaacugcacaacuacauggaaacugaacaaccugcuccugaaugacuacgggcuaaauaaugaaaugaaggcagaaauaaagauguucuuugaaaccgaugagaacaaagacacaacauuccagaaucucuggagcacauuuaaaacaguguguagagggaaauuuauagcacuaaaugcccacaagagaaagcaggaaugaucuaaaauugacacucuaacaucacauuuaaaagaacuagagaagcaggaacaaacaaauuuaaaagcuagcagaaggcaagaaauagcuaagaucagagcagaaccgaaggagauagagacaggaaaaacccuucaaaaaaucaaugaauccaggagcugguuuuuuucaacaacauagauagacugcuagccagacuaauaaagaagaaaagagagaagaaucaaauagaugcaauaaaaaaugauaaaggggauaucaccacugaucccacagaaauacuaaguaccaucagagaauacuauaaacaccucuauaccaguaaacuagaaaaucuagaagaaauggauagguuccuggacacauacccccucccaagacuaaaccaggaagaaauugaaucccuuaauagaccuauaacaaguucugaaauugaggcagcaauuaauagcuuaucaaccaaaaaaaguccaggaccagauggauucacagcugaauuauuccagagguacaaagaggagcugguaccauuccuucugaaacuauuccaaucaauagaaaaagagggaauccucccuaauucauuuuaugaggccagcaucauccuaauaccaaaaccuggcagagacagcaaaaaaagaaaauuucaggccaaugucccugaugaacauugaaucgaaaauccucaauaaaauccagcagcacaucaaaaaacuuauccagcacgauaaaguuggcuucauccggggauaaaaggcugguucaacauaugcaaaucaauaaauguaauccaucacauaaacagaaccaaugacaaaaacuacaugaauauuucaauagaugcagaaggccuucgacaaaauucaacagcccuucaugcuaagaacccucaauaaacuagguguugauggaauauaucucaaaauaauaagagcuauuuaugacaaacccacagccaauaucauacugauugggcgaaaacuggaagcauucccuuugaaaaucggcacaagacaaggaugcccucugucaccacucguguucaacguaguguuggaaguucuggcugggacaauuaggcaagagaaagaaauaaaggguauucaauuaggaaaagaggaagucaaauugucucuguuugcagaugacaugauuguauauuuagaaaacuccauugucucagccccaaaucuccuuagcugguaagcaacuucagcaaaguaucaggauacaaaaucaaugugcaaaaaucacaagcauucccauacaccaauaacagacaaaccaugagugaaccaaaucaugagugaacuuucauucacaauugcuacaaagagaauaaaauaucuaggaauccaacuuaacaagggaugugaaggaccuauucaaggagaacuaccaaccacugcucaaguaaauaagagaggacacaaacaaacaaauggaaaaacauuccaugaucauggauagaaagaaucaauacaaugaaaauggccauauugcccaaaguaauuuguagauucagugcuauccccaucaaacuuccauugacuuucuucacagaauuggaaaaauacuacuuuaaauuucauauggaaccaaaaaagagcccacauagccaagacaauccuaagcaaaaagaacaaagcuggaggcaucaugcuaccugacuucaaacuauacuacaaggcuacaguaaccaaaacagcacgguacugguaccaaaacagguauauagaccaaugggacagaacagagggcucagaaauaaugccacacauuuacaaccaucugaucuuugacaaaucugacaaaaacaagcaaugaggaaaugauucuccguuuaauaaaugguguugggaaaacuggcuagccauaugcagaaagcugaaacuggauccuuuccuuacaccugauacaaaaauuaacucaagauggauuaaagacuuaaacguaagaccuaaaaccauaaaaaccuuagaagaaaagcuaggcaauaccauucaggacauaggcaugggcaaagacuucguaauuaaaacaccaaaagcaauggcaacaaaagccaaaauagacaaaugggaucuaauuaaucuaaagagcuucugcacagcaaaagaaacuaucaucagagugaacaggcaaccuacagaaugggagaaaauuuuugcaaucuauccuucugaaaaagggcuaauauccagaaucuacaaagaacuuaaacagauuuacaagaaaaaaacuucaucaaaaagugagcgaaagauaugagcagacacuucucaaaagaagacauuuaugcagcucaacaaacauaugaaaaaagcucaucgucacuggucauuagagaagugcaaaucaaaaccacagugagauaccaucucaugccaguuaggauggcaaucauuaaaaugucaggaaacaacagaugcuggagaggauguggagaaauagugacgcuuuuccacuguugguggaaguguaaaccauuguggaagacaguguggcaauuccucaaggaucucgaaguagaaauaccauuugacccaguaaucccauuacugaguauauauacccaaaggauuauaaauuauucuaguauaaagccacaugcacacguauguuuauuacggcacuguucacaauagcaaagacuuggaaccaacccagaugcccaucaaugauagacuggauuaagaaaaugugccacauauacaccauggaauacuaugcagccaguauacagaaaaggaugaguucauguccuuugcagggacauggaugaagcuggaaaccaucauucucagcaaacuaacacaagaacagaaaaccaaacaccauauguucucacuuauaagugggaguugaacacauggaaacagggaggugaacaucacacacuggggccugcuggaggugggaggcuagaggagggauagcauuaggagaaauaccuaauguagauggcagguugaugggugcagcaaaccaccauggcacauguauaccuauguaacaaaccuguacguucugcacauguaccccagaaguuaaaguauaauuaaaaaaaaaauuucaauugguaaaaauguaaaaaaauaaauaaaagaguuauaaaacuauaauaauuuuggaaggaaaauagaaaaucuucuagaccuuggauucuagaagauuuuuaccuauggcaucaaaagccuauuucauaaaauaaaaaauaaauggauacauuagacuucaccaaaauuaaagcucuuguguuucaaaagacaccauuaagaaaaugaaaaaacaagucacagauugggggaaaauauuuguuaauuacauaucugauagaggacuacuaucuagaauauacaaagaaaucuuagaacucaaugagaagaugauccauuuuuuaauaugagcaaaagacaugaauaggcauaucagcccagcagauguacuuaaucacuaaaaaacauaugaaaagaugcuccauaucauuagucauuacagaaaaugcaaaucaaaaccauuaugagauaccaguucacagagagaaaauaacaaauguugaggaagacauggaguaaugagaaccuucauacauugcugguagggguguaaaauuguauagccacuuuagaaaacaguuuggcaucuucuuaaaaaguuagcauaaauuuaccauauggccuaucaauuuuacuccuagauauuuacccaaaagaaaugaaaaugugucuacacaaagauuugcacuugaauuuucauagcagcguuaucauaaaugcuaaaaauuggaaacaucccacauauucauuaacugaugaaaggagaaauaaaauauaguagcauucucauauaauagaaguucaacaauaaaaggaaugaaauauugacauguuacaugugugaaccucaaaaacaugguaaaugaaagaagcuagauacagaagaucacauguugugugauuccguuuauaugaaguaucuauaaaaggcaaauguaaguagauuagugauugccugagccugggaguaaaauccaggauuaaauggcuguggaggaucuuacuagaguaaggaaaaauauucuaaaacuggauuaugguaaugauuguacaacuugguaaauguaugaaaaaucauugaauuauaugcuuaaaauggaugaauuuuaauguauguaaauuauaccacaauagugaauagcauggguaagauuucugccuuuguggagcuuauagauuagugaugagaugcauaaguaauaauuaagcaaaauaauuaaaauaaaugaccgaaaaggaaaguccaguuaauuggaaagaaaaccagaaggaggaaguuggcaacuauauuggaugcugccaggagguugagugagugacagcauagagauucauggucaccuuaaugaccucauuugaacauuaggcaaagggcagauuggauugcagugagauuugaauggcaggauaggaaguggaggcaacaguuagguaacuauuuggagaaguuucccuguaaaagggagcaaaggaaacggguaaagagaaggcuaugaaacaugaaugucuugucaagggagguaccacccuggauuuggaagaugguacaucuuguuuauaaauugguaagaaugguccaggaaagagaugucacuucaugacucaggagaugaggccgacagaaaaggagcaaaguccuucaggaauugagaggaguuggauacagagugcaaaugaggguuugaccuuuguaaaaggcaaacauuucuucaacuuuaacaaggaaaagaauucaaggauauaugcagaugcagguagguuuggcugugggaauguuaggaguaucuuuucuuguuggaaugugagguuagcuaaaaggcaggauggagugggucagaaaaguguguggaaaauuugaggacagaagauagaaaguaugcccugggagaacaggaaagagcauuuccuaggagaacaugugggauugccaagcagaacugaguguuccauuggaaauuacugauaaaaaaauaaggugaagucaaucaguucaauuguauuucgucuacaguuuuguccuucugggguuucaggcucagagaaggcacauguuugggucaaccagagugaguuuugcuuagcaaguauaguggguaggggccugggagacaagauuuugcugaggauauuugcagaggaauaacugugaugcugagccuugaaaucuaagcugggaggaugcgggcuucaauguaccuuuggcugugaggaagggcacuuaaacuaguguuccgguugcacuugauggaacacaaagugcuucagaacagcugaaaaggaaaccuauuauguagaguuaguuaacccaugauaccaguuuuguuugucaucguaaaaauucaaguugcucuuggcguagcauguauuauauguccuguaaugauccuuacaaaucccucuggaauuugaagaacccugcuaaggccuuugucugauauuucuccuggcugauaguuucauguuuuuuaguaaaguaugucagaauaaugagguucucacugaauuaccuucacucagcucuugguugucacagauuuacugucaugaagcaugcaaaugaauuaggaaauggguaaagaaauauuaaaaugcauuauaagcacugauacuuauuaaugcuagguuaaaaucguacagaacuauucagauuaauggaauagagcggaacguucagaaacagucccauuauauguaaggauauaguaugugauaagggugacauuucaguauagggaaagaggcaguacaguaaaugauucuguaaguagcauugaagcaauuggcuuacaucuugggaaaaauauaauuacauguuuaccuuauauaauguacaaaaauacgucacagaaggaacuuuauaguaaaaaaaaaaucuuuuuuauaagguuuagacaaaauauguagaaauuuaugucacugcagaggaauuuucuaacuaugaauccaagccauaaagaaaaucaguaguuuugguuaaauuaaacaguuaaaauuuuaugugcacaaaacacuguaaauaacacuaaaaguuaaaauacaaacaauaaaagguauuuccaacaauaucacuaaaauauagagaauucuuacaaauuauuuuuauagacagggacuccaggaggaaagaaaagauagauguauaaaugaccaaaaauucgugaagaaaugaucucucauauuaaagacauaauaauuaaaacaugagauaccuuuuuuuuuuuaaccuagcagauuggcaaaaauuuuauuuucuuaugacaacucauuucggguggagggggcauucuuauauauaauuacauauauauaauuauaauuuauauaauuaucuaaaauguuauauacuuaacauuuuauauaaauugauagaaccauuuugaaaagcaguuuagaaguauucaauaaaagccuuaaaauuuuaaagucuacauugacccaguuccacuucuacaaauauauucuaaaugcguaaucauggauaaguacaaauauuuauuacaagaauguucauuaaaacauuauaaaagaaaaaaauuuuaauagcauaaauaucucaaaacuggcaauugauaaaauaauugugauuacaugcaguguaauauguugucaugaaacaugcaauaaaauaaugauguggaaagacgauuaugauguaauguuaaaugaaaaagacauuacggaauagaauggauuguguauuuauuaaaagcagaauaauguauauauguaaggggaugagaaggauauagaucaaauauauuaacuaucuuucauaaugggauuaugggugauuuuucuuugugcuauucuguaucuacuacagugcauauauguuuccuuuuuuauaaggaaaauguuauuuuguuauaaaggaaacuuugugagaagcguguaauugaaagaacuguguauugucuuuuuauagucccagucgguaccuccuuuuccaccuggugaaguacaucuuugcuguggcucacagauuguuccucccauuccccuugccgcuuuuugccuaucgguaaguagagugcuccuuuugugugacuucugaaaaagccagcuccacacacuuguuccuaauguucucccuuaggguuauagggugugugaagggcuggucuccagaucuccuaguguuaugacauuagcauagagaagaagcagaaauagauuaguguugguuaaaaaaaaauauauuggaacauuaaaucuucccaauucccaaaagugaaucuucccacuucccaaaagugaagaugcaguucuucacuuucuccaauuuaaaaccaucgaguuuaauuuuggagaaauaucuugcuaggcacauauguaaggggcagucagguuccccuguguuucaugucgcucauuauuaaaucaaccugaucaugcuauuggggaaaggagucaggcuaauucagacuuggauuugugguugccuucucuucuuucccugcuucuuaguuuacuucuucucuuuguggguuaaauaucuuugacuuggcugggagugguggcucaugccuauaaucccaguacuuugggaggccaaggagggcagauugcuugagcccaggaguuugagaccagccugggcaauauagcgaagccccaucucuacaaaacauaccaaauuagcuggaugugguggcaucugccuguagucccaccuacugggguggagguggggugaugcaagagaauugcuugagcuugggaguucaaggcuuccagugagcugagauugugccacugcacuccagccuaggugacugcuacugcgcacaguggugcacaccuauagucccagcuacuugggaggcugaggugggaggaucacuugaguucaggaguuugaauccagccuggacaacauagugagacccugucucuggaacaaaaaaaaaaaaaagaaagaaaagaaaaaccuacugcccugagguaacuguugaugggagcuccuuucucguccuagguuuuauauuguccugauuugaaccaaauaaaauaaaaucuugaacuuaccaugucacacccuaguggucugguuaaggagacugucacauccauugugccacaaacugaucuucauuuggguuuucauccauucauucaacaaauguuuauugaaugccuacuaugucuuagauaauguacuagguacucagaagguuacaacaaacacucaaaaaucuuauggucagaauguuacaacaaaaacucaaaaaucuuauggucuaacagggguaccagaaaaauagaccacuagaaugcagggugauaacgauauuuauugaguguuacaccuuucagacuauucacuuugucuccuuuaauacucaguuaucuauaaaguaaguaaggagaguauguggagugaguggaagaggaggccacagaguaagagaaacuuacaagaaggccaaaaagugaucaggcauuuaagugggaaaugagaguuuggaauucuagauaccaaagggaauggaguguuuucaggagagaaucgauguuuuaagaaggggaacauugcuguucauucacauguaucucaagccccuagaacaaugccugguacacauuaggcacucuguuaauauugguagaaugaagucuuacagaaaagucaaauaagauaaaggaccaaaaaaugucuacaaaugaccauugugaccguggcuucagugccgugaaagggauauaagccagauugcagugaggcacuuucaugguuguauauaaaauugaguuagaguuggcuuauguaugcccaugacauggcccacugaggacacuagaauagagaccugaagugaucuguuagcauagaaugagggcacagagaguuagagguuuguaaugaguguuuuuauuaagcuauguuagcccaauaaauuauuuuuuucugccguugaggaaucugaggcuuuauauguugcuggagaaauuccagccagcuuccuuuuucauuuauuuauacuaugcauuagaauguuguuuuucaagccuuuaaacggcuguggaacccugugcucacugaaguuuuacgucaaguccugcuggguaaauccaauaaaagagcuggucugguugcagugaugggugauacucaacgcauguacucccaaacccuuggccccccaggacucuguggggccccagcaaauuccuaguguuccucagaugcuaguugaaaacccacugcuacugggcacagugguguacaccuguagucccagcuacuugggaggcugaagugggaggaucacuugagccugggagugugaguccggccuggacaacauagugagacccugucuguggaacaaaaacaaggaaagaaaagaaaaagucacugcccugagguaacugaugaugggagcucaaguggcacguaaggagcccuucaauuuucauuagcagugaagagauggcaguaaugaagauagguggccuuuuccguuuuggguuuuauauugucguccugauuugaaccguagauuuuagccuucuccuugcuuuuggauuuuuuuuuuuuuccucaagggccccagcuuucagggguuacguuguauauuuuacacaccauucagcuugcccugcuucuguaaaggcagcauauuugaauaucugagguuuagauuaaauugaauuucacagacuugauuaaauacuggaguuuuucuguuugcuuuguuguuuguugguuuuauuucauuuuaaguuuaagaucuguuguuucuuuggaggagaacaaaguguaccagcaguuacagcagccgacuggguuggcuugagaggagauggaccaaaaagcagagguagccucacaggucgaggugguuauuuucuuaaaaaaaaaaaaucaguucagacugcucuacagcggucugucuuccugcaguucucauaggcuagcuuacaucuugggcagagagaugcuuaucacaugugcuauauguauuucucuuuccagauggguagcaagagucuuugaaauaagcccauuugagcccuggauaacaagggauaaaguggagcgggugaguacauguguggaaagcgucugccugggcagaugaugaggcguuagacuuauuuugcuuugccugcuugcuuguuucccggcccuugucuguuugcuguucuugcugucugcagucagccccucuacuagcgcugaagcucauccaccugcccugcuccagggggcggcuccucccuacuuucuguccgucauuaucaguguuucuuucucugcuugaucacuccugucaacacacaaaauugccuaauagcuccccugccaaagccucucuuccucccaucacucuuccagcuacuuuccuguugugucccuucacauccuaacuccuccuaacuuccuccuaacguccugaagaaacuguugacaguuucuuccuucuuucuuuaaccuacuccagucaggcuuuuauucccauuucuccccuaaaauugcucuuuucaagguuauccacaaucuccagucuccuugcugccacauccaauggucaguucucagaccucaugucaugugccugugcauuugcuucuagggaggaugcaaaauaaaauaaaaauacuauaccaauaccacaucuaccuuggaagaccuauggaccauauauuggcaagaaguagccaaauuguccccugaaugcugccugaaagcuaaaguguagagaagaugagaaaguagugcuuagggaacauguggaagugggcaacucacauacuuucuucagacauggucuaugaaagaucaggcaggaucgcugguugucagacacuucaguuuaucuuacacuaaagugucucuuacguuuauacuugagaaaguguugauacaguggccugaguagguuuuggauuugguuugcagacuggcuuacagcccucugguaaaagaauugcagacuuucagguggguaggaugagggauugcugcugcucuaggugcaaauggauucuauuuaugugguuuugaauaauaaucugggauguuugcaaacuuuacaguucauuaucuuucccuauaaacaagauggguuugguuuucuagcucuacagugagcauuagucaaccagguugaguacagcuggagcaaaaaaaguuacuuguuuuuuuuuuuuuuuaaugggcaaggaacaaauguuguguuaucuccuaaauucaaaguuaaaacugagucagaacgcccgugcucagaaaacaggggcgugagaggacugaggaauggaccagcucugcuuaagcccugauuuuauuccuaaacccuccuguucagccuccccuggcaaguguggugacuugugcuucccugcccuagauuuauuucuguugaaaucuguauauagaauggcucauguagugccaacauccugugcucgcggcugccacuggggaccucgaucugauacuuggugaucucgcccucuuuugucuuaagcccucuuuguguguucugcuuuuauagugauuugcaugaaucgaaaauugccacauauucuuugaaagcaauuaagucucaauaauaggacucaugccagcuugaauguuuaagugccugcuaggauagcacuuuguucucagccaguuuucagcauugucugugguccuuuguuuauccaaagaugcacaucacagacaugaaauugccucaccugccuggcuuagaagaccuugguauucaggcaacaccacuggaacucaaggccauugaggugcugcggcgucaucgcacuuaccgcuggcugucugcugaaauugaggaugugaagccggccaagaccgucaacauuuagugccuccugagcagcucuugguuuuggcgucuuuugggucggcccaugugguuugagcacccagccaggcggucucuuuagaggauccuguacacaguuccacuauuaaaacauuucagguugaauucugcaguauuuucuuccuugauuuacaaaaugagaaauguagucacuuagaacuugagcaugauuuuuguuaaacauauuuaauaaugauauauauacuauuuauucucugaaaugccagagaguuugaauuuuccuaugacaaaccacuucuagcauacguucuagaagacaaggacccuuuuuaaugucaaaguauuguaaagaccccaagugauaugugauuguuuuuuaauuuccauuaaaugagagagcauacaguauccccuaaccugaauguguuuacacugaagguguuuuuaaaauuuauuuuaauaaug

SEQ ID NO: 191700 - RNA, 31621 nt, Homo sapiens
gcccagccagcuugcgucaccgcuucagagcggagaagagcgagcaggggagagcgagaccaguuuuaaggggaggaccggugcgagugaggcagccccgaggcucugcucgcccaccacccaauccucgccucccuucugcuccaccuucucucucugcccucaccucucccccgaaaacccccuauuuagccaaaggaaggaggucaggggaacgcucuccccuccccuuccaaaaaacaaaaacagaaaaaccuuuuuccaggccggggaaagcaggagggagaggggccgccgggcuggccauggagcugcugugccacgagguggacccgguccgcagggccgugcgggaccgcaaccugcuccgagacgaccgcguccugcagaaccugcucaccaucgaggagcgcuaccuuccgcagugcuccuacuucaagugcgugcagaaggacauccaacccuacaugcgcagaaugguggccaccuggaugcuggagguaggucgggggguggcgcucgccaggagccaggaccccuccggaugcucggguccccggccggagcccuaaaccugggagagggcaauccccgcgccggccucccggcuccugugcgggaguuuaccgcgcgccuucuggcgagacgcguggcuuuauuucuguuccucuccagauaaacuggggaggcagaggggggaggaaaaucugggagaagcgaggcuguccugggcggggguaggggagcaucccgcgcgcguguuccugcauguggcugccucuucuucccaccccccucgcgaccugucuuuugcgaagccgccgcggcugcuugcgcugcggccaggaagagagucggggccugaaaucgggaccccgaguagaaaggcaaccccccccaaaaggccagagcaaauucgucuuggccucagguccccgccuguggucgcgacuccgcgcuggcacuucaccggggagguggagggaggagggagaaggagagaaacggggaauucgggagccccggaagucccauugaagaaacgcguguuucaggggaacccaaaagaaccgcuucuugccccucacuccaagucuuugcccagcgagccgugugcccacguaugcacagcucuggaccugccgugguuucgccauguugcuuugcaaacucccuuuggaaaggcugggaaacgucgcccgcuuacccucgcaccccauuaucccggccaccccacuucuaaucgugcccucucccccaccccccaccucacgaagauuacuuacaguuugguuuuccagcuuccucggugcggagauuugggugggguaggaagggggggaggggguguguguaggggggauaccgggucaccccugaaggagaggugggagccccccgugccucuuuccagggcucucugcucccgucuuuccccucgcucgucaccgcguucccuaguuucuguccuugugggccgcagccggacacucccgccgcggcgcucaccccuucaaguuuccucccgggauccaaagccccaggggucggaauacagaccuuucuggcacccgaaaccucuguuucgggaagccuggcucuucuuugggguuuucacgccaaaagggcuuuucuaggauauuuccucgauuuuuaauuauuuuuugaaaccaucccccccugcuccgacuccagcugccgaggcugcggcgcucuuccuccucuccucccucccccucucuuccccaccucuccucacccgcccccccaaaagcggccccugggccgcagggacccccccagacauuuuuuccaauugucgggaaugauagaggaggaucuggggauccggaugagaccaagaaguggacccccggagccuccagaauauuuuuauugauuuuuugaaaagaugacgaaauccaaaaaagagugagugaguuagagugcgcgaaggaguagccaaagggagcgucgcggagcugccgcggcugcugcgcacuucuccgacuccccguuuuggagcuguaguucacccccuuuuauaggaucccugggaauaccaaagcacugaugggcuauucugauucacuccaguuuccucaucuuuguucuuuauucuuaucacgcauucugguccccucccccucccacaaaaaaaaauuaauuuuuuuuguuucgauagauuacgcuuuuuuauucuuuuucucuuuugcugaugcuaugcucuccacccccgccccccaacccuuucccacucccauuauaggucugugaggaacagaagugcgaagaagaggucuucccucuggccaugaauuaccuggaccguuucuuggcuggggucccgacuccgaagucccaucugcaacuccugggugcugucugcauguuccuggccuccaaacucaaagagaccagcccgcugaccgcggagaagcugugcauuuacaccgacaacuccaucaagccucaggagcugcugguaaugaccggccccuuccucccuuccuuucugcgauucccgcuuuccccuggccaacaauaugccuucuaucaccacugccagagcaaauucuugggauccagaaugaccccaccaauagaauuuacccacuuaugggcgauagcucauuuaauaggaaaccacuguuuauuuuuuguguguuccuacuaugugcccaggcuccgugcccagcacugaggcuacaucugugaauaagauccucauggagauuuggguuggugagacucauuugcaauuguguaugcauguguguaggggacgcauggaauauuuuaauuaacagugauaauauuuuaauuaaauuccaaauuuccaaaaauagucugagaacguguucacaugauagguauguggcuguggugucuccuaaaaacuuggaguucaaagguaaugcccucuauaucuacaaagucucaagauaccaacacauaauagcuguucacuaaauaucaguucauugacuuuugagcaaagucaaaauguggccuuucacugaaggaguccgaggccuggguuccuaccuccagugggacugugaccucuguacaaccccagggauccugucuuaucucugcuuuucuaccagggaaccuuuuucccaccugaucuaacuccuuuucccugcagcuugacauauaagacgaccauauugcagcuguaccgcauggaauagcggcuccaaggcccaccuucggugguuugcacaccccucuuugcacuguucagaaaagcacccccuccuucccgccccucccccuccucacugguagggcccgcacaaaguccacagggcugaggcuggcuucuugaacugagcucuuugugaggagccuuccuuucuggggcucugcugccaucuaguggaagacaugcacaagguugggggaggaauugccgagaauguggagaggggccugaaugacuucaccuuugaaccgcugccagguuuuagcugcuucugguuugguccgagaggccuagaaaggugcuuucuucugggagaucugcuuccuuuaauaacggugcaagaccagugguucguacucgcauuacccugugaagaggaagggcuggcauuucaagccaucuuugaagaugauggugguuuaguaguuuauuggggugcuuuaccccggcuguacacagaaagccaaggcagauuuuaaagcuuaugaagaaaacauuguuagaauugggaaccaauuuguuuuucucaugagagagcaggaaaaaucaucuucauaugguucauuuguuucgagaggauggugaauugagauguucuucaggacacccaaaucuuuccaggacuagccaagcaauauauugcuacaaacaaacuuggcuuuuuccuauucccuuuaucccagaaguugggauuuggaagaguccuauuuuacaaaugagaaggcugaggccugggagggaaagggaaucacccccagccccacagcugugggacuggugcucugguugcugguuuagcaaaugaaagagauuccagguucuccaggugaaugggagagagggugcauuggcaaacaggcccugccucucauucuucugaugacagcucaguggauaggcauauuuucugguagcacauacgauauuuuuaauguuuuauuuuggaccguuucccuuugagcacaguuucccguaaguaucucagugaaagagggaaacaagguucuuuuucagguggguugcuggugagagacccaagagacaggguugugugguccccacacuugcacugagggaugcugugacacugagcaggcacccucaccuugccccagaucaccuccaucugcaaaaugagguugcuaaugaccaugugguccuuuagucaugaugacaauggccugugaaacauuuaggggaaagggcugagugucacauccccagaauuucugccugauauguaaaaggggaguuugagcagcagagagauaaaggcacuuuuuggcacuaaguaaaagcaagcuaauugguugccaaggaguugggccaaggaaccuuauuuugagcuuuaucugugugcaucauuuuuccaugaagauuaaaaagacuauuaauucggugauagagacauauacaauaaauuaccaugaaagggccacaaugaccuuggccguaucucauuguagguucagcuuucugggugggcgggaagcaguauugccugcaagucaggguugggaggggguaaggggagcuggaguggaaacgaaguagaagaaaauagaaucuuggcaacagcuaccugggcucucauuauuuucaguggagccugacauuugaagcauaagaagagcugucaacaacuucaaagcuucaggggcacauugacaaaugggcccgccuuacaaucuagcagccacguccuaaugagcggccuuaaaacuggucuggagcccaacccccagcccccuacaccaggucagccuguggaauuuagauucuccucuucucuuccugccuuccccuccaggagugggaacugguggugcuggggaaguugaaguggaaccuggcagcugucacuccucaugacuucauugagcacaucuugcgcaagcugccccagcagcgggagaagcugucucugauccgcaagcaugcucagaccuucauugcucugugugccaccgguaagaugaggcuugagccggggagggagaugggggagcucuuuugggagauguccggggagaggcaaaaggccguaggaacuuucauuuuaguucaggaguuuggaggagggguggucuugaguagucuaaagucugaaguuucauuccuggguugcuuuuucuuuaucugagcuuuauauauucgcuuucucugcuaaacucauaaaugguuuaugaggacaggugugguuaaggcaaaaaaaauuagugccuguuaaaauauucuuuaugauggcuaaagugcucuuugaagauuacauauacugcucacugguuguguucaaaucuuuaaucuuuuaaggaaaaggauggcuuggagauaagcccaagaggaaaucucgagggggaugggggcaaauacagguuaaaggaacaacgucaagauaaauaugcugccugccuugauuagugguaagggagaccaaagaaauucuuuuuuuuuuuuuuuuacuguagggcauuuauggccuucuagcuguuugcuucucuagcuguuugccccacugggcgcgggagggaaccugguuggcuuucggugaggcuuuacuuucugagcgcuggguucugaugcccucaguucauguggagguguuuugauuuuggccgcagccuuuaacguugcaauuccgccuaccacguggaucccacaauugauacaucauuccuacuggcccauuuguuuuguaguuuccuaauaaaccaaaggcagugguuugcuguugucuuauuaaacagccuuggccagugucuacugguuuuuuguuuuuuuuuuucuugguaguggccauggcagagacccuggaaccuuacucauccaagggagagaugucaggaguucauguuuugacaaucagaaaccuuagguaaaaagcugaucacuugggaagaccuuucggugugcuucaccucaaauuugccaagaguaguuaaaucgcuagguggacucacgugguaacuuuuuucaggauguuguuacauguuacuggugaguucuacggaacggaugauuauauaacguacgauguagugcauaugcccugugcucacagucaaaaagucaggcuuugcugcauaucagugagugaccuuuaauuggcugcuuaaccucucugaacccgagcuucuucaucuccaaaacaagccuauugauacaucauccuacagccuuuucagagcagcuaggaaaauuaaaaucagaaagaggugaugcacguggacgugcuuuguaaaccgaaguguagguuggaccuucacuaauugugaaaaugcuaccaucuccgauuuucacccugauuuuaacuguuccgacuaaaguggauaugauggcuuuccuuuucuggcugcccuuacguguuucuagcaggaccuguguguucugcacuugcaggcuugaguguggaguccucccggcccccugccuguucaucuagggcacagguuuccccuugcugguuuucuguaguccuguucuccuggaugcaggccaggccucauggcgugcacaugcgcccugugccccuuggugggagaguccguuauccuuccugcagcccugggggcgguucuuaggaccccuguggaccccugcugccuuuuggauaguggucacucuggcuuccuucccuucugcugucuggcccgggcccgagaggucaguccuccagugaccugucauuuugucucccaggcucggcugucuccuuccucucucaucaugauucacugugggggaggggucagccaguucuuucucucuggcccaaggacagcugacccccgacccuaaacucccccacugcccagcuguugauagccagagcucugcucaacacugucucuugacuaacagaucuuuuggggucuaacugccccuuccuccucucugaucucugauugggguaggggugcuggguggaguuaccggggugugggcagauccccagauuccgucuagacccauucucgaaaaccggggaucccaucccccacccguggccuucuugcccagaucuuugggcuggcugccagcuccggggccagaguagggagccugggauucagagacugaggacagaggcccagagggauacagaggcaguuauaaagacuguguuuugggggccuugaacuagcuuuggucagggacuaggaaaggacacccccaaaccacaugaaaauggugugcuaggcacuaagccucaggcguugacagggcagagcacagguagguccucggcaguuuccugggucuggaaaggaggggccuguaucgaaagaaguugcuuucccucaucugcacuuggguuugugcaacugacugagucacauagaauccuggcugcguggaguuuuacaacagucggccucacaguacaaacaccgaaggccgcuuuucuugaaggaaacaccuuccauggagaggcgauugugcauuguggggccagggugugaugaaugggcaaggacccaggacucuggccaguagcgggcacagagugacugagaggcagagguaggagaugcagauuccccaacccgagcuguugcccucaccugcuccucaaaucgcacacuucccuccuuuucucgcaguccuggauguuccguccuggagcugaugaaacaccugcggccagggucucggagguccacaguggguggagggugggggucccgagagauggccgccaacccucaggccgugcagcuauuugaugggaaaagcugguugugaaagagcuggcagugguucugcaguguguggggagcguauuugugugugaaaggggaagggagagcaggagaacauagaggggccgcguaaguguggcgaaguggcggucuugcuuuauggggcucuggauuaagaugguggcaaggcggagaggagcccuccuuccuucccugcucagccuaaaauggcuucuggaagagcaagggccgcaagcugcugguaucccucugcagcagguccugggcagugcaggcauggguggguugggcgggggaucuuccugacuacagcuccuagcauuccuguuccuggaguuuccaaaacuggggaagcagaacugagccauagcuucccugguugccgcucugcugauagaacacccaggucugcaagcgaggaaagaaggccauuggagaugaccuggguucgcacucuggcacugggagauuguugagaugugauaccaugcucgguggaugauuccaguuagucuagcagagccaauggcauugaguuuacaccuggcaccggguagggggaggugcucacccucccucuccaggcacccacauccccucuuucuucacuagaagcccacccuaagaugcugcaccuugguauuugugccacacacgguagccacccccaggccuccccacgccaaggccagagccccauuguugacuagaacccauugugcuguccuagccccuucccuggcuuuaccuacagguguucccucagauuccaucgccaagugagagggagacagugguggcccagagaaguucgaugacuuggcccuugaucuagagugggagauuucgccuugaugggugcugggaaggaagaauggaaacccgucuuuccaucugcaagucucugagcuaccccugaagccgcgaggucaugggacugagggggagucguuagcaugcccuguggggacaagcagccaggcaguguggugcuugccaucgcucuucccucuggcuguaagaugaauggguagcaggcugcucaucgcccuccaaccagcccccuccccagcuccucccagcaggccuugcaguugcaugggcauucccuugccauggcagcccugccccacaaggacaggguaugcugguccucuuauggggguggcagaugaggugcgugcccagugacgucccuggccugugaacacucugguucuggcccuuugaacuuccaccugacugcagguuggagaagagagauggggaaagccugaccuggccuucccuuucuucuucagcgucagagugcguaucucucucccccuauuggugaacagaagcaaagccaucaccccugcaccccaagaccucggccaccauagccaaaaugaugggugcuaaauguacugggcaggaccauguauuccgugguuuuaaacuuacuuagcucugaacucuuuauuugguaaaauccuaccaagaagugcagauaccaaguugaugaaauggagcacuucucagggcccaugcccaggugagggagcccagcgggacccccagaggcucccagggcauccuugggaggauaagccuuuugugcuugcuggugccggggcugcggcugggacccaauuccuuugauuccugagccagagcgccaccuuuggggcucuucucccacuuccgacgugaaaggcugcccuguccuccugagugguauaugggaggugacuuugaggagcuggucagcuuccaguaaguuacgaagagcucugcauccagagucucaaagucucauccggaucccaggcccaacacucacagugagugacaucagccagaucacuucaucucccaagacuucauugauucaccuguaaaaggagauguuugaaacagaugaauuucaagcuccuuuuuauuaauaccucaccaucaucaccgccgucauaagcaagcaugcagcccacagcagagcugccccuggcgccuguggguccagcugggauuccccuaagguguguccuuugccuccaccauuuugccaggagggaggcgggaaugucggguguuccugguuaucugggcaucguuccuuggcucgggugaacugcaucucaaugaauuguggaaugugcuggguuagaguugccaacuucucucuuccauucgcugaguguucaugggguucuuuucauuccccuguggggcugcacuuucucccaguucugcaaagcagcaggaggcuuuggggacucgaugaugucauuucugggacacauacacaacuggauagugacagauucuccaggaagcacagagcccucauucuuccuggccugcuuggccugcucccugcaucugccugcaauccagggaugcugggcgccuuucuccucaucccuccagacgcuggagagcaucuccagucggaacuccccaccacaguccugcaggaaguacuaggagugagagcagaggaggggcagguuggggaggaugcuggcugacauucauugcuuaccuugaaccaggcacugugcuuuuacaaggauuauuuuaagugaauccucagaacagcacuacaacguggguauugcuguugucauuauuugcagaucagaaaaugaaaacucagagaggucagguaacuugcucaucuucacacacuugguagguggugggauggagauuccaccuccuucugauuccagagcuaauacucugaaccagugagcuguguucuccagaggucugcuuugguuggaggggagcuggagcccuaggcccugggacggccucuguugcccauggcaaggcguguggcugcuccugcucucuucagaucuccagaugcagcaaccuggagaaaggcccuccugggucugguggggacuggggcaggaguggaggcugcccaagcuccgugcacuccacguuccagcuuggagcuuuuugagucuacucuccaaauccuucccaucucccugaagagucuucugagaagugucucaaaugcuccucuucacucaagagccuccuuucuuuuuuuuuuucuuuucuuuuucuuuuuuuuuuuugagacagucuugcucugucacccaggcuggagugcauggcacaaucucugcucacugcaaccuccaacucccggguucaagugauucucuugcccaagccuccagaauagcugggauuacaggcgcgugccaccaugccuggcuaauuuuuguauuuuuaguacagacaggguuucaccguguuggccagacuggucucgaacuucggaccucaggucaucugcccaccucggccucccaaagugcuaggauuacacugugagccacugcgcccagccuucaagagcccccuuucuuugagaaguuucuucagaaguuauccauauaguaguacagaccuagccauuauagcacaccauccucuacuaucuaaugcauugaugcccagccuuaagaagucugaauauuguacguuuuggggggaguccuccaugcugccuggaacagggaggagcacauugucaugagucgaucagaauggaucgcugaucgguucauugccucucucucugcugcaggaggaaggaucucaggaagucaccagcaucucaccucuccaggugggcaauuaacgauggcgagggcacacccucaccccugagcgugccuucugcaccagcauauugcuuguuggcauuuuugaucaagagacuuaacagacugcugagaaauuuguaccugguuuuuauuuguuaaaauaauauuacguacaaauuuuacaaacucaucuguguuucucccaccuaacagaacagcuuuuauuuuccgugcauccuuccaguucauccauaggcauauauguauguauuuacccaugguuguaaucuucaucgucgcaugcaugcaugcaauuugguuuuccgcuuccuucuucugaguggauauugugaccauuucuccauccugucauagcgacaaagcugaugguuuccaggaauggcugcauuggguagguggagcuuuccacaguugaggguggggguuggcuaauuacagcuaggaagcuagugcacagaugaaaugauguuugauuuuuuuguuuuucucucuguucaguauccccuaccaguagagagggggauguccuugagagugguccuggggcagcccuggugccacggggaaguagcgccgcucuguggagagggcugcuuugugaauuugccggcugguagacaccgugauccauucuauugucuccucauuguucuucuccuugggagucauucccauuccagauccucaaguaagagcaaaguagaccuguaaggcaccugggagguuauccugcuuacuaucuuuaaacucuugaccuaagccauguaggaagaaacacauuuuauaacacaacucaggauacuuguacaaguauaucaaacugauacaaaaguuucuccgaacaauauuuacucuuaacgacauacggugagccugauacuuucuauccuacucuauuugguuaaaggagaacaacaacagaaagugcuggucacgacccacaaaugcauuucaugacccauuaaugaguugcagcuagaaguuagaaaaacacuuaucucacccaacccguuauuagacaaaugggaaaccaagcccuuggaaagaggaagugacuugcccacagucccacgucuggaccuagcuggagggcugauguugccucaguauuugacuaaccuggaggagagguggggcaugcucagggaucccgaggaagaugcucgucuucuguguagcgggcaacagagggcagcacggccgccguccucgucuccagcggcgucucuccucuggcugugggaacacacugcuccuuuggugccacucugagcugcugagaggcagucaaguucaugcacauagugcuccccaauucugugggauuggacaguguccccaagaggacuccccugaaaaucuucuuaguaaaacaaaaagggagguagagucucccugugcaaccggugcaccuguucccccuaugccugcuggcuuccagaaguucauucguaugccaauaauaagaguugguuuugcuagcagugggacagcagagaugggcaugugugaggugugcuucccggucugaggccuauggcagagggaagggagggccggggauacuugccugccucuucccuggcagaugcucccacccgggccuuugugggcccagggccaugggccggcugccccgcuuguguuaugaaugucacaggggggagcuaacgagguuauugggcagagaaacacucuccugugacccauguggaagagaccuacagcagagcaagaggcagggaggcuggcuuugucacacuguucauggcgacagagaaggcguaggaggggcggguggacagcaggcgugggcgcagcaccauuauauacgucccucaagagguggagauggugagagggcaauggagaaaaagccaaggagacaggcagauggccagguuugcucugcguucaugaugggaggggagggcugugcuuggcucagggauccacggugucuaacaaugcugcuaacuugaugcuggggcaaugggcugaccauuaaaagagcugcuguagaaaguguguuuguaauagaguguguacaggaggaaggggaaauaggagaggggcugguuuuuguagauuuaaccugauuguuuuugcuguaaguugaagggugacccacgguucccuguaugcugugucuccugcccccacgugccccuuccaugucuacacacaguaagcucacuagagcaaugcuaaaacgagaaagaguacgcuuuggaagacuugcugcacuccaggaccgucacuagcgugauggcugcaacuauacccacccuaauaucugucaacacgagcaggggcaacuuaaacucucaaaagucucaggguucucacccauaccauuagggugacgcucgugugcaucuucuguggcugauggguaaauuaaacaggacguaauguguagcguacugcaugugguggucauugguagcugucagcagcuguaacaggagaaguuggcugucuuuauuuccccucgauggaccaagcagcugcuggaucauggccacccagccccucugaaggagugcucggaggaacacaagggggcuggucuuccaagaggagcccucuagcauggcaguggacgggguucaagccccucugauuuauuauccucauucugcacuucccuguagcaagucacauuuuuuucucuuagcaauaaaauggggccuucagucucaugagucauaacaucgaaaccgagucacccaucugauucggaugcaaugauuaaucuucagugcuuaguuagagcccuauguuaggguuagaauccucugcccuaauguucugaggguucuugcuguugggccagagguugggaacuggguggaacucagcccccacucgcccacucccugcauugcugcuucucucauuuccuuuuuuagaucaaaccuuuuuuuuuuuuuuuugggugggggucauauuaauccucaaugccuguccagagacuauaacaagaucccaucugaauuagcauuaugcauagauuuugcccguuucucccaucuccuuguacuuucccuccuucucacaucuggagccccuggucuguccugcuugcauggcccaugggguaccuugucugcacuggucucaggcauucucugcucuguucccaccaucaccucuagaggagacuaugacucgcucaccuugcuccccccaccagggucaagaauguuaacucagacaugcuuaauaugacugggaucuggggauuggggaccuugaauccucugugcauucauugugugcgcuuagauaagcugucuuccuucccugccucagucuccuucguuuaaucuggaacagccauggugauggcaaauaaacacaggcuccuugugaaagaacucgagggaggacaugccuguagggcacggggucacucgcgccgcugaccugcugccguccuguuucugagucucugcagucucgggagcuccaggauccaaauucguucugugcccugaccuucugccucucauuccuugcagacuuuaaguuugccauguacccaccgucgaugaucgcaacuggaagugugggagcagccaucugugggcuccagcaggaugaggaagugagcucgcucacuugugaugcccugacugagcugcuggcuaagaucaccaacacagacgugguagguggccaccaccuucuuggcuaaguccagaugucucuucucagcucagggaaggagacgacggauuugauuauguugugucagagguauuuuucugguuuguuuccuaagaucgacauccaagggagugcaaaguucagcaggugacacccccucuuaagguucugaaaagcugugcacgggaaaauacggaagaaaacucagcaagcagaugaagggggugggggugggagggcuguuuaccgauguuccuuuauggcgugggcuucucagugggucugaauuguugcuucauugccauauuuguacacgcugccaggcugccucugcccggcagcgaagagcugccgugucugcuuucacacgcugaggcuguaaggcgcacagaggagaaaggagagccaggacucagcugcaguggauggagcagacacacaagaggugccccacugugagaacgguguccgucccuggcaaaccucucgaccccuccccgcucucucuucccuuuuguucaaugcaguaauggauuacaaagugcuuucaaaagacaaagugccauacaaacucaagaaacuauuauuagcuacggagcuuccccauucugugugcccuguggacggcccagaggcuguuaacuuccuguugccagaauuuggagcuccugagaagaaagguuuugagagagaccagggucaagugagccucugaauucaaucagcaggaagcugcaguccuagcccguccgagacaggauggugccaagaggucagagaggccauuccuucguuuuccacgggcaggacagggacugaaguaaccagccaggagcggggugggcaguggcugagcuggggcuagaacccccaggcuccgacugcccccuggaaacuucccacuccacccuuguugccgcuccugggaucuuuugguuugaaaaaaaacccugggguuuaaagucaaccugagagagggguguuggcccugagcccucaugcaucaccauggagaggcugaagaaugcugggcacuucacgaugacacccucuggaugguccggggggauucagaugcccucugcgggcuuuuauugaguuaagggaucaugugguuuauaggccuauggcugaggccugcacgagggauacgggacagguuaaaccucagagagcccacggcugcagcucgccggccuccucgcccgcccaccuggauuuucccuggcauuuguucccagcucagagaaauggcgcagggagaugcugacggagcaaauccgggguccuccucugagauaguucguagauaugguuuuaaaaugcgggcuccaaacauacgcuuuuuaaacgaggacuccagaacacagacugaaaaccucccuccagugcagcaugaagaaugcuuuucuaauccuccagaggaaaaucguggacgggacuuaacguuuauagaaaugguacgcuuuccuccuuuucugaaugucuccaauuaaggcugccuuacaaauaggacucucagccaguuuaagacaagcccuuccucaaugccuggagacaaaaaugucagugacaggaguuggaagcggccaccccccuccuccugcccccaggcauuguaaccuuuucccccgauguugauagaccugcucugaugggcugaccacccuaccggcuccagccuuuucccaccucccuuugucccccguuacugaucucacauggacagugguggaaauuucccuccugggaguugcugcugagucucuuggcuuuucgagaccgcaggcaagucaguccgucaucucaucuggggaaacuguuugccuuuuucugauacuacguagccaguccauuuaagucagcuggccaacucuguuaaauggauaugaaguggguacgaagcugguuuagggguguccuccuauaaauccuaacuguuggucaaguugauaccucauuucuauaaugggcacacgccguguuuccuaacuggggcugccugugugugccucauucacaccgguggaccuggguugaacauguucauauuuaaaaaccaagagugaacgcggugaaauguacaauucauaacacuuuuucaaagaaaaaucugagcccucaggaaguuccaggcuuaccucuggcaccccggaggcugguucgcucucccugaaaauguuuuuaguggaaagguucaagcagcucugggcuaggcuguguguguguguguguguguguguguuuaugcaccuuuccaagugcuaaaucuccucccauccaucagccuguguucucugaaaagcugacgcucagagggaagaaaaauaaaaggacuagaauuuagaacacauuaguguuuggagggaggugaguugugcuuccugagcucuguuuaccauuucacgagucacgaagugguguauuuccuucauucguuucuggaagucuuuacugaaggcccaguuguugcuagaaguugggguggaugguggcaucugggaaauagaggaugagauuccugccuucaaggaacuuagcaguuguaugaugaagcaagaguaaagcgugcaaaacccuagcaaauuaagaacguaaacaaaggugugcuacguaacguguuacgaacccuaaaugcaguaggaaaucaacccaaaagaaggagcucaucaggccuaacguagaaugccggccucccagcagagaaaacuuggugauagaaacuguucuuagaguagagaaacaaaauguaugggcacgcaauggaauauuauucaaccuuaaaaagaaaugaaauuccgauccauguuauaacaugggcgaaccuugaaaauacuauguuaagugaaacgagccagacacaaaaagacaaauacuguaugauuccacuuauaccagguaccuggaauagucaaauucguagagacagaaaguagaauagagguucccaggagucuggggagaggagaggauggggaguuaguguuuaaugcguacggaguuucaguuugggaugaugaaaacaauucuguagauggagaguucugauggccacacagcagugugaauguacuuaaugccacuguacauuuaaaaguggcugaaaagggaaauuugacauuauguguauuuaugauaguaaaauguguguguguauauauguauauacacacacauacauaaauggauauauauauauguauguauguaugucugaaacauucucgggccacgcuaugaaaugcccauagguugauguugagcucuucccuggaaaagugaaauacacaggaccacauuuugcccccuggcccuagugcauugacaaacgggaaucaggaagagcugacaguuucccccagagccccugaaguuauaugucagcuccuacacaccuugcuguuucugauuucuucaagcuugcaaugcucucuguuacuuuggggguuaggucguggguugucggggaucgagcuguggaaagagggucccccugauucuugugagauggccaggcgagucucugugguucauuggccaggagcagauagcuuugauaugagggacgcaugcggcucugagaaagucggccuuuguugcuccgucugguugccaaaauaaaccagaacgcuucauuccaaagagaaagcugagugaggggccugacaguuuuauagggaauaaacgucucagagagugguauauuuuaaauacuuuuuccuuccaaucguaagaguugcuaaaaacagccagagaggcaguuuggcuguaggggggacgucuauuggggguguccagugccuggguagguuugagaggggagggugccacuggccuggguccccggugaccauggcccugcuuccuugggcugaaucgggguccucuuccauccccucugcacacuagucgggcugcgugccagcauugaucucacugcuuccuugucuauagaaccucuugaauaaggcccagcuuuuccucagcucuuuauccagagccccuggcagagucauugggagugaugcuuaagagaggaagggaagaggaaggaaggagcaaaggacaaaggcaggcagauggguuuccaguggguuuccgauucacuggucuguccauguccuuugaaaagcugugucuuuucuuuaacuucaauucugugucagggccuuccgagccuucugaguuuuccccaaccuuaucuuagaguagguuaaaugaaguggcuucauuuucauaugacacaguugcacaaauucacuaacuaaaaaauggaauggaggcucacaggccauaaagguguugugaaguuauugcaagauacuuaacagaagaaagacucuagucaucuguuccuuauauuuauccuuuuuugucuaagucacaucaaaacucuuugucacauucuuuaaaaacaaaaagcaaaaaacaaaacuuuagauucaggggauccaugugcgguuuguuacguggauauaucgugugaugcugagguuugggcuucagucgaacccgucacccagacaguguacacaguacccaauagggaguguuucaacucucgucccugucccuagacacauucuuaaauauugcccagagaagauuccaggauaucccuuccuuagggucauccuggcauuuuacgguccugguuaucaaugagcuauuaaaaagcagggagguggaggcgccguggaagaagucucaguuucgaccacaugugugugauucaugggguuuagcauuguguguuucugcuccguagcuggaagugccgccacccucgccccacaugucauuuucaagccuccacuguuacagauucugucuucuguggacucuucagggccuguggucaggaaccuugugaaguguugcuggaagcuggggguggggagguggaauagaaucgggggcugaugccucccucuccugccucauuuuucugugggccucauuugguaugcaaggaaauaagccaaacagccugugaagaaaggaagaaugagauaguuuccuaaguugucucugccugaguuggccgcgggucuggggcucauucagcccuuugucccccuguugagugcagugcguguguggugacaaugagguggugcaguuacacugagggcuaaugguaggaguuccgucagcccauucauggaggcagaggagggugcagggcgcggagcucgagccagcaagcagaggaagucagaggcccuuguaacgagcugaagaucacaaacacugcugugagggcuccaggcuugggggcgggggcagccaggagggaagggggcaagggagggggccuaucaucauagaaguuggaggucugcccgaccgccagcgcgguaggguaccaccuguccaggcugacagacgagcauuauggcuucccuuuuaaucagcuuaauuuggggcaucuuaacacaauggcuggugcuuuggaggcugcaggaaagcugauguccuagagccgccacacuugacaugcguguaacaccuuuugauuagaggcgcuuucguguuuuuccagccacuugggcucugucucuuuuucuuggagauucucuggucuguaugucuuuacuuagagcuuagaagucaagguauauaggaaaaaggaguucugaaauuggaggcuugcccuuucuaaagccagucugagcuuucagccagaugucacugggacaagccacgucaacucuccacgcuccauucccuagcugggaaacgagggcauuuggcuauuugauuuccagaggcccuuuggaccuccaaauucuccaagucugugauuauuuguguaugucuucuuauaauccagccccuuuggaagcacuaacuccacucuucucucagcuugauccucuaauagaagcaaccugguuggauuuaagguggaggucuuccucucuccagguggcugcccucaucucuacccccaccccaaucccaugcauucuccugcccuccugcuuugggcaagacccgggcgauguggaguuggcauguccaguugcagguaucagcaccacugcaccaucuccucugccuucacuucccaccagcacacagaauuuauaugcccuucccaaguccaaaaagggccccugccaugcuaaacaaagguauucauaugcaaggcaugagcucugucucauggaagggagaggccaaguucucuuuccaccaucagagaguagcguucaacaucauuuauacaagacaggcuuuugcccuuuuagucuugcugaacuagaaugagggauuuguguagucgaaagucaagcugaucauugucaaguuucguggaaguggaaccugaaggaagguuagguggagacugcagagaggguuagcguccugccuuaccacaagguaagucuagaagaggguggggaagggaguucagaauucuucauucauggaguguaccugccuuggucauccuuuuaucuuccagucagaggggucaucagucaagagcuggccaggcugggugugguggcucaugucuguaauccuagcacuuugggaggccaaggcggguggaucaucugaggucaggaguucgagaccagccugaccaaucuggugaaacccugucucuauuaaaaauacaaaaaucagcugggggugauggcgugcaccuguaaucccagcuacuugggaugcugagacaggagaauugcuugaacccaggagguggagguugcagugagccgagaucgcaccauugcacuccagccugagugacagugagacuccgucucaaaaaacaaaacaaaagcuggccguagucaagucagugaugauuuggauugaaauuaaaaugugacuaaagagagaguaugcaguuuugucuaucuaugaaaccuuccucuguuuuaugugggacaccugggcacccacucuuggcuggaacuuacauaaaacacuacugugcacgcacaugucaccucaagucccguggcucugaaaguccaguagaagugacagccagacaucccaguccucccuguaggguuuucucagaacuguuccuuuaaggucucaggcugcuggaagggagggcugauagcagaaaaaguggggacacugggaacuccaaagggaagacgcgcauggccugaaaccgaguucuuucgcuuucuggagccuggucucccuauguggagggucaugcuggcauggcuggcaaugguuaauucaccgauggccauggagucccaaguuggccauauuauugcgguaaaagauacauuaacccagaugaccuugccgggggccagaauagagcccgugaggaaggagagcaaggcaggaucggccgggaggcgagagggauuuuguugaggagcaaggucuuccacaggaacugcgacuuggaaaguauucaccaagggcugugccaugcgaaacccucuuuaaaggaaccgcaucgcuacgccuaacgggcauuucuuuuuuaauguaaugguucagagcuauugucuaccacgccucgugugcacacgcacacacacgcaaguucccucagucagccgagaauccugccaucucuuuuagauaacaaaagcucuuaggccuuaugcuuuggguaggauuugucuuccauggacagguauucaguugggaacaaguauauagucacugccucuaugguauggagauacuccgauuuagucccucugccucuuggggaaaaaaaaaaaaaaauuguaaacauccccuucagcagcuucucaagucccuguacaguggaggaacauuacacgugaacuuccuggauucaauggauucuucuuugcaagaaaaaaaacaaaacaaaaaaacagagaaagaagaaaauaucaauuuagacuguuagguccaacguuucacucagugagugagcacagggggugacggaggauggcuggaaugugggguugaagcugcuguucugggucucagcuccugcccauguaccguggagugagcaucucacaccacgaugauucuggcauuuaagugaacuccuucacacggugcucaaguggagaaagggcuguccaugucuaucccagcuuagaagaaaaacugaugguaugagacuugccauuccucucugauguagaaccugccuaagggacauuccacagcaguucugaccguugucacuuugugccuuaacccccacauucauuuugauucuauauuuaguauuaaauuuuuuagauuauuaggauuuaagguuuucaaacaucuacugaaaugcaagugccccuagaaacauuauacuuucaggccgggcucaguggcuuaugccuguaaucccaguacuucgggaggccaaggcgggcagauaccugaggucaggaguucaagaccagccuggccaaucuggugaaaucccaucucaacuauaaauacaaaaaucagcugggcgugguggcacgugccuauaaucccagcugcucgggaggcugaggaaggagaauugcuugaacccgagagguggagguugcagugagccaagauugugccauugcacuccagccugggcgacagagcaacacucugucucaaaaaaaaaaaaaaaaaaaaaaaaaaacagaaaagaaaagaaacauuauaccuuaacuuuucgcaccuagugagugauaaccuaugaggauaaugcugccacaugguccuugagggaagaacuuggggaagagccgaacagggaugaggcaggugagccccaugugauuuaucgucauucauucagcucaacaggucggacaggguaaggguaagggauguaaccaggagaugccacaggaacgucugagagguguuagcaagucccagaggccagcgcccgacuccauuucagccucguucaggguggcacggagacuccugcugcugcgucacgucugucauguucagcacucuucccagacacacagucuugacuaaagauugucaggaucuugacacacgcuucauuagucuugacuaaaugcgaaucuauaccucauuucaaagaaaucugaauucuuuagguuccaggaccaguuuauuguuauacauaaucacgaucauuuauugagcuccacuuagcacugcacauauaucaguaucaucucaguugcccuuuacucugauuauuuuguggggaaacugagaucagaaaaguuaaauaacuuaggugccaccugcaaguauagugggugggcagcagauaccacccuuccucauuucauuguuccaggugauauuucgucucugccuuuggccuuuagucugugguuguuccuaaucuuaguuuucauugaaagcuguaguuugaaaugugggauagaugagagauaggaaaggaaaauuuagggguauggaaauuuuguuccuuagugguuaguuccagcuuuauuuuguuuauuuauauguuuguuuuuaaagaucgggagcuugcuguguuguccaggcugguaucgaacuccugguuucagcuucccgccucagccucccagagugcugggauuacaggcaugagccaauaugccuggccagcuguguuuuagaucuuugggaaauaaagagaaugcuuuugggcuuggcaaaauagaaaccucuggguggggagaauugcacaguaaaagaaacaaaagggaaguuuauauuaaacuaugaaaagacacagggagguucaauuuaacauauuugccuuauguaugugcuucuuaagagagugcacaaaggcaccuuugcagaggagagaggcuagaaaaugcccguuagaagcaagucuacgguuugcacccucuuacuagcaccagcaacggucccugucuagugauacccaugacuugucauugcauugcaugucaucugccuaagagaagcuccugccuggggcagacacacugucaauuaccccuacaauauagacugauacuaaagcaaggcugcauauucuugcuuauucccaaauuggauggcucaagguuccagaauguuguagacauucugcauuauaucuuuaugagaguuaaggaaaugguaaagaagcagaaaaaguuggggauuuuuuuuuuuaaguauuuacagugaggcgcgguggcucaugccuguaaucccagcacuuugggaggccgaugcgggcggaucacaaggucaggaguucgaggccagccuggccaauauggugaaacccugucuguacuaaaaauacaaaaauuagccaggcgcgguggcgggugccuguagucccagcuacuugggaggcugaggcaggagaaucgcuugaacccggaagguggagguugcagugagccgagauugugccagugcacuccagccugggggacagagugagaaaaaguauuuacaguuuaugugagggucaguacguugguucauuggcuuccuucuuaucuaguucucgggcugaguuugcuaaugucauagcacuucuaguagccuuccccuuuucucugccacuucccagcuuccccaggcagaaagcaucuggucggccccuugauuaccaggcauccauaagugaccaucauuuaggccagugcuucucagaaugccaaucaccugggcuccacuaaaaggcagguucugaauagcucggccuggguugacugagauucugcgguuccaacaagcucgcaggugaugcugaugcugccagcccauggaccccaccuggaguagugagguuccuuggcacuuuaagaacaucccuccuuuacuucacauuuauuucuacuggaaacuagcacagacuuaugcaagcuaaauuacgcauguuuucuccguaggaugcucuauguccuguuccucuuacuaacaacucuggucuggaccauuguucuaggauugucucaaagcuugccaggagcagauugaggcggugcuccucaauagccugcagcaguaccgucaggaccaacgugacggauccaagucggaggaugaacuggaccaagccagcaccccuacagacgugcgggauaucgaccugugaggaugccaguugggccgaaagagagagacgcguccauaaucuggucucuucuucuuucugguuguuuuuguucuuuguguuuuagggugaaacuuaaaaaaaaaauucugcccccaccuagaucauauuuaaagaucuuuuagaagugagagaaaaagguccuacgaaaacggaauaauaaaaagcauuuggugccuauuugaaguacagcauaagggaaucccuuguauaugcgaacaguuauuguuugauuauguaaaaguaauaguaaaaugcuuacaggaaaaccugcagaguaguuagagaauauguaugccugcaauaugggaacaaauuagaggagacuuuuuuuuuucauguuaugagcuagcacauacacccccuuguaguauaauuucaaggaacuguguacgccauuuauggcaugauuagauugcaaagcaaugaacucaagaaggaauugaaauaaggagggacaugauggggaaggaguacaaaacaaucucucaacaugauugaaccauuugggauggagaagcaccuuugcucucagccaccuguuacuaagucaggaguguaguuggaucucuacauuaauguccucuugcugucuacaguagcugcuaccuaaaaaaagauguuuuauuuugccaguuggacacaggugauuggcuccuggguuucauguucugugacauccugcuucuucuuccaaaugcaguucauugcagacaccaccauauugcuaucuaauggggaaauguagcuaugggccauaaccaaaacucacaugaaacggaggcagauggagaccaagggugggauccagaauggagucuuuucuguuauuguauuuaaaaggguaauguggccuuggcauuucuucuuagaaaaaaacuaauuuuuggugcugauuggcaugucugguucacaguuuagcauuguuauaaaccauuccauucgaaaagcacuuugaaaaauuguucccgagcgauagaugggaugguuuaugcaagucaugcugaauacuccuccccucuucucuuuugcccccucccuuccugcccccagucuggguuacucuucgcuucugguaucuggcguucuuugguacacaguucugguguuccuaccaggacucaagagacaccccuuccugcugacauucccaucacaacauuccucagacaagccuguaaacuaaaaucuguuaccauucugauggcacagaaggaucuuaauucccaucucuauacuucuccuuuggacauggaaagaaaaguuauugcuggugcaaagauagauggcugaacaucaggguguggcauuuuguucccuuuuccguuuuuuuuuuuuuauuguuguuguuaauuuuauugcaaaguuguauucagcguacuugaauuuuucuuccucuccacuucuuagaggcauucaguuagcaaagagguuggagcaacaacuuuuuuuuuuuuuuuugcacaauuguaauugacagguaaugaagcuauuuguuaaaauauuugccuuuuuaaguaaaaaagaaaaaucagaacagggcuauuugaagaauuauuuuauacacagauucugccuuguuucauaguaugaggguugaagacggaaaacaaucuaagggucucucauuuuuuuaauuuuguuuuguucaguuugguuuuuuuuuuuuuuugcgcugcuaagaagcuaaagucauccauccuuauucacguugacaguaccuagcuguaauguuucacagagugugcugcuauuuuauaaacauuuuuauaauauauuauuuuacugcuuaaauuccaaguccugaaguagaugguugagauaugaguucuucguacuggaaaagcccuuccguaguuuguuuucuucugguagcauauucaugguuguuuuuuuuuuucuuuuuugguuuuuugguuuuuuuuuuuuccucugaucacauucuucaaagacggaguauucuuuaccucagguuuacuggacaaaaucaauaacuacaaaaggcaaugauucacgcuuuuguuuucauaauaccucacaaccguacaguuucugcuugggagcccauucgcaugaggaauacagaagcagugugagcagggcugacucccucucagguggaaggcagggcggucucacucccagggaccuuuuuggucauggaggccaucgggcucccaguuagacccugguauccucaucaugauggaaaaaauacauugaaccaagggauccucccuccccuucaaggcagacguucaguacaaacauuuaugcgguaggcucagaugucguaauuugcacuuagguaccaggugucaggaaacagacuaaaaagaauuccaccaggcuguuuggagauccucaucuuggagcuuuuucaaaagcggggcuucaucugcaaagggcccuuucaucuugaaguuuuuccccuccgucuuuccccuccccuggcauggacaccuuguguuuaggaucaucucugcagguuuccuaggucugaaucugcgaguagaugaaccugcagcaagcagcguuuauggugcuuccuucucccuccucugucucaaacugcgcaggcaagcacuaugcaagcccaggcccucugcugagcgguacuaaacggucggguuuucaaucacacugaauuggcaggauaagaaaaauaggucagauaaguaugggaugauaguugaagggaggugaagaggcugcuucucuacagaggugaaauuccagaugagucagucucuugggaaguguguuuagaaggguucaggacuuugugaguuagcaugacccuaaaauucuaggggauuucuggugggacaauggguggugaauucugaaguuuuggagagggaaguggagcagccagcaaguaagcuagccagaguuuucucaagagccagcuuugcucagcacacucuccugggccccaaggagucccacggaauggggaaagcgggaacccuggaguucuugggaaucuuggagccuaaagagaaaccgaggugcaaauucauuucauggugacugacccuugagcuuaaacagaagcagcaaaugaaagaaccggacaaauaaggaagggcacaagccuacccgacucuauuuacagucuguaacuuuccacucuuccuguagucccgaggccccuggguccuucuagcuuuucucuuucccauccuuggggccuugugugaugauggguguggggcugccgaugggaaagucggggguuguuaggcuuuucugccugcuccugcuuaaacacaagaaggaauccuggauuuugcccucuccuuagcucuuagucucuuugguaggaguuuuguuccagaggagcucucccccuuggauuugaacuugcucuuuuuguuguuguuguucuuucucuucuuuuucuuaccucccacuaaagggguuccaaauuauccuggucuuuuucuaccuuguuguguuucuaucucgucuuuacuuccaucuguuuguuuuuuucuccaucagugggggccgaguuguucccccagccugccaaauuuugauccuuccccucuuuuggccaaauccuagggggaagaaauccuaguaugccaaaaauauaugcuaagcauaauuaaacuccaugcggguccauaacagccaagaagccugcaggagaaagccaagggcaguucccuccgcagaacaccccaugcgugcugagaggcgagcuccuugaagaaggggcuguucuuccaggaggccuuauuuugaacugccucaggaccccacuggagagcacagcaugccuuacuacugggucauccuuggucuaugugcucuguacuggaggcucuguucugccucuuaucagccaggucaggggcacacauggcuuaagugacaaagccagaggagaagacaacccugacagcaucacgcugcaucccauugcuagcaggauuggcaacucuucagacggagcugcgcuucccugcagucuagcaccucuagggccucuccagacugugcccugggagcucugggacugaaagguuaagaacauaaggcaggaucagaugacucucuccaagagggcaggggaauuuucucuccaugggccacaggggacagggcugggagaagaaauagacuugcaccuuaugucauguaaauaauugauuuucuaguucaagaagauaauauugguagugugggaauuggagguaggaaggggaggaagucugaguaagccaguuggcuucuaagccaaaaggauuccucuuuguuuaucucugagacaguccaaccuugagaauagcuuuaaaagggaaauuaaugcugagaugauaaaguccccuuaagccaacaaacccucuguagcuauagaaugagugcagguuucuauugguguggacucagagcaauuuacaagagcuguucaugcagccauccauuugugcaaaauaggguaagaagauucaagaggauauuuauuacuuccucauaccacauggcuuuugaugauucuggauucuaaacaacccagaauggucauuucaggcacaacgauacuacauucgugugugucugcuuuuaaacuuggcugggcuaucagacccuauucucggcucagguuuugagaagccaucagcaaauguguacgugcaugcuguagcugcagccugcaucccuucgccugcagccuacuuuggggaaauaaagugccuuacugacuguagccauuacaguauccaaugucuuuugacaggugccuguccuugaaaaacaaaguuucuauuuuuauuuuuaauugguuuaguucuuaacugcuggccaacucuuacauccccagcaaaucaucgggccauuggauuuuuuccauuauguucaucacccuuauaucauguaccucagaucucucucucucuccucucucucaguuauguaguuucuugucuuggacuuuuuuuuuucuuuucuuuuucuuuuuuuuuuugcuuuaaaacaagugugaugccauaucaaguccauguuauucucucacaguguacucuauaagaggugugggugucuguuuggucaggauguuagaaagugcugauaaguagcaugaucaguguaugcgaaaagguuuuuaggaaguauggcaaaaauguuguauuggcuaugauggugacaugauauagucagcugccuuuuaagaggucuuaucuguucaguguuaagugauuuaaaaaaauaauaaccuguuuucugacuaguuuaaagauggauuugaaaaugguuuugaaugcaauuagguuaugcuauuuggacaauaaacucaccuugaccuaaauua

SEQ ID NO: 191701 - RNA, 22645 nt, Homo sapiens
gcuucccauacggcaguggcugggggagagugauggagagaaaggcuaagcuaaggucaaagaaaguggaggaaggcuggcuugucccgcuggacuugacggcggagcugcugcaaucucgcgggcugggcccuugccccggguggacccgagugccugcggggaggcggguguggcucccccgggaggugacagcuggcggggcccguaaggagcuggucugcuccggcuccccucucguagccggcgcccugggaccagcgcgugagcacgucucggaggaguccgaugcgcugggcagggccggguggucacccccgcccagcuuccaggggugacugugccucugacgucagacgguuuuugggucauucccuggcacggggacuuuauuuucauaacagcaugaagugccguggaacuggaauaggcguguccucucccucgacccucccccuccuugucccucugcucaccccucgcucguucccucccuccggcgagggccgccuuuauaacaacugcucagagugcgagggcgggauagcuguccaaggucucccccagcacugaggagcucgccugcugcccucuugcgcgcgggaagcagcaccaaguucacggccaacgccuuggcacuaggguaagugaggcgccaggagcccagagcgcuggggccuccggauuuaaaucgucuggggagagcggggcguugggaggggugggauagaagaggagagaaauccugguaauggaauacaguuggcuaugagaaaaaaauucccuaggaaacaguuccucuaguuuaacaacucagauuuuuuuuuuuuuuuuuccccuuugcggguuuccuaggcuaagauagaggcagagagcaaagagauaaucaggguaauaguuucugcucggacacauucuacaaacuuugaguagauggaauccggccaggcaggaggugagcagcucugggaucacucugcaggaaaagaauagagggagaaagaucucagaggacccgaagguacugggaguggagggggagugggaaacaaggggcaggggcaggagggaggacacggugacagcuacuauuuuacccagaugcugcaaaaagcccuucugaguuuugggaauuagaucuagaagcccaucccuuuucucuugaugugugggcggucaguuccacucuggugugccuugaguugcucagaaaccugggacagaugaaaguugaaugugcgcugagagugcaccuuccacuaccgacuuuauggauaggauuugggaauagcauagaugcuguuccaucuggucccuuaaacauccauggggaaggcuggcaaauagcuuuauuuuauuuuuugagauggaguuucacucuuguugcccaggcuggaguacaauguugcgaucucagcucaccgcgaccuccaccucccggguucaagcgauucuccugccucagacucccgaguagcugggauuacaggcaugcaccaccacuccugguuaauuuuguauuuuuaguagagacgggguuuccccauguuggucagguuggucucaaacucccgaccuaaggugaucugcccgccucagccucccaaagugcugggauuacaggugugagcccccgcgcccggccacagauagcuuuaaacauccaugggaaaggcuagcuaacagcugaaaccugcucagaaucaaggaauuugaaggacuuuccauuccugacuucuuuccauuccugauugucuccucagaggcuuguguaaacaccacaccuguugaaggguucggccgaaucagccacugcuguggguucauuccugaaggggaacacuucagcuacuucagacacaaugggcuagggaccacgggaggggugagggcggagggggcacacacccuccagguuugcaugccggugucugcuaggugagggaaggaaugaggggaaggaagggccgggagaggcgcuacgugggaaacaagggaccucuccaagggcguggagaggugagugccucaagggcagaauggaaugagcagaacccuuugguuucccgggaagagcucucaaccuugagucaggaagacugauuucuccucccagcuccgcaggaacauggaacugugaucaggcaaggggcugggccugaguuccucauaggggucuuggggaggcccccaguuuccccuccuguguuucgauucuggccccucuccaucugcacacgucgccuuggaaguucccuuuagaacuggcuuuuuuguauucuagucuugaaugguaaucgaagacaacaggguaugaagaacaauuuugacggcgugauuuuauucuucucauucuggguccacuacuauuuaaagucccaagauuaagcugaggaauuaauauggugguauaguaaacaauaaauugaggaguauuuuugcuugaggaaucuuugacuuccugaguaguucaggguguuugcuucuuuuauucucauuuuuauugcacuguggucagacuauauggucugcacauuucuuauuuucuaauuccagauuugucuuuguauucuaaauaugcucauuuuuggcaaauguuccauuuggaccauggaccauaguuccuauuaagcaaucauaauagaguagagauggcaaacuaugguccauggaccaaauauggccuauagccucuuucuguaaauaaagugauuuuuguuuuguuuuguuuuguuuuuguuuucguuuuuuugagauggagucucgcucuugcccaggcuggagcgcagugacgugaucucggcucacugaaaccucugccucccgguuucaagguuucaagccauucuccugccucaggcucccaaguagcugggauuacaggcgcccgcuaccacgccuggguaauuuuuguauuuuuaguagagacaggguuucaccauguuggccagacuggucucaaacuccugaccucaggugaucugccugccucggccucccaaagugcugggaucauaggcaugagccacaaccuguaauccacuauuuuacuaaaacacagcaaugcucauauguuuauguaucaucuaugcugcuuucaugcuacaaauguguggcuugcagagucuuaaauugcuuauaaccuggcccuuuauagaaaaucuaugcugaucacugauauagaggaucugaauuauaugauuaguaauggagaucuaauaagauaugaagauagagaauauuucuauuuaaguauccauagaacauuuacacaauuuuaccauguucuuauucauauuguauauuuuaucugccaaggacugguaaagaaguaugaaagucucaugcaacuauaguauugccuuuggguucuccuuguauuuucagcaguuauuuauuuauuuugagacagggucuugcucuguugcccuggcuggagugcaguggcacaaucuuggcugacuguaaccuccaccucccaagcucaagugauccucuugccucagacucuugaguagcugggucuacaggcacccaccacuacaccuggcuaauuuuuaaauuuuuuguagagaugggguuuugccauguagccuaggcuugacucaaacuccugggcucaagcaaucuuccugccuucacuucccaaagugcugggauuauagguguaagccucuguacccagccuucaguacuuuuuguuuuacguauuuuggugcuauauuaguuggugcauaaaagucuaggaugguuuuuuuuuuuuuuuuuuuuuuuugagacagagucucgcucugucacccaggcuggggugcaguggugcgaucacggcucacugcaagcucugccucccggguucacgccauucuccugccucagccucuugaguagcugggacuacaggugcccgccaccaugcccggcuaauuuuuuguauuuuuagcagagacaggguuucaccguguuagccaggauggucuugaucuccugaccucgugaucugcccgccucagccucccaaagugcugggauuacaggcgugagccaccgugcccggcccaggaugguuuuaucuucaguguagagcaucccuaauuauuauaaaacaagccuuuuggucaauauaauaucuuuuugcuuugauuacaacuuuguaugauauuaaaaccuuaacuucuacuuaauuauuuuaccuugaacaacuuacuuaacuuugugucugacacauaauacuuguuaaauaaauauuauguuaguauuucuuuuuauuuucauuucuuucuguucuuuugcuuuuaacucuuguguaucuuuuuguuuuagguuagguucuucuagguaugauauaguuuagucuuuuuuuuuuucaaaauaguuaccauuuacauuucuuguaauaauaguuacuuguuauugucaucuaauuuuaggcuauaugguuugguugucuccaucuccuucugcauuagacaguauauaucauaucauauuuuuagaucuacuagcaacugaguagaugguagugccauucucagggcuuugaaagauaggcuuguaaggagaggugaucaguuuagcuuugaacuuguuggauccagugaauauuacccuuauguaucagaauaagauauuuaaaugaagggaucuuugagagccuuaagauaguauacuaguagagggccggcgcgguggcucacaccuguaaucccagcacuuugggaggcugaggcgggcagaucacgaggucaggaguucaagaccauccugacuaacacagugaaacucugucucuacuaaaaauacaaaaaaaaaaaaaaaaaaaaaauuagccgggcgugguggugggugccuguagucccagcuacucgggaggcugaggcaggagaauggugugaacccaggagguggagcuugcagugagccgagaucacgccacugcacuccagccugggcaacauagugagacucugucucacaaaaaaaaaaaaaaaaaaaaaggauaguauacuaguagaggacuucacuuuauuuuccuauuuucuggaaauuucauuucuuugaauucgggcauaagagauuuagaagcuucacucaaauauuaagcuuuauuuaaaaagaugauuuccaguauuucauuuuauauucacauuaaucaagucuacauguuucguuuagaguaacaggaagaugguaauacgcccagggaacuaucuggaaguguagaaauugggaugaacaccgugguuauacuuguuuugaucugccuguggugcuaugaugacuuauuuucucucauuauugcauagaaacucaauucagugauguuauucagauguuauucauaaguuauugccaugauucaucacuuuuaugucaucagaguugggauggcuacccagaauaggggauccuggagauuucccuguagacgcuuugcauuuauaaauaauccuuuaucaagggcagagggauuucuguaggacuucucccuuagaagaacucagccuggguagaaauacgaggauuaacaucagcacauauucaucuccaaaaaauuuuccuccccauuacucacacuugccaauaaauaacuugcuuuggguaaauauucagcacucagucuuaguccaaagcauuugcucagcaaucacuguguagaguacagaguaagggggauaccaacaaauagaaguuugcucuauuuucuuaagaagcuuguugucuggccaggcacggugccucacgccaccuuccuaucuuccuaggagauagaugccacaaagaagcuuguugucugauaggcagcucagcagugauauuaauuuguaauauauaacaaagauauggaaaaacuugagugccaagaaauauuuaauuguaaaaaccaugaagagaucgacacauuuagagugcaauaggauuucaaguccaggugugauggcuuacgccuguaauccuagcacugugagaggcugagguagguggaucacuugagcccaggaguucgagaccagcuuggccaacauagcaaaacccugcgucuacuaaaaauauaauaauuagcuggaugugguggcgcaugcuuguaauccaagcuacuuaggaggcugaggcacaagaaucgcuuuaaccugagaggcagaggcugcagugagcugagaucaugccacuguacucccaggcuggaguacagagcaagacccugucuuaaaaaaaaaaaaaaaaaaaaggccauaggauuaauaguaauaaugauaauaauuuaaaaaacucaugauagagguuaaaucuugggcaaaguuuugcagaaauaugguaaguggaucauaaauaggagggagaggaucuuucugguuaggagaauaauucauguguugaggcaaagagcaugagaagaccuuaaaugaacccaaauucccuuccagauggaaaauacagaacucuaggaagauuugcuugccuugcacggagguggagacgggaguuagggaggaaggaggagauaggugggaggacuaauuggagaaaggccuugaagcucaaacuggggcuggaucugccgugacagacaaaaaggagcgaauacgcuucuuuuuuuuuuuuuuuuugagaccaugucucacucuguugccuaggcuggaguguaguggcgugaucucagcucauugcagccucugccuccuggguucaagcgguuuuugugccucagccuucugaguagcugggacuacaggcgugagccaccaugccugguucauuuuuguauuuguaguagagauggaguuucaccaugcuggccaggcuggucucuuaacgccugaccucaggugaucuacccgccucggccucccaaaguucugggcucacaggugugagccacugcgcccggccgauaauuucuuuuuaaccuccuuugcggacuccuaccuagaugagauggugcuccacaugguucuguccuuggcuucccaugugaucuugucuccucuugaggcuucagauaccacucuaggugaugacugccagucugugcuuacagcccaaaccucuccugagcaccaacccauaugcccacggugcagagacagcacaacccagugucaaggagccuggcuuuuaagagucauguaaucuugggcaaguuauguaauuucucugugccucaguuuccucagcuguuaaaggaaggcauaauaauaggguuguugugaggauuaaauaacaccauauauggccaggagcaguggcuugugccuguaaucccaguacuuugggaggccgaggcgggcagaucaccugagccucaggaguugaagagcugccugggcaacauagcgagaccccaccucuacaaaaaauacaaaaaguagcuagaugugguggugcgcaccugucccagcuauucaggaggcugagguaggaggaucaccugagcccaggaagucgaagcugccgugagcugugauugugccauugcaucacuccagccugggcgacagagagacuuugucucaaaagaaaaaaaaaaagaaaaaagaaaggaaaccauauauggcucagaggaaacucucaagaggacuugggucuuuugacuuguuauuccuggauagcuccacgugcaggucgcauauuuaucaaagagccaacaaagcuacacuuagcaucucuccuuucaagccuguauuucuaggcucugacaguggugccacucaguugccuaagccagaaaucugggaguuaaccugggcuuuuccauucccaaagcccugucucuucuaccuucauaaaaaucuccuaccauuuccuguucaucuuucauguuucaucucccugcuuucuucccuaaagcauuaaacauuaaaaauaauuauuuuaaaaccccacuagguagaaugggucacuguuuuccaugugcccucagcauuccuaauguauuccauaacuucuuaguuguaugucagugugauuauuauucauuccaagggcaguggccacaauuuuauauuuauuuauuuaguuuuuuguuuugagacagggucucacucuguugcccaggcuggagugcaauggcaugaucauaguucacugcagccucgaguuccugggcucaagcaauccucuugcuucacccuccgaguagggggaucacaggugugauccuggcuaaauuagcacccggcuaauuuuuaauuucuuuuuguacagcgggggucucacuaugcugcccagguuggucucaaacuccugggcucgagugguccucccaucucucggccucucaaaguacugggauuacaggcguaagcuacugcccccggccaggguugcuuguuuuggagacuucucagcaagccaaugcuugaauauauggugguuuaaauggagagagguuggggucagggagaaaagcucuagagaugaugacagugauuuagaggugaaaaggaggauugaauuaugauuaugacuacuuauaaagagcuauucuuucugaccaugugacacuggacauguaccuuccucacucuguuagguuucucaccuauaaaaugggcuguaggaauguuaaaugagguaauggauguaaaagcauguaaaugagagaauauguguaaaaauacauaacuacucagcauagugccugacucauaauaggacucaggaggugacaguagcugucauuauucuuacucauaauuacaucaugacuguuauuacuacugacugaauguagcaauucgagaauagagaaaaaaugaaaaugcuagaaagucacacauuuucagggcugggcuggcgcgaagacacauuuugacagaaugagagaaaucucauaggaaggaagacaaagucaguuugucuuugcaagguucugggccccagaugauucauucucagaugcucugggaaggacugcguagaauaagcaugggcaaacuuccaggccuagucacaagcaacucuacacacuuuccccaucucucugguugcgaagaggagucucagguuagaaacccaaagcgggagacucaucacauguucacguuuuucccugcacaguggucagugcugugugucagucaaggccaugucuagggucagcgcugcuccaggagccucuggcuuuguccuucaggugggcagucccuugcugugucucuucuucagacccuucaaccuuaccucuagcccuggcuuuuaguuuggguaggaguuuguggcacauacucuuuuaaugacaggagauggggcaagaaugaggaugagggggagaaagaaagacaucuggaaguuuuguacaugaagcuccccaggugggugaacgguggagcugaacaugaguucagaccacguaguucagcagcguguccugcauuuuauagaugagaggaggcuuugagaggucaagugacuuacuuguucacacagccuggcagcugaaaccccuucucccuaaaggggaggaggaacagagggcuuggaguugacccaagaaaugacuucgcccuccucuuccuuuccucccucuuccucuuguucuuauucuucccuucccucucccucuuccccacugguuuuucuaaaccuuucuuuuggggccgggcacaguggcucacgccuguaaucccagcacuuugggaggccgaggcgggccugaggucgggaggucgagaccagccugaccaacauggagaaaccccaucucuacuaaaaauacaaaauuagccgggugugguggcacaugccuguaaucccagccacucgggaggcugaggcaggagaaucacuugaaccugggagauggugguugcagugagcugagaucaugccauugcacuccagccugggcaacaagaguaaaaacuccgucucaaaaaaaaaaaaaaaaaaaaaacaaaaaaaaaacaacccagaaaaacccaaaaaacaaacaaacaaaagaaccaaaaaccccuuucuuucaugccuagauucauuccaaaaagguuuaagacagcaacaagugauuccaggaucucagcugugggcauccuuguguuacuggauggcuguguguuaauuguuagcagcuggaauaagugaagagggucucguccucauacucaaaguccuuugcucaugcccaaggccagaggcuacucaugcugaaacauuaccaucucccuccaaagugcaggguuuagucacugaguacuggguggagcacaugacuggaucccaguuaaucccucccagcuuaccaguaaaaccucaggauucaugcuuuccugggagccaccugcggccacuaagauaggagcgggguucagacauggccaggcgcuccuaaucucagacccaaagugcaauuuuuggcagccugcaugagaaggagggugggaggaaagguggcuagaaccaaggguagcagccugggggcuugagaggaaaccaggcacagcccauccuacccugucucacgagcagcccguccuccuccugacuccccuuaccccacacaccgagcgccauucucuugcugccucaucuauucugguuagguacuuacugagcaucaggugcuaggcaaguggcuggggagagacaacguuuaaugacucagucuccgccugcacagagccuuugagucuagagggagacacagacuuacugacaggcuggguuguguaauaagugcuacgggaggaaaagcugagagugucugagaauuuaugagaugugugucucaucagacuugggcaucaaaaaaaaaaaaaaaaaaaaaccauccuggaggaaaggaccucuacgucaagugaagggugggguccauuugguuuuuauaggagcaaguucuuuguuggcuggacucuagaucucccguccuuugacuuugguuacaaauaauauccaaaccaccgcuagucucauucucuuuucucuuuccugcucuagcccuuugcuccucucccaggcuguuucucuagcuccagacaguucauauuccuaaaugcugaucacuucucuuuucccucucaaaugcugcuuucuagaaaucauuuucaguuuuucagaacccuguccaucucuuccaauccccuggugucuuucccuuaccugggucauucucugggcaacauggcacccuuucagugcagacuuguuuauuaauaacuccagugaguuuuauuuuccucuuacuaaauucaaaguacucagaacauuuuagacuuguugagcaaucccuaucagcuuagggauggggugggggaggcuaacagaggugaauuaagaaugauaauuccaaacuaauuagucauccagauuaaaaaaaauagacuaagaugguuuuuuuuuuuuaaagacauuugugagagaauugggaaauaugaauccuaacuagauaguugauaauaaaggauucuuguuaguuauuaaagugugguuaagaaggaguuuuuaucuuuuagagagacguucuagacuggacaugggggcucacaccuguaaucccagcacuuugggaggccgagagggggaggauccuuugaagccaggaguucaagaccagccuggggaacauagcaagacuccaucucuaaaaaaauaaagauuaaaaaaauuagccaggugugguggcaugcgcuuguaguuucagcuucuugugggugcugaggugggaagauaccuugagcccaggaagucaaggcuccagugagccacagucacaccacugcacuccacccugggugacagagugagaaucuaucucaaaaagaaaaaaaagggcugggcacgguggcucacgccuguaaucccagcacuuugggaugcugagguggguggaucagcugaggucggguauuugagaccagccugaucaacauggagaaacccugucucuacuaaaaauacaaaauuagccgggcaugguggcgcaugccuguaaucccagcuacucgggaggcugagguaggagaaccgcuugaaccugggagguggagguugccgggcgccgauaucgcgccauugcacuccagccugggcaacgggagugaaacuccgucucaaacaaaaaagaaaaaagaaaaaaaaauacacauacuauuuauagauaaaauuacaugaugucugagacuugcuuaaaaauagucuagggagugggguggggaaugcagacgaagcaaaauuggccauauaguaauaauuuuuugaaaugaagugcuggauacaugggacuccauuauaaaacuuucuauaaugaaaacaaguuuuuuuuuaauuuuuaauuuuuuaaaaauagacacggucuuauucuaucucccaggcagaauugcggugacgugaucacagcucacugcagcuucgaaauccugggcucaagcaauucuccuaucuaagucucucgaguagcugggacuacaagugugccccuccgcaccuggcuaauuuuuacauuuuuauuuuucuagagacaguggucucaccaucuugcccagacugcucuugaauuccugggcucaaacgaucagcccgcuucggccucccaaagugcuaggauuaaaggccugagccacugcggcuggccuaaauaauguuuaaaaggaacuucaagaacuauuucuccauucccuguugcaugauugggaggugggagguggaggugacauuuggggaaacugguuuuuucuucucuuuacacccacugccauuacuuuuguuggauccuggucuguggguucuauaaggcccugagacucagcacccuccugcgcagcugcgcuggaagaggagccuauagguucuagaugggggcucugccuucccuccugucuguccaguaccagaacuguucuugaggcaaacaccacaucaaucucugucaagauuuagagucaucagguucaaagucccucauaacgauccugucccucauaacaaucagguaauuaugaaaacaacuacuuguccacaaacaguaauaccugauggguggggaaggagcaauuggcagagaggggcagggagagggagagaucaaagggaagagggaaauaccuuuccugcuagacaacacccuggugauuaaucugccgggguguggagagacacagugaagugcacagggccugaguuccuuccgcucgccgcccuugaaggaaauagggucuuccucuuccacauucacgguguagccugggagagcccucauacuuccucuuucuuaugucaaagaggggaccaaagaggggacauuuguaggcaagacggaucagacuugggugcuuggauugcaggggcugucuauaucugaaccucauuugccuuuuucuuccuauuucucauucugcacugcccuguagagguauagcccauucuuugugcucugcuugugguagcgauggcugugguguagcuuccaggaggguagaguguuuaggugacagacccacugugagggaaggcggugggaggcccauggccauagugacaggugccauccgucucucucuucuacugugguagaaguggaaacgugucuguuucuggcuuuaccauggagugcuuagagcagugaucagcacauaguggugcucgguaaauauuuguugaaugaaugacuacauaaaauaaaguugagauuggagagccaaauuuuauuaaaauucgggaagaucgauuuaagcuauaucuggugucacuuuaacacacuauacauaauaucgugauaauauauauucacaugauauucacauauguaucauacauauguauguauauguauauauugcauauauacauauguacaaucuuccuacuugcuauaugaauuaaauaauuuugguaagaugacuaucucuucuaguggaaaagaaaauuuugugguuuuuuuuuuuuuuuuuuugagauggaaucucucucugucacccagccuggagugcaguggcaugauccccgcucacugcaccucugccucccggguucaagcaauucuucugccucagccucccgaguagcugggauuacaggugcgugccacuaugccuggcuaauuuuuguauuuuuaguagagacaggguuucgccauguuggccaggcuggucucaaacuccugaccucaggugaucugcccgccuuggccucccaaagugcuggaauggcauaagccacugugcccggccaagaagguuguuuuuuccgagcuguuuuuucugcucuaaggaaagaggcaggauucaggggaugcuuuguaucuuuuccugcuucccaacccgaguccuuccucuuguuuuggauuucuugcugcaucaucucuguccuucuuuagggcuggaggugaccucugcgagccuucccuuccucuaacucuggccucuuuccugcugcaacauaguucucuucuaguccguucaaaacuuuuuauugccacgugaacaaucucauugggaaacaaaaaacucaagaaaaaaaaucccaugcccaaaaagcauggaacacaacaaaaagaauaguguagaagacacuuaaauaagcaauaaaauaauuugaaugaaauuguugacaaacuggacuauaguuaugucuagccuuguugaaucucaacaucuuauucgacauugacuuuggaauuugugagccaccuguuuugaggaaauggggacacuccuuucucuuuuucgauuucccaauuuaucuucccacuugugcccugaauccugaggacuuagauuuccuagggguauggucaaggagcugggucuaaaauucacacgaagauuguaggggcagagaaagaagccuuucuccugacaaaggacagauauaugggaaguaaacuguaauacagcuaguggcuuccugauuauccgaaugaguaaguagauuucucacuuuguggaugguccguuaccugggaucuccuauccuccuggggcugaacuaggagaguggaaccagagucauaaugaggcaucugaugaggggagggguagggagagagagaaagagacguagagaggaggagagagagaaggauaucucagaucucauuuuaaggcuaauuugagaggagacacguagaguacuugagaaccuggguccuggcaccagacaaccuggauucagauccuggcugugccauuuccugguuguaugauguugggcauguaacuugacuucucugccucaguuuccucaucuguaaaauaggauaauaguuuuaccucauaggguugcuaugaaaugaaguaaguaauguauauauagagugauuagaaguaaaaauucgaggcugggcggggugacucaacaccuauaaucccagcacuuugggagggcaaggcaagaggauuaauugagcccaggaauuugcgaccagccugggcaacauggugaaaccccaucucuacaaaaauacaaaaauuagcggggugugguggcacacgccuguaaucccagcuacucaggaggcugaggucgggggaggauggcuugagcccaggagguggagguugcagugggucgagauccagccugggugacagagcgaggcucuguuccccccauccccccaaaaaggaguaaaaauuggagcaauacuaaaaaugaacauguuagcuaugaagauuauuuuuuguuggauuacccgcuauuuaugugccauccaggacguuccucuuuacagguagccaauuuagagcugguuaugacagacaagaccccuuucauaacuuuucggaauuaguggagccaucuuuacacaucuuaaggaggaggccgggcacgguggcucacaccuguaaucccagcacuuugggaggcugaaggaguuugagaucaaccugaggucgggaguuugagaccagcuugaccaacaugcagaaaccccaucucuacuaaaaauacaaaauuagcugggcauguuggcgcgugccuguaaucucagcuacucaggaggcugaggcagaauugcuugaacccaggaggcggagguugcggugagccaagauugugccauugcacuccagccugggcaaaaagagcgaaacuccgucuaaaaaaaaaaaaacaaaaacucaaaaacaaaucuuaaggaggaggggcagaauaauucugaaccacagagccuaagaagaggacccagccgcuggcucagaagggaaugcucggccuucuguagaaaaaucugcuauucagagaccaucauggguaacacggugaaaccccgucucuacuaaaaauacaaaaaaaaaauuagccgggcaugguggcacaugccuguaguaccagcuacucuggaggcugaggcaggagaaucacuugagcccgggaggcggagcuugcagugagccgagaucgugccacugcacuccagccugggcgacagagcgagacucugucucaaaaaaaaaaaaaaagagagagaaagaaaaaucuaccauucagauaacuccucuuauccaugagagaauaggaugcuuacaaaugauaacuguaucagggccaaagguagaggcugcaacguuaugauuaaaguguuaacuucaaguuuagauaguuccauguucacuaauuccuaagaaaacacuaguaaaaaaauaucaggaacccuggcagguuauuuguaauauauacacguauauauauuucaagagacagggucuugcucuguugcccaggcuggggugcagugacgugaucauagcucacugcauccuugaacuccuggacuccagcgauauucccaccucagccuuuugaguagcugggacuacaggugcgugccaccaugcccagcuaauuuuuuaauauaaagauggagucuugcuauguugcccugucuggucucaaacuucagagagcaaaugauccuccugcuucagacuccugaagugcugggauuauaggcaugagccaacacguccagcccugugaaguuuuuugagauuaggcuucaaaauaccucuucagaguguuagguucucuggcuuuaagguaaauauuaauauaguuaaacugggggaagggacauaugggauuucuuccugguucuucaacagguuuuagaauuuacuacaggagguagaggaaaguuaguagcuuuacuuaauguaguaagcucaaagucaaaacccuggcuaaacaugcaaaauugguuuccuaauccuuuuuuagucuucugugucugaggacuguguuaggagauucaauaccuucuccccacuccaacauuccuuuucugcagguccagaauggcuacaacagucccugaugguugccgcaauggccugaaauccaaguacuacagacuuugugauaaggcugaagcuuggggcaucguccuagaaacgguggccacagccgggguugugaccucgguggccuucaugcucacucucccgauccucgucugcaaggugcaggacuccaacaggcgaaaaaugcugccuacucaguuucucuuccuccuggguguguugggcaucuuuggccucaccuucgccuucaucaucggacuggacgggagcacagggcccacacgcuucuuccucuuugggauccucuuuuccaucugcuucuccugccugcuggcucaugcugucagucugaccaagcucguccgggggaggaagccccuuucccuguuggugauucugggucuggccgugggcuucagccuaguccaggauguuaucgcuauugaauauauuguccugaccaugaauaggaccaacgucaaugucuuuucugagcuuuccgcuccucgucgcaaugaagacuuuguccuccugcucaccuacguccucuucuugauggcgcugaccuuccucauguccuccuucaccuucugugguuccuucacgggcuggaagagacauggggcccacaucuaccucacgaugcuccucuccauugccaucuggguggccuggaucacccugcucaugcuuccugacuuugaccgcaggugggaugacaccauccucagcuccgccuuggcugccaauggcuggguguuccuguuggcuuauguuagucccgaguuuuggcugcucacaaagcaacgaaaccccauggauuauccuguugaggaugcuuucuguaaaccucaacucgugaagaagagcuaugguguggagaacagagccuacucucaagaggaaaucacucaagguacagaugcagccuggcuaggcagagaaucccuuguagaaaggugggggagaaucauaggauauuauaacuguaaggaacaugcaagauuuuccagauuauacccuugauagaauagauaaguuccuuaaggcucagaucuugcuuaaagucguccagccuguuagagacaaguagaacacgaagcuggccucuggagucuuuauugaguacuuuguacaauugguguagacugggagagcccuccucacuuccccuuucuugugcuguaauuuccuguggggcagaacaccucagagguuucugugcaucaaaauaagaugcagcaaagacauggaaaaaggauaacgagacaaauucccagcaauaaguagaugagguuguguuuuuuauaaaagauaacgaggcauuccuuccagaaauguggagccuuuguagauuucagugcauaaaaccaagccaugauuuccugcagugaucacagagcagagaagggagaaagcccuuuuaucacaaaccagcaggaagucucuguaaaauugguaaggauucugguuuagugugaagaaccacauuuuuuguguauguuucugggcccaugggaaggaacagaucauauuugacauacaagaaucaaaugauucaggccaggcaugguggcucacuccuguaauccuagcccucugggaggcugaggugggaggauugcuugagcccagaaguuugagaccagcuugggcaaaauagcaagacuucaucucuauuuaaaaaaaaaaaaaaaaaaaaaaaaagaaucaagugauuuugcucuuaucuggaguugagacaagccagauguucucguguuguuuucauaagcaaaagaggcuaaacugauggccagaaaguacuccugcucauagggaccuauucauuggucuccaggguuuacacugaccuuuaagucuaaucacagggggugggugguuuugggauaggaaugaggaaccuccaaggccauguucuuagcuccagcuaaaaauaggucuuuccuuugcucuuaagccugagguguggaacuuccuggugcuacucacugcagcuauggucccugucuagggcacuuggaagucugaagggaggcggaggagggcaggagggguuauuuaaccacccagccccuccuguccguuccguggcuucacuccaucaccucacuccuguacuuccuguucucauucacugaugagucuuccuuccuucauucauuucaagggccacugucagcuuucucccuuaaaaugcuucucuggccuccaugcuuugcugcucacuuuccucccuggguccccugagccaccccaucccaucaaauccuuccugagcccuuccacaguuggaaccaacaaccucugaagcuuugcucgcaguccagaugaaccaagucgcugugcuuuccugccugugccugugcuccaggugugucuguccucugccuggugugaccaucucccucuucugcccuucuccaggaucaggcauuccccaguuuccccugguaaucacuccacccugugcaucuguaggacuuugaaaugcucuuaucagggucugucucauugcacuguuauuuauguaccugucauauguuccuuacucuccagugucagcugcaaggagggaucauucugguuaaucuuuaugugcuucaccaucucucucuuuuuuuuuuuuuuuugagacagagucucgcucugucacccaggcuggagugcagggacauaaucuuggcucgccacaagcucugccucccagguucaagcaauucuccugccucagccucccgaguagcugggauuacagacgugcaccauuaugcccaacuaauuuuuuuguguuuuuaguagagacgggguuucaccaucuuggccaggcuggucucgaacuccugaccucaugauccgcccgccuaggccuuccaaagugcugggauuacaggcaugagccaccgugcccagccacgaucucuuaaauaaaggcguuuaaguguuuguucagcaaauugggcccauaaauuuggugggaaauaaaugaauugcuuugaacugcauucaugaugauugcauguguuuauccuuguuucccaagccuuugguuuuccccaaauacacagaaaacaguugcucaucaauccugccucuucccaaugaaaaugauacaaauauauacauauuuuccuugucaggcaguugaaauagguaaauccccagugagauucacucuagguacaccccuggccagaucuauaucugaaaugacugguuuuuaugacuuuuucuuuuuuuuuuuuuuguuugagacagagucuuguucugucgcccaggcuggagugcaguggugcgaucucggcucacugcaagcuccaccuccuggguucacaccauucuccugccucagccucccgaguagcugggacuacaggugcccgccaccacgccuggcuaauuuuuuguauuuuuaauagagaugggguuucaccuuguuagccaggauggucucgaucuccugaccuugugaucugcccaccucggccgcccaaaguucugggauuacaggcgugagccaccaugcccagcccaugacuuuucaaaugugcuuuugaagugguccuaggaugagguggggcucuggugaaguucugaaaaggggcgucccuagucaucauaguuauucauucauucaaccaauauuguguuugcuuugugccugguccuaggcuugaggaccuagucucugucccuccaagaaacuuaaggucugcuggagagacaggcaauuaaaugggcaagaugucacacugugauaagugauacaauggggugaacauaggugggggccccagugguuuaauuucuccuguuccuccauuucagguuuugaagagacaggggacacgcucuaugcccccuauuccacacauuuucagcugcagguaagugauuuuuuucucccucuucaucaaaggcauuagcaccucaggaacacugauccuuuggaaacagacgauguuaccuuucucauggccccuagauggccacuugaaggaaugaugggucuucuuuccucuaagcggccucacgggguuaguggguaagaaugagugcuuggcauagagaggacuugggggugggaggccugggagaaagggaaggaaaugagacuucugcccagacuggagaccuguugaaauggcaggaacuggaguggguuucacgauaugacuguuuccuuuucagaaccagccuccccaaaaggaauucuccaucccacgggcccacgcuuggccgagcccuuacaaagacuaugaaguaaagaaagagggcagcuaacucuguccugaagagugggacaaaugcagccgggcggcagaucuagcgggagcucaaagggaugugggcgaaaucuugagucuucugagaaaacuguacaagacacuacgggaacaguuugccucccucccagccucaaccacaauucuuccaugcuggggcugaugugggcuaguaagacuccaguucuuagaggcgcuguaguauuuuuuuuuuuuugucucauccuuuggauacuucuuuuaagugggagucucaggcaacucaaguuuagacccuuacucuuuuuguuuguuuuuugaaacaggaucuugcucugucacccaggcuugagugcaguggugcgaucacagcccagugcagccucgaccaccugugcucaagcaauccucccaucuccaucucccaaagugcugggaugacaggcgugagccacagcucccagccuaggcccuuaaucuugcuguuauuuuccauggacuaaaggucuggucaucugagcucacgcuggcucacacagcucuaggggccugcuccucuaacucacaguggguuuugugaggcucuguggcccagagcagaccugcauaucugagcaaaaauagcaaaagccucucucagcccacuggccugaaucuacacuggaagccaacuugcuggcacccccgcuccccaacccuucuugccuggguaggagaggcuaaagaucacccuaaauuuacucaucucucuagugcugccucacauugggccucagcagcuccccagcaccaauucacaggucaccccucucuucuugcacuguccccaaacuugcugucaauuccgagaucuaaucucccccuacgcucugccaggaauucuuucagaccucacuagcacaagcccgguugcuccuugucaggagaauuuguagaucauucucacuucaaauuccuggggcugauacuucucucaucuugcaccccaaccucuguaaauagauuuaccgcauuuacggcugcauucuguaagugggcauggucuccuaauggaggaguguucauuguauaauaaguuauucaccugaguaugcaauaaagaugugguggccacucuuucauggugguggcagcaguuaccaguaa

SEQ ID NO: 191702 - RNA, 133087 nt, Homo sapiens
uuuuugaaucugcggaggcggcggcgguggcagcggcggcgcggcgacugaagcgcgcgaaaagcugaggcggcaacgucggggacggcugcgcgggacggcucuguaggaaggaacuugguucccccucccucagcuuccgccccaaaagguauaugugaaucccaggggcuguuaaaaccacauuuucuuaaauuacuauuguauuucugaagagucaagaccgcauuauggcggcugcgggaguugugucugcgccugcgcgguugcggagcugcgggcggcgcugcaugggagcacgugaucuugcggggucgggcucuagcugcaguugugcagcuggcggggcgguggcugcgcaagcgcaauauucauuuucaagaucuaauguucuuguuggacgccauuuggguucuagauuuaauuuuccucguucuugagggguuucuuuguguuaaccuuaaauucucacaauuuucaagaaaaacauuacucuaauguuguacuccugggccgaccucaagcucuucucuguuuuuucgauuuuuugaaaaauuguggacuuaauuuucuguaaaaaugauuuucauuugugguucuugauuauaauuucaguuuuaaaguauuacuggauucagguuuauauuuacggugguaaagaucagcaccuagugguguucucacgggaagugcauuuauuugaacugcauauuugcaaauacauuuuuaacccuauuuuuaccuguucuguuauggauguguggaauguuuacaaaacagaaacaauuuuaguuuugggaauauugggggaacgggaauaguggaagaaauuacaguauaaucgaaaaugaaaucucaaucugaggauuauuuugguuuuaaauguuugauccuaaguaaauaaaguuuuaauuuuaaucaguuuguauguuucugggcauuugaauuuuacauguuuuaaguuucuuaggugacuuguucauuacugcuucagcuagauuauuguuacuuuugaaauuaaucaacucauuuucuuagcauuuuuguuugcuaugauauguaagcuauaacauuuauuugguaaauuuuucugaugaagaauucuagaaagaacauccauuacccugaggccucuuugaagaaaguggaccauuaauaaaaaaaaucuguuuuuuucuuuuaaacacuguacuguaugcauguguguaagauacaguuguguuugauuuuuuaauuguaagugugcuccugguuuuauuaauaguuuuuuagggaagguaauuauaaauaugcuacugauuaguuuaaaaugguagugucaacuauaguuaaaucuuauguaacacaauugggggaaguuauauaagauuugauaugauucucccguugugcaaauucuuucuuacuaagcaaagaaacuugcaaauguuuuccauagacuucauuugugguucauauauacaacaacugguuucuugguugguuauaacucuuuaaguuugaaucagucuacugucaaaugaagacgugccucuugcuuuauaaucucgguuaauuuagggaaauuuuuauugccuaaaacaaauaccauuaguaaauauuaccuagauguaauugaaaguaauacuuuugguugguggauuuuuaaaugacgucacauaugagauagaauggagguaggaaagauucuucuuuuuuucucaagagaauauuugaccugauguaauucuuggaucucugaggucuucuacacagaaguauauuuagagagcaguuguguaauuuucucccuuuuauguuucuggagugguuaccuagcagccccuuucuaccacaugcuauuucaggcauuuucgaguugaacauacacauaaauauuucgguuaacaaaagaacuuugaucuuugaucuuagggcaugguacacuuuacauuuccagaaaaaugaaauaguuugguguauauaagcguauguuuucauuugaauauacagaugauugcuuuuuagguuaauauugaagguaguaagagguauuugaaaaugcucuugaauaugaagaacauauuuauugaugggacgauuuugcugucauguuucuuacaaggcagauauaaucauguaaacuuaauaagauuaauuaauugccugaacaccaacuauuuguuuauuaguacuuugucaauaacaaguauauuuuaaaauuuuaguuuggugguuaugaugccacaaaauuuugacacauauccaacauauauaaauauuaagacuagguuacuccaggaaugaauaccaaguuacugaaguuauuuaaaaucuuuguaguuuuguaaauuuaaaaauuuauauguaguuuagaaaagacagguuugaguuauuaaacaauuagaacuauuuuuucuuuaaauuagguuuugcauaugugauaaauguauuuaaauauuuuuaaacuuauucauuauagaacauuuggaaaauauugaaaauuaauuaacaaugcuuagaaauaaccacucuaaagguauuggugauuugugacuucacuuuuccaugauugagcaaucuauaaauguuuauuaauuaguuuuucauugguaccauaauuucauuucuacucuuuuaauguuaugaguauuuucccauuucauuauucuucuaaaauaugucuuuaaaugguugcaugauacuuuauuauaauaucccacaugaucaaauguucuuuuuaaacacauuuuaaaaugguuacauauuauuguuaucucuaagaagaauuuacugugauuuauuaaaccuuucauuuuuuguuuccuguuuugcuuuuugcucauuucucuauuaaaaauaaugcuacagugaacguucuuguacuauaccucagaauauuucuuugaaauuacuuucaaaggacuuuuaaaguaauuugcaaaauugauaaaaacuuuuuuuugaaaagcauuuuuuaucauauucaauaccaccaucaauuagaugggugaaaaauaguagcucauuaacuuuuuuugauaacuagugaaguugaauuuguuauuguuuuauauaugcauuuuuuucauuuucugugaauuagcuguuugacuuuuuguguauuuuucuaugaugaguguuacuguuuuucuuauuuguugguaacagcuacuuacggcuuugggguccuuagcuuuuaauauuugucacaguaauuuuaaaauuaccuuuuaagugguuuaugauuguauauguuaagaaguuuugcauuuuuauguaguaaaauguacugccccccuuuuuuuuuuugagauaggaucuugcucugcugcgcaugcuaaagugcaguggcagugaucucugcccacugcagccucgaccucccaggcucaagcaauucucccaccacuggaguaacugagacuacuggugaaggauaucacaccccgcuaauuuuuucuuuuuuuuuuuuuuuuaauaaacaaagccucauuauguugcccaggcuggucuugaacuccaggggucaagagaguuucccacuucagccucccaaagugcugagauuacaagcaugagccaccauguccagccuguacugccuuuccuuuuuccuuuaugauuucuacagcacuugucugcccagaaaauauuaccuguuguaaggugaauuguauguuuauauuguauuuuauuuuauuauuauuguuuuuugagguggagucuagcucugucucacaggcuggagugcaguggugugauuuuggcucacuguaaccucuucuuggguuccagcgauucugcuaccugagccucccaaguagcggauuacaggcgugcaccaccaugcccugcuuuuaguagagacgggguuuccccguguuggccaggcucgucuugaacuccugaccugaggugaucugccugccuuggcccccacagugcuagaauuacaggugugaaccaccgugcacagccuuguucauguguuuuguuaauuuuuuacuagaacuuuuucuggaaguuuuaauaaacuuaaaaaauacuuuuacaucuauguggacauaucuguguuuugacauauuguguguuaagauaaguugcuaguuuccauuuuuuuccagauaucuaguuuccauagacuugauccauuucuuauugcuuugguagcaaacaauucugauucauauacuagguauauuuaaccugggguccauuguccucuagggguuccaccgaucccuugauauacacaauuuuauguaagucugcauauguucauuuuuuuuuuuuuuugagauggaguuucgcccuuguugcccaggcuggagugcaauggcacgaucucagcucaccgcaaccuccgccucccagguucaaaugauucuccugccucagccuccugaguagcugggauuacaggaaugugccacuaugcccggcuaauuuuguauuuuuaguagagacgagguuucuccauauuggucaggcuggcucgaacuuccuaccucaggugauccgucugccucggccuaccaaagugcugggaguacaagugugagccacugcgccuggccuccuaugugcauuuuucuggggaaaaagugauagcuuucauuagcuucucaaaagaauauaugauauaaaguuuaaacagagguugacaaugacuguaucugggccuuauucuuagagcauuauugcauuguuuuauuugcuguaggacgguacacaauuuaaauauguguuuguagugcuauauccuauauaaaauccaauacccacucacaauucuauuuuacaauuuucauagcugauuuugacuguuuuugcagaucaacuuuagguucauuugguuaauuaagaaaaaaaagccagcuaaugguuuugguuacaauuccauuaaauuuacauugggugaauuuauaaccuuauacuauuuuuuuuaauucaucgguauuacacacuuccuguagacuaccaaaaagcacuauuuccuaggaacucugggagaauuugugguaucugugacuuuucaggaggauguuuucuuggugcagcuauaauuuuaguagggaugaauuaggagacaauauaagguuauauuucuguuuucaaucugguuuaggacaugaugacauaaaaguaguaucaguaugaaguuagacgugggaaaaauaagucgcaaaauaaaguauuguacaauauucgaaaucaaaauccuuuuuuguuaaacacagacaauuuuuuuuuuuuuugauggaggaauuugaaaagguaccuuacuccuuuucuggccagggugaggcuuaaucucauaauaaagauaaaaaauuuuuauuuuaguuuccuugguaucauuaaauuauuauauuuucugauaaggauguuucccuaauuauuagaauaaauuuauuuuccauuaaaucucuuuuuuaugcugauugcauugaaaaagauuaucuugauuaauaaggauguauuucagcuguaauucuacuuuauaucuuuuaaauaauugauucaggagucaguuuauugccaaaauaacauuuuuauugaacuaaacuuguaaauuaguggaggaaugaaaagaagaaaucacggaaauauagaacucaaaugauaaaauauuauuggcuuuaugaaaauaaaucuagaaaauggauauaaaauauuaagauauuauuggccuuucuuaagcaguuuaucuuuuuuaaugaaaaaucccugccuuugggucuuuuucaagcaacacugcuuauaacagcuuagauauuuuacuuuuuugugaaaguugagaacuuuuucuaguucugguuuauuauuauacuugguuucuagacuauaacagaugaggaguaaaaaauuagaagugcuacuugagaaaugcauuuugguagggaaaagaaaugauguccagcaucaugauaguaaaggaggguuauauuucuacuguuagaagcaauaauuuauaaacuuaguuaugaggcuauuuaguuugggaaucaguauucccagagcugaaucaguaguuauagaauguucauuauuaauugaugauuuuauuaaugauucugaaucagagaauauuguuauauuuaaccuauuucagaagggaaaugagcgugugauuuaguuuagaaggauuucuauuauaauuuuuucuuuuagguuuugaggccuauggaaaauuuaugcauuggcugcauaccuuguuuuucaagggagucacauguauaaagaagcuugagaauaaaguuccugccuuuugaguuucuaacaguuguggggcauauuauugauugaaaaauuaggugauguuuuaacauuauuuaaacagauuaccuuaaugucauuaauuagcuucagagaccauaguccuugucacuuuccuagaguacuuagaaauugccuauccuuuaguggaacucucuuuuaaacuucuugcuuguuugaccuuauauuuuauuagagaggccaagaguauuuaaacauuacuuugccauguucuuucucagauuguccugccauccacagaguaaaucaggggcuccuccaggcauuuuaauuuguugaaaacaaagaaaauuaaacuuuuuauagaugauucagcuugcaugguggaaaccauuuuguauuggagacagagagugagugcuggggagcacuuucaguuaagaauaaguagaucagggcuacuagugcuuguuuauauggugugaauguuucaauuuuaaauuucgaucauuuggaguuuagaaucuuuaagaggaugacucagguaccucagccacuuuucaaaaaaaaaaaaaaaauaccauaggccuaagggaacaguuauaccuuccugagagucuuuauaguuggaccuauaugaauaugagaaucugggaaaugaagaugacuuauuaacuuugccaucagaaauaugcacuuauucaugucugcaguuuuccauugcucagaauauuauaagaaacauuuuguguucuuuuauauccaauaacugguaguaacuagcuguauuugggagagaggaccccuuuguaugauggugaugugagguaguaaugccauaaugucuuacuauauaugauccguucucccuuucuuuguuguuuguauagcccuaugcuacuuuggggaaguauuaucugguuugauaccuagaaauuauguguccaucacucuuggcauucuaauaauuuaacauucuaauaagaaauuugauuuguauguuagaauaguuguccucagaacugucaaagcuguaaaaggaacuuucuuugguucaguaauucucagugauaaugccuaccauuuuguagaaggauaaagcuaaaaagauggaaagggaaucugcuguuuugaggaccaggagaaagaguuugauggaacaauaaaggaugacuugacugcugcagcuuauucccagcuaaggcuuuggagccuuagauguauaucugcccuguuacucuuauuagauagaaugucauaggaaaaagcauguaagggaaaagagagacugcuuuugaacucuuuuauuuccuuuuaggugguaaaugucagaagugaauuccauuagaguaaaaacuaagcugccacaguauaggagacuccauuccuguuguuuaaagaugacacauguuuuuuucucauguaaccauacaaaguaagacuguuuagaguuuguaagugguuuugccuuaacauauggcuuccaucacuaggugaaacaugauuacucucuaguuuuacuagcuagaggcaaggaagaaagaacaaugggagugcauauucuuucuuuugagagcaugauauggaaguggcacauagcacuuugacucaugguuuaugugugaucauuuagucauugggacauauuuagcugggaaaggaagucugggaaauauaucuagcuggauaaucauaugcuuagcuaaaacuagagaauuuuauaaaagagaaauggauauuaaugaauagcauuuucugcuauauaaggaauugggagaaguggucucaaaguacuucauaauuugguacugaaaacuauuucucuuuuaagauuuagguucaguuauaguauaacuguauauuuuccauugaaaugguauuuuggggguuuuguguucaugauuugugguuggggucccaguuauuauaaauauuuauauuugauagaauucuuccccucucugcuugccguugaaaacauuaugauuaguuuugcaagaauuagaauuucaaauuuuuaaaacucaguguaguauuuuugaacuuuacagguuaacuugcuuaauucaaaaggacuguagaugaaucgagugacaauuguuugaauaguuuauguuugcauuauuuuauccagauuuuuuuuucucuguuuauaacuguauguauaaaauauacauuuuccaugauggaaaauaugacuuuuuuuuuuuuuaauugagacuagggucucacucugucacuccagcuggagugcaguggugugaucauggcucacuguaaccuugaccuccugggcucaagggauccuccugacucagccuccuagguagcuuggacuacaggcacaugccaccaaacccagcuaauuuuguaauuuuuuuuuuuuuuuuuuuuuguggagaugggggucuugccuuguugcccaggcuggucuugaacuccugggcucaagcaauccuccccucuuggccucccaaaauguugggauuacaggugugagccacugugccuggccgaaaaugugacuuccaagggccuuguaauauacacagguaaaaagauugugguuguaaauucucugcauauaggcaaaacuuaccugauuaauaaguaaguaguuaaaaguagcuuucuacagaauaugacaaguaaaacaauauauauuuuuguaggguacagaaaguggugagaguguuggaaggagaucaaggagauuuuaugggaguuguauuuuaaggaaugaauuagacagauaauacuaguaaagagaauaaauaguauguucaaaaucuuagagccagaaaggaagguaguguguuaggagaacucuuaauagcucugugauacaaauccuugguuuuugugaauaaaagucauaguugccauggcacccacauaguaugccuauuaaagcauguuguugcucucaacuggaaauucucuaauuuuucuuugcuuuacuucauauauuuuuuaaaggcauuuauuccuuuccacuuuuauauuuauaguuauuuguuuuuuguguaguacuuuauaaguuuccugggguuaggaaucauaucuuauugauauaucugacaauuuuuuaagacaaauccuuucuaauaagguaugauaagaccacuauuaaaaguguaagauugcuuuccaccaugccuugcuuuccaccaugccucccuuaauauucaauaaauacuugcuuauugaaagaauagaauuccuucguuuuagguggaggugaaaaaaaaaagggaauaagauauucuaauuauuuucuuuuauuuaacucauuauccacagaugucagaacuuuuuuuuuuuaaucaaacauguaauuuacucagauggcaaauacccacaugaugaauugucaugggaagauuugacaggcacuuuacauaugaaaaauaauaaauaguugcuuuuaggaaaaacaguuuucaaugucauccauuaagaaccaguugcuuguuaauaaaaaguuucuaaaauaugacugugaagaaccuacguauguaaauuaauaaggguuugaggaaaagauggaaugauauaauuauuuuguauuuuagguuuguauaauccucuucccccaccaaacuuacuuuaaaugauuuaaacauugaaagauaaaaauaaauaaaaaaaugaagaaagaaaagaagaacaaaagaaaaaacaaaaaauuuuccuaaaaucaguuaguuauacagugaaguggaaagaacaguaguuuuguauugggaccugggcaauuagugucuccucucaguguucuuuaucuuuaaaaugugguguuaccaccuacaugguaguguugugaggguuaaauaugauuagauauauaaaaugcuuagcaucugugccucacacauaucucuagcuuuaaucaauuggugaaucaauuagucagucaugaauauuuauuaagaagcaacuaugugcagggagcccugcaguacagggagauuuaugaaaauaauauucuugauuucuggagcuagaauguaaaugcauuuaaaaaguaacuuggaaaggucgguuucauauuaccacucauuaguaagguaaauaagcauuuaagaaaguaguuuacuuguaaagguuugugauggagaccaguuuuaggacugacucauuaaaaaacaaacggguauuuaaaggaaaaaacgccacacgauuacuaaauucacuaaauuuacaguaaacaucuuccuggugaaaaagcagccauuuucucacauugauugucauaucugcaagguuuggcagcauucaucauuggcaaaguuagggaugaaggcauuuauuuugggcacuaauuccacauaggauuccuccuugcccuccuuuaaaaacaucugcuggacaugcuuacucaaaauugagacaaaguaucauuuuucauccauagcccuuccuugaaaucaagcuccagccucuuaaggcacagauuuggccauaaaguuuguuaaaugauuuuccgauuugguauauuuucauguuuucuuuagccauuugauucacauaggucuaaugagguguugauuuaaaauacagaaauacaucccuauugugugcuuaacaaaacuauguccauuugauaggaagguaagaguuaaccucuguauggauguuuugugaacugcuauaauugacuuauuuauuuauuagcuugucuccacuaccagaaaccgcaucaucugacuuaaugagcuuucaucugcaguaccuauaauuguaggguaucuugggguucucugagauucccacauuugucaguauuccugguuuuuugggaaauacuauucuuuauucucuucaaagcuuggaaucuauaagcuguggaagagauacuaaauugauuucuugugaagauuuaguaggcaugauuucuauauuuaagaugcaauccuugggaggcugaggcaggagaaucguuugaauccggaaggcagagguugcagugagccaagauugcgccacuacacuccagcgugggugacagaacaaaacuccaucucaaaaaaaagaaaaaagaugcaauuuuuguucccugucauaccuaauuaaaggaaauuuguguuuauuuauuuguuuguuuguuuuuugagacacugucuugcuguguugcccaggcuggaaugcaguggcaugaucuuggcucacugcaaccucuaccucccagacucaggcaauucuugugcuucagccuuccgaguagcugggauuacagaaaugcaccaccacgcccugcuaauuuguguauuuuuaguagagacgggguuucaccauguuggccaggcuagucucgaacuccugagcucaagugaucugccugcuucggccucccaaagugcugugguuauagaugugagccacugagcccagcccgaaauucauuuuuaaauuucacauuuccagugugguuacgguuacaaauuugauuuauccaauuuuuuuuuuuuuuuugagacguugucuugcugugucgcccaggcuggaaugcaguggcaagaucucugcucauugcaagcuccgccucccagguucacgccauucuccugccucagccucccgaguagcugggacuacaggcaccagccaccaugcccggcuaauuguuuguauuuuuaguagagacgggguuucacuguguuagccaggauggucucgaucuccugaccucgugagccaccgcgcccggccuuucuuucuuucuuuuuuuuuuugacagagucucgcucugucacccacguuggagugcaauggcgugaucucggcucacuccagucucugccuucugaguucaagugauucuccugccucagccuccugaguagcugggauuacaggcacccaccaccacaccaagcuuauuuuucuauuuuuaguagagacaggguuucaccauguuggucaggcuggucucgagcuccugaccucaagaggaucaccucaggugauccaccugccucagccucccaaagugcugggauuacaggcauaagccaccgugccuggucugacuuacccaauuuuauccugguaggcaggagaacagauucuuauggaaacuguguaaacugagucauaaaaaguaaaaagauugaguuaugauacuuuauacaguauuuaaucauuggucuaagcaguuucuggacaagacugaacaauauauucaguauuuuucuuuuucuuuuuuuuuuuuuuugaaauggaaucuugcucugucgcccaggcuggagugcgguggcaugaucuuggcucacugcaaccucugccuucaggguucaagcgauucuccugcaucagccuuccgaguggcugguauuacaggcacaugccaccacgcccagcuaauuuuuguauuuuaaguagagauggaguuuugccauguuggccaggcuggucuccaacucccgaccucaggugaucugccugccucggccucccaaagugcugggauuacaggcgugagucaccaugcccggcccuauauucaguauuuuucuacagaaucauucauaaaauguuuuugguggcuucuuuagcuuauaaccuauauuaaaaccuuucacaggauauuuuucucccugaucucugagggggaaagauauuacuauuucuauaaaguauaccuuaaguuggggguuagagauagauugagaugaaaguauuguucucuuaugaccauuuaaaauaaaauguuaaccacaauuaaaucauucauuuagucuuagguaauucuucuuuuuuugaucuuguguuaagcagccuacuuacacagaauugacugguuuguacaacauaaucaugaaaaucaugacccauucccuugauacaguuaugacaguuguugacucaugaugucaacuuuauaccaggaugccugcauccaugagucucuuccauguaaauagcaauaguuaagacgauuugguacaguuacuaauaaucuuugauauuuauuuaaaagacuuaauuuauaagacacaauuccucagguaugguggcagcaaaaaucuugacucacauuuaguucuugagugucauugcuccuguguggcuuaguugcucacuauaucucguacacaacugucauccuuagaauuuuguacaccauugauauaguuuggauuuguauccccacccaaaucuaauguuaaaucauaauccucuauguuggagguggggccucgugggagauaauugggucaugggcuggauuuuucaugaauuguuuagcaccaucccccuugguacuguccuccacaauagugagugaguucuugugagaucuggucauuuaaauaguguguagcaccucucaccuuucucuuguucuugccucugccaugugaugugcaugcucccccuuugccuuccaucauguuuguaaauuuccugagcccccaccccaagaacccgagcagauacacuguacuuccuguacagccagcagaauugugagccaauuaaacuucuuaauaaauuacccauuuucaaauauuucuuuauagcaaugcaagaaugaacuaauacaaccaucagugaagauuuccuucaccugucuucuaggacccuuguuuuccaaaugcuaugucuuuuuauugauuuauucuguccuuggcaggagaauucuuagaauucucccugccuguagaaagcuacacauucucuaguagcuuuuugagaaagggugcaugggagauacagguuuuaaagacaaugcauguuugaaaaaggucauucuauguuuucaugcuugauugauaguuuggcuggguauagaacucuagguugaaauucuuuuccuucagaauuuuaaagacacugcuccauuaucuucuuccuacuauuaucaccacugagaaaucugaagccauucugauuucagauuucuccucucaguggaagcuuguagaauugguuauuagucuuuagucuuauggaauuucaauggaaccugcccuuguguggaucuguuuauuauggucugcuggcaugcuuugggcucuuuggucuggaaauucuugcccuucaacucuggaaaguuuucuuaaaugauuucauuggugauguauuugugugugugugugugauuccaauuugaauauuuggauggauacuccaauuguaucuuuucuucugauuuguaauuuugucuuuuugcuaagguugguuucuucaacuuuaucauccaguccuauugaguuuuucauuuuuuucuaucauguucuuaauuuucauuccuuuucuauagcauucuauucuugacucaagaauguaacauuuugucugcauauauucauuuuuuugaaguuuucuuauuccugcauagucuauugcuucauguauuuuuuuuguuuuuguuuucuuuuggucucugucauguuggaaacuuuucucaauugccuuccuuagguaacugcauaaugugauguggaagauucaaaaguugauugccuuaucuaaauucgacaguuugaaacuucccuuuaggcugaucugggucagccauuuugggagaguucuccagagaccuuaggucuuaugucuugugcuggucagacacccucagggaauagucuuccauuuuuaucaauagagaaauaggcucugauugccagcacucugggagauucaugaaggggacuagggaucucugcagucaggacuuaguccuucucuuuuugauauaguacuuucagguuuuguuuuuauuuuauuuuuuuuaagacagaaucuuacucuugcucaggccagagugcacuggcacaaucuuggcucacugcaaccucugccucccaggccaagggauucuccugucucagccucccgaguaccugggaugacaggugugugccaccacgcccagcuaauuuuuguauuuuuaguagagacgggguuuugccauguuggccaagcuggucucgaacuccugacuucaggugauccaccucccuuggccucccaaagugcugggauuacaggcaugagccaccgugcccggccagguacucucauuuuuaacugcagauguugucuucagacuuuuguuaggguugggaggagcagauagucacuguuaaauguguuugguaaaggcuucuaagguaucuuucugcuucuuaaacagcugucacuauuuuggccauuuuaucguucucucugcucccuucacucugguuuucaaaggugcuugguucuuuuacuuucuaugauuuucagauuucugccagguaaaucagauugguucuuaacuugucaccacugcagcuuggaauauuguauguuagggauugcuacauuaguuacaacuggucgugcuuauuuauuuuuuuugagacagagucucauucggucgccuaggcuggaguguaguagcucgaucuaggaucacugcagccuccaccucccagguucaagugauucuugugccugagccucccugaguagcugggacuacaggugcgccaccaugccuggcugauuuauguauuuuuaguagagacuggguuuugccauguuggucaggcuggucuggaacucauggccuugaguggucugcccacuuuggccucccagaguguagggauuacaggcuugagccaucguguccggcugguccugcuuauuuuucagcuucccaaaucuuaguagcuguuaccucuuauuucucucuguuuuuuuaggauuuauguaguuuuagugggauuagguguuuuugguucaucaucuuaauaccauucuaacaugccuuuuagauuuaaauauguguaauguuaauaauaacuuacaauuagagcaucuuaauuaaauaaauaaaacauauauuuacucucaaccaaauacagugaaaauuuuucuuuagauucuauaguuuucaauaauuugcauaugcagaguuuucaaauaguauaauauauauaaaauguaaugguugacuagaauuaauucuaguuuuuuuuuuucuuucuuuacuaauugugugacuccuggcaaaugauuacauucucuggucauaaaaauuugagauuguagcgcucuuauuuuacauggucauugcaagagugaaauaaaaaaaaaauugaaugcagccugggcaacauagugagacauuaucucuacagaaaauuuuaaaaauuagccaguuguggugguguacaccuguggucccaguuacuccagaggcugaagugagagagucucgugagcccagaaaguugaggcugcaguaagcugagccaugauugcaccacugcacuguagccugucuacaaacaaauaaacgaaaaaacaaaaagacuugugaaaagugcugauuuuuaauuaggaaaagauuaaacauuggauagucauggaauuguuuacugaacauuagaaauugguugcaaguguuuaugcuucuguaaauaaacgauuggucucauuacaaaugacccaauauaaaacaaauuucuuaaaaccugugacauuauacagucaaggugaauccugcuuuuuuaguaauauuaauaaaacuuaaaucacuuuuguuuccuguagauuuucucagagucaucuaucauaauaagcacauaguaguucccauguagugccugaaaagugcccuacaaaaguuauuuuuuccaucuuggauucugaacugcagauguuuuuaggccaagacuaaaaucuuaguugacauauuaguugacuucuuccuagaaaguaggaguugagauccuaaaaaugaagguucuuuugagauuuuugugguagaaacaaaaacacugagaauuucagcucacuauuuauugagcaaauaacuguguucuauacuauggaagagaauggaaaaugaaucaagaugcgauuuauauccuuauauaaagauuauuugcauaaagauacaaguaaugaaauggugguaaguauaaugaugauaugcauaaaagauauugagagaguaaugauaccugguuuggggaugugcguauuaaggagagaguaagcaaagaauuaucagugauaggguaauauagguugaaucauguagaggauauaucaaguaaacuauaauaggauaguuucuuugggauaaagguguuggccuugacacuauuuaucugaauaacagccuaauuauuuuccuuuucuaaacuguuucaucagacacagaaacagaaccaaugugugaagggauggauaaagcucugucagcugguacuaaguguugucuggguuguauuucugcuuguaucaguuuugugaaauuauuuaaucuuauuggagaauucuggauuuucggauuagggauguccaaccuguauuauuaguagccagcagcuuucucuugguagacuauguuuagacuaagaaaaaaguagucaggauuuacauuggaaaaguauuuggcaagagaagggaggcuugaagaagauaucauccauuugacaguguguuccauaauuuaaaucuuuguggaucagacuuccuaaaaacacuuugcuuccagaauguaagaaaguguucauuaggcagcucugaauauuuuggcuauguguaccaucuuuccccaccccccaauuaaacauagauuccagugcuacaguaauaucaauucuguuccagccuuucucaauuuaccaaaucuugcuuuuguuuuuaauuauaauuuuuuuugagacaggaucuggcucuguugacuaggcuggauggagugcagugguucaaguucacuguagccuugaacuucugggcucaagugaucuuccugcaucagccucuugaguagcuggaacuacagguucauauuaccacaccugcuaauguuuuaaaaauuuuuuuuguagagacagacagagaucucgcuuuguuggccacgcaggucucaaacuccuggcuucaagagagccuuccgccuuggccucccagaguguugggauuauaggugugaagcacugugcuuggccuaaaucuugcuuuuaaugaauagucuuugcuugagaaucacaguuguauuuuuaaagaauuaauauggcuuggaucaaguuuaacuuuuuuuuucugauauacugaaguuguuacauacauuauucauuuugccucauggaaaauacauaaggaccuuuuaaagauaaguaauuuaaaaaacuuuuauuauggaaaauuucaaauauauacugaaauagaaugagauaauaaauucugugugcccauugcucagcuugaaccauugucaagucauagggccaaucuccuuuuagcuauaucccuauuacuccccuauacccuuaaaacuuuuuaguaaauaccuauauuuagugauagauagaacaagauacacagguuagcuagauuuuaggaagguagacugaggaagagagaaagaaaauguggauucuauugcugaugugaacagguucucucugugcuuuuguccuucccuucucuuugauugauauguuucugccaacccacauuuguuggagcucuuucaaauuugucuugcuaauauaucuauuagacugaguuuuacucuuuuuuaaaauucccuucuuuccaucagggugccuauaauucuuuguuuuuauuugcuuuucacucacaucaaaaaguugggaggucuuugucagggcaugaaauguaauuugcccugggacuaaacacucaccuggggauguuaauguuugugaccaucuguacuacugaagagaagaaauuauuuuuauaucuaugguaaauuacucaauaagcuuuuugccaucuucuagagauucuguuaucaagguucaaaaauuuaauuguaggcuuuaacuguucugcuagauuugagcacuuuggggcuuuuagauucuguggagaaaaucuuuagccuucuauaaauugaaauuaacuuaaucaaucaagucauuuucaggauuuaaacaauuuucuagaaauuauaaaauugaaauucuuuucaugauaaaacuauaaaagguaaaaaaaaaaaaaaggccuugagcaagguuuaacuuuuuuuuuuuuuuucuggacugaaauggaggcuuucuuucaagcgaauucccugauguuugcucugugugauuuggcuccaucucuguaacugcuaauauguggcauggauuucaaguuguuugggaucuggaugugcccaaagucuguauugcaagacgggauucacaggcauuauguuacaaaacuggcuugcugccuucuguuuucuuuuucuguguccuguguagcugcauuguuuguugcaguauaugcauuagcuguugucuauguucaguuuccugcaggcugacaaagugggaggggcuuuguuuguuacauagcugaguuuucacugugugaguucuugagugcacauugcagccaucuuaauuacacuuuugugcaacugagacugugcagcugucucaaaauggcugcuaaccuagucuuuguagcugcuuaggcagcaaguaugucagugaggagacuugucacaugcaucaggaccagagguaagaaccaauuacucuuuuaucuuaaacauucucauuuuuuucuuuuuuaaaaaggaauuuaacugaguuuacuuagaggggugaacuuagagcuugguuuuuaaaaaguugaaauguuugguagaaccuuuaagccuuuauuauggaaacaguacauagcaugguggggucaaagguuaaauuccuguaauuucucaccauuuuauguucugucauugccagaacauuugaucaccauaguagugcauuucuggcccuaauuaauguaauauuccuuuuguguaggcuauuuuaguguguuugguauuuauuuguagaaauuaaaacaauauauuaucugaauagauuuuuuuuuuaaaggauccauaaguaagccuuguuuugcacaaagacuacaauuuuucuacgguuuugugagguauuguguggaagcuuuuuggaaagaaggguaauuauauaaaucaugaaaaaaaauuuuuaauacuguccaaaaucuuuuuuuuuggcauuauggguugcaguucuuucucaucaugcugccuccucccaguauccaacucuuugacauuuuuaaugcugcuuugcuucuuuguucaaauuacuuuuugcuuaaguuggcauucagauucagauuuugaauuuagaaauaaauucacaucuagucauggauaccucuuuuuaaaaaauauaucuaauguauucaaauaccaucagagcugaaguacucaguuaauuaaguuauauuuucauuuuagucuuaauucaaaccuguaguauauuuaaaagaaauauagcucaaugauuuuguaaauuuaauuucaaaaaguuuaaaaagcuuucuuaacaucguucuggaguagaaauguuuauugagauacuguaagucugugguuacccagaaagaugggagaaugaaauucuuauucacguaguauuucagauagcagaaaaggcauacuuuaagcagcaauacuuaaauugcaguaccuguuaaaauauuuuuuagcugguauaauauacuccugguuuuguccguagaguauuaagaauauaucccugacuuauaugacauagaacaguaaguucuaaacuuucugaguagagcagcuuucuaaaaacagaaacuuuuugcauguuaaacucuuagggaggauuccaauauauaaaagggauacuuaugguuucugcuuaauucugcaaggcuuaagaaacaaaaggacacgugauauuuuauuguuauguacuuauuuuauauuguaaacuuauucacaugucauguguauuuaauaaaaugacaauaauuaugcuauuaagauaaacaaaacuuggaaacgagaucguacaugacaauuauaaucuuguauuagauccagaucuaguucacuuauuuguagaaccuuggccucuuaaggcacuguggaauucaguuugaaaauuauucuagaaugugucuucguuauguugauuuuugauguucaugaagauggaauauaagaucuauauguacaugacuuaacaguuuaaaauuguugacuugucucagccuuguguuuauauuuguuauuuacauuuuuuuuaaacaaaauaauuguuuuuccuaauuaaaucaguguccauuuauuuaguggcuuaaaauauauucugggaucaguauuuaucucaguuucaucaacagcuuuagcauuuuuguuucacuuuagucacuacauuguaaaaucuuuaggacugucuuauaugacauaguagauucucauaauuugaacacuaauuuauguaaaucauucagucauaugaacuguaccuaaaaaagaaaaagaaaaacauuucaauguguuugagggauucuauucaucauuccuuucaguaagguuauccuuggagugaguaugacauagaaaagugaaugugcugugaccuugaucacucuuauuuucaugccuuuuaauaguaauaacagcucauuuucuugguggcgagagugggaggggaggagacucuaguguuuaaaaauauguguauuucaaaacauuuuauauaaugucgaaaaacuguccauguugaaauuauugagcaguuuaugcuggucuugagugggaucuuagggaaauuuuaauaacccagucuuuuugccuucuauugcuaacuguaauauuugccgcuacccucuacaagauuauuaccuguacaugaggaaauacuaaugcccuaugguuacucaggauauuauugcuaauucuuucccugcuguguugcauuuuugcaacuguaagcauaaauuaccccuuaaugagaugauugcuuuugggauuggugauaguucucaaauuuucuguuccaaguuccaguuagcuauuaugcuggguaauugagggcauaauaaaucugggagcugaauaauugaaguuuuaugauguuauuuugucacuuuuaaaaauucuccccuuuuguuuacccuuuuucaugaacaauuucaucugcauaagccucuaagagaaauguuagggugguggcacuggccaaggguccaaaccugaauuugaauacuguuuuugcuaccuuuuucugacauugacgagcuuauuccauuuucuuucuuuccuuucauucuuucuuuuuuuuuuuuuuuugagacggaguuucacucuuauggcacaggcuggagugcgaugaugcuuccucggcucacugcacccucugccuccuggguucaagccauucuccugucucagccugccuccuggguucaagccauucuccugucucagccucccgaguagcugggauuacaggcaugugccaccaugccuggcuaauuuuuauauuuuuaguagaggugaaguuucuuccuguugguuaggcuggucucgaacuccugaccucaggugaucugcccgccuuggccucccaaauugcugggauuacaggcgugagccacugugcccugcuaauuuuuuuuuuuucaagacggagucucacucugucgcugaggcuggaguguaguggugaaaucucagcucacugcaaccuccgccucccagguucaagugauucuccugccucagccucccgaguagcugacauuacaggcgcccaucaccacgcccggcuaauuuuuguaguuuuaguagagaugggguuucauuauguuggcuaggcuggucuugaacuccugaccuaaagugauccgccugccuaggccucccaaaguguugggauuauaggcaugagccacugcgcccagccuucuuucuuucuuuacuggagacagagucucacucuguuucucaggcuggagugcaguggcaaucugagcucacuacaaccuccacuuccuggguucaaacaauucuugugccucagccuccugaguagcugguauuacaggcaugugccaccaagcuaauuuuuguguuuuuaguagagacgggguuuuaucauguuggccaagcuggucucgaacuccuggccucaagugaucugaccaccucagcuuccugacaugcugggauuacaggcaugaggcaucgugcccuguguucauuccauuuuuugauuuucguuucuucgucuauaaaaugggggaaauuuccuaucuauuugguaagcauaugcucagaaucaauuuacauaauguuucagaauaguaucuugaaauacucugcaaaaaucuugcauacuaauuuucucaguaauauccaaaugcauuucaguuuauuugccucucgagugucauauaccuuuucaagugugauuggaucaguguguauuuaaaaacuaugggaaauuucuuauauaacucaugcucagaagcaagaagugcuaaguaacaucauauccacuuaguaauguuauauauucguuuuuguaguacuggguccuacucuguuagcauaaauuagccauccuuuguuguguauggauauggcagauguauuuauuaaguaaagccaauauagaauguugacauuacagaauuuagaggaguaggagaaguguuuuggguauagucuggcugaguucuucaaauacacugugagaaaauaacuuaucuaaaaacaugacuugaauucacggccuagaguuuccuguguuucaguacaaauaagaaucauaaaaacaguaaauucucuuugaaaaaaauucauuuucagagcuauaaacuggcagccagcaaacuuacuuuuauucuuuagucaccagcccauuucucuaauuguuuguuuuuuguuuuuuuuguuuuugagacggaguuucgcucuuguugccuaggcuggagugcaauggcgcgaucucggcucaccgcaaccucugccucccagguucaagcaauucuccugccucagccucccgaguagcuggguuuacaggcaugcaccaccacgcccggcuaauuuuguauuuuuaguagagacuggguuucuccauguugaggcuggucuugaacuccugaccuuaggugauccgcccgccucggccucccaaagugcugggauuacaggcgugagccaccgcccccagccccauuucucuaauuguuaacauuuaaaguugucagauuuuaccuaaaaaucuagaugucuugccucuugaaaagcaaacaacauuuuugcuugaggauagcaaucuacaauugaguauagaugcugucuccuucagauagggccuucucuugcccaccucugguccucuucacugaaucacguuaccugcguggccuuggaagacaguuccuuuuaaagaccuauccuacguauuugauaguuuauuggcagccuuaaauaucuaaaauauaacuucuaacccaaaagaaaguaaacauaaguaaaauuuagccuacuuuacuugguaggagagacuuagaauauauaaagucaguuuacucuuuagaagauauggcaccuuuuguaaccuuucacuuuguccuaauuuuauauagagugccaugggagccaaaugaaggagauccaauggcauaacaacaaguaacgauugaaagugaagagauuaaagaaauacuaauuagaaacaucuaaguaccuugagaucuuuuaugugauaaucaguucuguuuucuuuaaauguuaccgcuguguuaaaggacaucacuaucaacuugauguucuuaauggugauacugaauaagaaaaaguuaaaguguauucaagcuaugcaguuuacugaacagauaaaugaaauaacauuuuauaaaagauuuuugcucaaauuaguugagcuaagaaguuuaucacugaaaauaaugaguaaauuuccuaauagaauguuuucuuaaccguacacuagauuagauaauggccguuaggccauuacaaacuuuauuuuuguugaaaacuuacaucuauuuacauuuauuaauuuaacauuuacagugucuaugugaagacuaccuugaugaugcaugaaacaugauaauuuauaaucuugaucugacuuaaauuugaauuccacauuucccagagugaaagccagcuuguuaacauucaaauaauaccacgacauugguaacucuaaggaagugcuaaaagaauguuaugccuuuuuggaaaaugguuuucuaguuagaguucaacuuuagagaaaauugaaaaagugauuaacuugcacaggaaacagugacuccccugcuuuacugcucuucacacuuugaaaagagaaagugauuugagagaaagccuaaugucuauucaaauaagugauuguuuuuuaauugcucagguuagaacucucacaaagaguucucuguuggugauauguaacagucuguuauuagucauuaauaugugaauauggaaauugugaaaacagcacaaauugauuuagcaaaucuucaucaguuuagugaaagagggaccuuaacacuggagagaggucugaggaguugcuucugcaucugccugagggaaucuugucuuuccuucugaaguaaggcagauacagcuagccaacugccaguagaacuaucugacucguguaucccuuuguuggauauagaaauaccuguaccauggcauacauaguggaaaacauuaguauagaaguuaggaaaagauuacuucugcucucguacuguuauuaaguaauuguguaguuuuggauaaauauuuaaccucuuuguguuaucccugaucauuaaaugagaugggucguuggaagaacaccaacuuugagucaaacagagucagggugaauccauguucuuccucucauuaguuauagguuauaugaaaaauggauauauagugcucaaaguacaguaccuauuuaugauuauguguucaguaagucuuagguauuuuguuuguuuguuuguuuguuuugagacagaguuuugcucuuguugcccaagcuggagugcaauggugcuaucucagcucacuucaaccuccgccucccagguucaagcggucuuccugccucagccuccugaguagcugggauuauaggcgugcgccaccaugccuggcuaauuuuguauuuuuaguagacacgggguuucaccauguuggccagguuggucucgaacuccugaccucaagugaucugccugccucggccuccaaaagugcugggauuacaggugugagccaccaugccuggccaagucuuagguauuuuuauggaaugaggcaaguuacuuauuuucagaaccucaguuuuucuuguuuuuaaaaugggaauaauguuuaucauaaagaacuaauauugggguuuaaaugaggauaacaaauauaaagucaagugaaguguagcacaaauuaaauauugguugcauuuguuucacaagacucccuuuagcacagaucuuuuuuuuuucuuuuuuuucuuuuaaaaaucaucauuucaggaagaauggaguugggagaaaucuggucuacuggguaguuuagaaaaggaucuuuagggagagggcguauuuaggggccuggcugauuuacaguaaaaaugucacagagcagggucuuuagaaucuccaagugaagacuuugaagagucuaaaggggacaaaauaagaauucuuacuugugcaaaggcagcaugguagagugaaaacuaaaacagacugugaauugaucaguuacucaacaaauguaacaguuauuuauuaugcaccuauuauuugccagguacuguuugaugcuuggcauauaagauccuugcucucucucagggaguuuacacuuguggagggagugggaagacacagacaauaaauaugagagaagguugcaaauacuuaaggauugugaaugcugugggguaggguagaauagguaucuaagagcuagaugagcacuacacaaaauguggccugugaucagucugagaacuguucgcuucugguccucugugagauaagaacugaaauugagaguuuauagaaauuuuuacaucaaucugauaauguaauuuuaugucaguugagucaaaacaauuaaaacucauauuuuauaugccuuauuuuuaauuucauuuuucagguaauucauugccaccauauuuuacaauagcauugaucuacaguggguugaaaauaaaacaccagucuuuacuguauucauuuuagcagugagcuagaucaacaguugccauuguuaguacuauuaguaagcauguuguggagauuuucagcuucuuuugaugaauaauucacugucaaguaauuagcuuauuuggcuuagaaauacuuacauccauguuauuuacacuauauuuuauguuggacuaaguuauuuuaggucuuuugauuuucaaguacuuuuauucaugguuggaugcaugauacagguaggaagagaacaaaauuaaaacuguaagguauauaauaagugauuucuuuuuuuaauuuuuaacuucuagauucuguucucaaugcuuagauuauuucuaacauuuuuucucaacucauauuuuaugaucaguauaugguacuuagaaagcucuuuugauauaagaucuuuccuccaaccaagaguuaauuuaugcaugaaauuguaucauuauauuugucccuaucacuucaucugcugcuggugggucauagauccugagaagagaauauaguuguuugaggaaauuuaucauugauaaccuagauaauauuuuugauugucuauauaagucuaccauuugcuauugauaaaugauaacuuuaugcguccccucauuuauagccccauuaucuuuuuuaugugauagggguaacuuaagaaguauguugaagauagcugaaaauaagauuuaaaaauauggaaaauauuuuggauaaccccuaguaagcauuuuaaguacuucuuuucauuuuguuauuucagaugcgggacuaaacuaguuucuggauuguuacuuuaaaaugaaauuuaauauaucucuagccuuaaugaaaaugguaguggaguagaauuauguauuaguagauaauaaauuaacuaaaaaauaaguaaaaauaaagaaaagggccuugcagauaaugacucaacucuugccuugucagaucuggccaguaaaaacaauacaugaaugauacagguuugaaaagaauguggcacagacagaauauuuucuugggaagacauucguaauuuaaugugccuagguuuuuauacucagcacaugcuuugguaauauuaacuagugguaaauguguugaauuauuuaaccaucauaauagugauaccugaagguacacaauucuuauuauuuggugaaauguuaaacaauauacuucuaagagcacaucuacuuaauaauguuuacuauuuaauugauuaguuaaaauuugaaagguaguuguagaguagaaugaggauaacauuagguaaugugaauuauaauuuguauuuuuaaugauugccaaacagcaaccauugaauuuacguggucugugccauaaguaagcuaaggcuuuugaauaucucugagaguuaaaaauauuuuucuuguggugggggguggaauuucaguuauauaagaauuauaaauugguuuucuuuuauuaccuggauuugaauucuauucaaauauguauaucaaauauauguagauaacuagauauauucuagaaccagucaguacauguuggggaacgaauggggaggguuuacucagcaguacucuccuuuaguuuggucaugaaaugaggacugcuuuauguaaauuguccuuacuggcgccagcuagcuguaacugcagucuggcugugcuaggguagcaaauaaaaugugucauggauuuucuguuuggaauguauaagaauucagccuuuuggacugaaagaacagaguugauacauuagaauagcaguagugagaccacaauugacagugaauaugugaaauagugagaagcuauaagccuuuuaagcuuuuaguucuuuuauagguuuauaccuauugauacuauuggguaauaugugggagguacuuaacugcacacaguugcugcagaccuaauaguuggcagcauagaaagcaguacaaagaauucugauucuaggcauuuucacuuugaaauagucauuuugaagauauacucuguguguucugugagcuucauugacauauugucugacguuuuuuggcuuuugugguaaaugggauguaugcugcacaaacuacccaacagaugugaaccacuauuugaaaggaauuuuaauauguagccaaccuacuguauucuuguuuuuuuuuuaaugaauaugaaucaaacaagaaauuuagacucgagaaggcugaccuagaagucugcauuagcuuuuaauguuuauacaaaugaacuaaguagcagugguuuacagaagaggaaguccuuuucacagugucaagcugcccacagguaagagauucagguccuuuuucugugacaccuaccccccaggcuuuauguuuuucucucaccauuggaaguuuuuaaaaauuuguuuguuuuuaguucuaaugaaaacaggauugguagaucguuuaauguuaauauucaggagauuuugaaugccacauuuggauuugguauuuuuuaaaauguaauuuucaucuucucaaaauuccuucacauuugaauugaaaugaacuaacaguggacuucauauaugaauauuacucaugcauacaauauguucauauuacauagaaaucaguuuuagaucucuuuucauuauagucuguuacuauauucucacuuguagugacaccaacugguacacgcagagagaugacauuuuguaaccucacuuaaguauaaaguuuuaguuuaaauuuaccacuuugaauucaccuuuacaaaucagagugcuuauguuuucaaauauggcucauugacauacauuagauaauguauauuuauacauauaacuuggucaauuuucuacuuccacccuuauucuuuccauuucucuauauuuaaauuuauuauuauuuuaauaaagugauuuuuaaaagucuaaaaugaauguauuaauuaggaauuccacuaaauuucauauuucuuaaccuggguuaaaggaacacagucauuuguuauuauuuuuuucuaugcaugaaauauuguauacaaaaauauaaaauuccauugcaauaaaaauaaucuacuaccauugcuguaaagauaggaagguguauguuuauaaagaaaugccaauguauguguucauucguaucaguauggccagaaauauauuacugauuguaauaauuuuuggagggugggugaagaguugaauagcagaguaaagugaagagugguagugagguagcuuagaguaguguaucaaagaaaggaauuacgucaggcagcucucugcucuuucccucccucuuuagaagucaagcagcaggcucuuucuguaaccaaaguguuacuuuuaggugggacuuccaguucucuaguuucugaaaguuuggucacuuauugcuacauaguuguauacuuuaaaacugggggccagcugugauagaagccauacucauguuucaggggcaggaacuguuccuuacuuguugccuuuugacaguguugcuuggauuuaaaaaaaaaaagcauauauuuuauuaaaguauagaaacguaacuuuuuuguguauguuucaucucaguaaacaauuucccuaugauugacaaaaugaugauaguagaaagaaaucaauuuugauugauguguuugagguuggaugaggagaaggucaugcuucuugguguggaagacauacacaucugaaacaguaggaaaaaguuuuucaaacuucucuugugcuauuauauugguuaggggaaugcugggcugggaagauaguugagaugggcuaguuuuuacauauagacaaagagaaaaagaguugauagacaaaaacaggaauuuauugaaugcuguuagaguuggaggucauagcaaagaaagaugagggauaguaggacagagguauauuuuguacauagacaaucaaaacaaagauaaaagucaugaguaugauuacaggcgugguggcucacgccuguaaucccagcacuuugggaggccgaggcaggugaaucaccugaggucaggaguucgagaccagccugacuaacauggugaaaccccguuucuacuaaaaauacaaaaaauuagccagaugugguggcgcacgccugucauuccagcuacuugggaggcugaggcaggagaauugcuugaauccgggaggcggagguugcaguaagccaagaucgcaccauugcacuccagcuugggcaacaagagcgaaacuccgucucuaaaaaagaaaaccaaaaacaaacaaaaaaacaaaacaccaaaaaaacaaugaggauaaagguauauagucuuugaggcuauugaaguugagugugaaugauccaaaauuuggaguauaaaaaucuuugaguuccuaaaaaguguuuguguuccuuuuaagaaagaaaauguauuuagcaagcaauguagaaucucaaaaucuucaaaaugaaaugaaccuaaguggucagguaguuucuaauauugcacuuugcacaggaaccuacuguuugauauuccugacagauaauuaucuaguuuauacuucacuauuucuaaugacagaagggagagucucuauuuucauaaaucaguuucuucuuuuauugggcauccaaacaaauuaacauuuguugauuuugagaugaaguugccuuucauuacuuuuauuuuugcuucucauagccccccacuuucugucugucuguagcucucuuucucuuguaucucuuuuacaugacaaauauguacuauuuaaagaaagcucauuaaaauuuucuuauguuuucuaggcuaaauaucaauaucuuuuauuuuuuccugacauuuccucauacaacuuacuguuccagagcauucuuuagcauggucaucccacaguuauuaauaaguccuucuuuaucugugaugcucagaaccaaacauaauuacucuaaaaauuuuccccuucuccuuggcuauuuguucuacaguuuaacuuugcauuagcauuuuuggcagccaccuugagaugauuuuuugaguuugcauuaaguuaaaauaccucagucuuucccuaauauucauugauaaacuuuaacauacuuuaauauuugaaacaauuguuacguuauuauguuuucuuaauaauuucucauguuguucguuauauuuacuaugcuuugugucugucuuccuugcaagguuuuuuucuguuuuaauaguguuuuuaaagaacuggcuuuugguuccuuaauugcuugcucauuuguuuucuuucauaauuuucugcuuuuauuguaauuccaugcuuugggauuauaccuuuuugccuuuauuaauguuuuugaguuuguguuuuuuguuaauauaugcauuuaaggcuaucaguuuuaaucugaauaucauuuuagcugauuucccuagguuguauucuuuuaauacuucguugguauuuuaucacugauuuccuccuacaucuaaaaguuuuuuuuuuuauuuauaaggagauaauuuuucugucaucuuguugguauauuuauuacauuaugacuacagaauauagccuugugguuuuuuuuuuuugucuuugaguuuguuaagauuuucuugucgccauacacauggucaauauugauguacauuggcuguauuugugaaaaaaauuauauuuuggguuuauuggguauacaguucuauuuauuuuuguuauucugacaugcuaauggguuguucauugcuuauuacuuuuguguucuucauccauagauuuauuucugauugugaauuuauuaguuuuuuccugaauuauuuaaacuuguuuuaucaauaggacauaucucuuuuuuuuguucuauuacuugauuuucaacuugaauucuuuuuuauaugucauauauagguuuuauauguauaccuacccuuuuuugugguacuauuugccuagcguaucauuuucuauccuucuguuucaaccuuucuaugcuguuacucuaagguaugucucguuuauagugcauagcuaaugauauuuuuguuguuuuacacgcuugaaacccaucagguuuuucccugauugauaauuuucuuuauuuuugccccauauucugcaaccuguuaguuaacuuacacauugcaauuaucuggauaaauaacauauuuauuuuaaagaugauugauccucaguuauuucagccugcucaagaguuuuacuuguuuuuuggagcuuugcuaauuuccuuaucugaauuucuucauagguucuucugcugucuggucuuguacuuauauuuauauauaaucauuuuagcaaaggucugcauucucugucuuugcucagaaguaauauauuuauuuccucacucuugcugacugcuagcuuugcuagcuguagaauuccacagugaaaauaacuuuucccaugaauuuugaggauauuguuuuuuuuuuagcuuucaguauugcugaugacaagucugaugccaguuuaauucuuucucuucuguaguuaaaugauauucuaaguuauuaauauuucccuauaaugauuuucugaaaucuuauugcaguaugccuaggugucaaaaaauuuuauuuugcuuauuuuaauuuaguuuguuuugggauucaauagaccuuuauuauuggaaaacuuguauauuuuuucagcuuugcugauuuuuuuuaauuuucuuauuuuuucccuccuuuuuuucuuguuucuuuuuuuuuagaaacuugacuuaauugaaaguuguugcuucuggguauauuucuuauguguuuguuuguucuugugaguguaauaucuucucauacacuuagaggauuuuuuaauauacuauuuuaaaaugucuucuguuuauucuccuacuaauuagcuaguguuuuuugugggauuuggcaccugaccuuuuguuugaauucuugaauguauucauuuuuguauuugagauuuccuguuuuacuuuggcuggaugcugaugguucaggugauugugagugguggggaagugguacuugcuacacaugggauaugcugauaauuugucuuugggaugguagccuccaugucucuccggggacauagugucuauauaaguuacuacccuagcugcauucacaaaugugacugcugcccugguuuagcacuagcauggaagagagaaugucugaugaacuuaacuguucaaauaccaauuacaugagugaauuuucaugugaugauucacacuggcguaucaggucuaaauugaaagucuguauuuguaucgccuugucucuguguaagugagguacuuuuaacuaguuugacauuuauccuuuuagucuuuaaaauaucacuugcaugccuguauacauguuuagauuuuuguguguuuuaaaauauaauggcauaaaacaggaaacauuuauugacugcuuacaguaucuaaguacuuucuauuuauuaugucauuuaauucccauaacauuuccaugaagacagacuuuguuauuucaguuucauagaugauuuuacugagguaaggagaagauauauauuuuagauagauaaccaggaaauuaauaggauuaauauuuaaaaagguaugucugguccugguauuugcacuauuaauugcaagaguucugcuuuuuuggugugcuugauaauauuucucagagauuuuuuuuuuaauuccugggauauuaagggcuuuuguuuuuguauuuucuaugacagugcagcacuaggcauccugauauauuccuuuguaaaacauguugauacauuguuagauagauaccuuaaagguccuuugcugugucaaaaugaugcacaauuccugcuuguuuguccuuaaaaauggaugugacaguuaacucuucugcucaugguacauaagaccacucauuucuguauauuaaugcuaaccacaaguaguugccaaucugauguuuaaaaauguauuuucucuuucuguuuugucuuuuuuugaugauuagguugaaugccuuuucuuguauauguuguuuuaugaauugccugcucacguuucuguauuuuuuuuccaacuguuuguccuuuucauucacuaauagauuuucuuuuuuauucugaauacuaauccuauaucacuaugccauuuuuucaaguauuucuccuaacuugugguuacuuguaguacuuucugugccuuugaauauuuauauuauuuuaugucuagugucuuugcuauuaugcuuaacugcuauuuugauagauuuuccacuauuuauuucaaaauccauuucuuccuuauuuguuacguuuuguuuuguuuuuguuugagacagagucuugcucuugucacccagguuggaauauagucgugugaucucggcucacugcaaccuccgccuccugggguucaagugauucuccugccucagcuuccugaguagcugggauuacaggugucugccaccacgcccggcuaauuuuuguaauuuuaauagagaugggauuucaccauguuggccaggcaggucuuaaacuccugagcucaggugauccgccugccuuggccucccaaacugcugggauuaguggcgugagccaucgugccuggccuuucuuucuuguuugugaugcuucucugucauaguuaccuuuuuuauuguuugugucugucuuuuggaugauuauucuguuguacucuuuuuuuuuuuguacuuaagauaauaaugcuuuguuauaugcugucacaucugagagggcaaacauuuuucauuacuuuugguuuucaauuuuuucccuguuuuuagcauuguuucacuuagagauuaagcuuuuuuuuuuuuuuuuuuuuugauauggaaucucgcugugucgcucaggcuggagugcgauggcgcugggcucacugcagucuccaccuccuggguucaagcaguucuccugccucagccucccgaguagcugggguuacaggcauccaccaccaugccuggcuaauuuuuguauuuuuaguagagacgggguuuuaccuuguuguccaggcuggucucuaacuccugaccucgugaugcgcuugccucggccuccaaaagugcugggauuacaggcgugagccaccgcgccuggccucagaguaaguuuuaaaagcuagucaugcuacaaaauaucuagguggaauuuucuuuuuuuuuucuuucuuucugucugucuuucucucucucuuuuucuuuucuuuucuucuuucuuuuuuuuuuuuuuuuuugagauagggucucguucuguagcccggacuggagugcaguggcaugauuauaguucacugcagccuuaacuucuggggcucaagugauucucccaccacagccucccagggagcuggggccagagacacaugucacuauaccuggcuaauuuuuaaauuuguuguugagauggggucucgcuguguugcccagacuggucuugaauuccugggcucaagcaauccucuugucccagcuuuccaaaguguugggauuauaggcauaagccaccaugccuggcuauaguuacuuuuaaaaauuccccuuuuuuuucuuuagucaccucccugacaauacuucuaauaaauuuuauccaggaagaauugauuuuuuuuuuacauugagucuuagcucuaauauuucauaagacaguucuaauaugucauguaaguguuucuagauacauuuuucuugccauucugauuuuuuuuuuuuuuuuuugagacaaagucucccucugucacccuggcugaagugaaguggugcgguguuggcucacuacaaccucugccuccuggguucaagcgauucuccugccucgcuuccugaguagcugggauucuaucaugccuggcuaauguuuuguauuuuuaguagagacggaguuucuccauguuguccaggcuggucuugaacuucugagcuuaggugauccacccaccucacccuuccaaaguacuaggauuacagucaugagccacagcuccuggccugaauguuuucuuuauuguauguucugacuccuguuugagcuuuuacugcuuugcucaggauuuucacaacguauuggauauaguaugcauacccuuuguuuuguguuuaagagaaaugucugugguguuuuauuacuaugguguuuuuuuguguuuaagagaaauaucugugguauauuauuauggaauuucuuguuaguuugaagugaucuuuaucagcuaaaggaaugauuuuuauguucuuaauuuuuauuuuuaucagugcuuaauuuuaauuuuuaucagugaaugaguguugaaacauuuagugucuuuucaauuucuguuaagaaaugaguuaauuuuuguuuaccccuuuuauauugucaauaaauuuccuaauaugcuuuaaaaauuauuagagguguuuaaaauggaaaaacagugcaguuuaggauagagauguuaaucucaucuuuuaguaguuaaccaggaauaugaggauaaaggaauuagaagaaaauguauaguuucuugccuccuggccuuaaugaucuaacauagucacagucaggcuccacaaacugcucuucuagucucucuaagcacuguucuuugcacaguauauuuauugaauugauuguugugcuguuaacagugagguggcugaucgaauuuuuuucuguuuaccagucaaauggcuucagacucuuuaugucaacaguagaaaagaugauuaaaaauuuagaagagaaauaugguauuuggaaaugccaaaauaaggugcuagaucugcauuugugaacccuccaaaagagcuuaguuauauguacuugguggcuuacugcauuuaucacugaauuuccuuggaauuuuucuccccugcuucucucucuccaccuccuccuuuuuauuuuuuuuaauucuggaggcucuaggcucaguuaaauauuuucauguggcagagagccagauuuccaauagcccugaacucagcaugcugcuguugcuuagcaacuacuugugaagucuuguggcuauaacugaauuauaaauaggguuaugagcagaagugcaauugaaauugagauuggaaagaaaggcauacucuuuuuucccccgucucacuugaauuugagugauuuuuuuuuuuaaaugcagagucaguuuucagaaaucuggcucauaaacauugguaauacuaacccuaucaggaagacaauaugggcaucuuuguaauuacacauuuguaagcuuuuuuuuuuuuuuccagugcuaaacagucuauaauggagacaaggcaguucauggaaacuagagaacagaacuucuaauuuucauggucauacauguagaaaaauauccauauauuguauuacugcuguauuuaucuuccacauuuacauuaaaaucuacauacaggaacacuuuauuagauuauguucuuguacuuuucaucacaucauuucuuuagaguggcuuaaaaauuguccuauaaucaugaccacaggcauuugaugaauauugaauacaugaguaaaucaaccuaucuuuauuauugcuuaaacaguacauuuuuaaguacacuuuauuaaaauguuaucagcaaaaaaccugaaagguucuuuaaggucuucugauuuaauuuccuuauauuucacauggaaagcuuuagaccuaacgauguuaaaugauuugccuaagaucugucauacccugguguguguauguauauuugguuuuuuugcauuggucucucuuacuguuacauauuucacaacucucuuuuuuuuugcacucauauuucaucaguuuacacaaaauuuaaauucuguaauuuauuaaaaaauguacaacuuaguaacaaacacaacuuacaugaacagguuuaguugagagcagaagaccauggguaucagucaauaaauuuguagaauggauggagaccacuggcuuauuugauaugaugauuaggagguuaagagaguuuccaaaguauagaauuuuuggucagaacucuacagauuuuuuuucagguuccaaaagaugaaacuaaguggcaauucuugguuuuggguaaagaacucugugcuuucuuaaaauauauuaaacuuuuuuuaaucgcuuuuaacagcccauccuaugaaacuaagucgauugcagacauuugccagaaacaaguagauuguauucuuaggcauuguugcuaggaaaaauuuagaguggaaauguaauuuuuucuuuugcugccaguggaggugcugguucauucuuuguuguaugcccaguaguagagaucuugcuaucaaaaguguaaguuucuuugaaagguuuaacugaaggaagauguagaauuauaaauagaauuggcuggaaaauuugugauaaaaaauaauuuuaauuagaucuacaaagagggauaaccagcaaucuugcucugcuauagaagauaaauaguugguacaaagaggaauuugaauuuccuccauaauauggaagaggauuuagggucuuuuuucuuucaucuuuuuuuuuuuuuuuuuuuuuuuuuuuuugugacaggaucucacucuguggcccaggcugaagugcaguggcacaaucauggcucacuaugaccuugaccucucaggcucaagugauccucccaccucagccuccggaguagcugggaccacaggugugcaccaccacacccugcaaauuuuuaaauuuuuuuuguugagacagggucucacuauguuguccaggcucaucuugaacuucuggugccucaagcagucuucccaccucagccucccaaaguguugggauuauaggcgugagccacugcacccagacaucucagcugccacuuuaaacuccuguggguuuuuaguagggcaguuggaagagaagaggaauaagauagagauccagggugaaguuccuggaacucucuaaacuauucuaaggcauuuuaguugcuauacuaauuguucuaaggugccuugguuauucaguuucccucaaauuuugauugguaugugauguguaacugcuuugaauaauguuuugcaagcaucaugucuucuugcuuuucuugaaacaaaacuggccaguaugagcaaaaauuauuuuaaaagcauuaaaacuaauuuaauaaagaaaaugugaaauuccaagacauguuuaaagugauauuugauauaugggauuauuaaauguucucacuuguauugcuuuguuuuuuuauuuuuugagauggagucucgcuuuauugcccagguggagugcaguggcgugaugucagcucacugcaaccucagccuccuggguucaagugauucuccugccucagccuucugaguagcuggggcuacagaugucugccaccacgccuggcugauugcuguauuuuuaguagaguugggguuucgccauguuggccaggcuggugucgaacucccagccucaugugauccaccugccuuagccucccaaagugcugggauuacuggcgagagccaccgcgccuggccuguagugcuuuauuaacaaaaucugauauguuugugauauacucuuuucacuaguugugacucauagguuuauuaauauugcuuuccuugcaaugaggauaacaguauaaguuaagaacuauuuuaagauauuuuagauauaaauauaauugugguuaaauuuuggauaucuguugcauaugaauguaacauuuaaaaaaaaaaaaaguaaaauaagcuaagcuacuuuucauguagaccaguguuuaaaauaacaguauuuauggguuuuuuuuuuuuuuuuugagauggagucucgcucuuuugcccaggcuguagugcaauggcaugaucucagcucacugccaccacgccuggcugacuuuuuguauuuuuaguagagacaggguuuuaccaucuuucccaggcuggucuugaacuccugacauugugauccacccaccucagccucccaaagugcuaggauuacaggcgugagccaccaugcccggacaguguuuuuaaaagcuugguuaaauuucauuuaaaaaucuaaccacuguuaaauauuugguuaaaaagagccucaguugguggauuacucguauaauuuuuacccuuccuccaauggagcuuuuguuacuuaaaaugguucuguguuccuauauguuuuaaaggcauuguuucuaaucuuuaguucaugauuaaaauaaguccucuacauauaauuuuuauauuaaguguuuaggcuuucguagugucaaauauaugaauucauuuugcauuuuggauaacaaguagugaccaaagaaacauuuuaaaauuaauuugucauuucaucaaaacacacuacuggaugguuucauauaagaaaugcauagaacaaguacauuaauaaauagcauugguuuuaacaugacuuggcugucaaaccagccauucauuucagcaacuguaauuuaaauucuugaaauuaaaagguuuuuuuuuucuuuuuguuuucucuuucuuauuuauuuaucuauuuauuuuuugguuugguuugguuugguuauuuccuacugaucuguaauccucuucaugauguuauauuagacuauacauuguuugacaucuuuaggaauuaaaauccacuccauaauaaauuuguacuauacaaagagacaugccuauuaagcauuauuaggcuggaaagguagaaugaugaaaugcauucuguuaucuggguaaaggaguaagaaauuucaaguauugucaacuuuaacauuacuccacuuuaggcaaaguugaaaaaucaaaaauagcgguguuguacagauuauuuaugugcaugguuaacuuuuacuugacacaaucuuaagauaauuuguuuuucuaacugauagaaauuauuuuaacuuaauugagaaaauaauuauugaaugccuacuguguauaagacacuacuuuuuguggaaagaaguuuguguuaaaaaaaguauaaggcauacuuccuaccuuauuuugaagucugcuuugguaaguuauuuaagcuuuguauuuuuaauacauauuaagcaguuuuuuaaccaacaaaucugauugacucauaaacuugcagaaaaaaagugcuaggaaaaauguaguacuguuuagaauuugagauuuuagagaaacuuuaauguauuaggacugugauucaaguguuuuaugauucuccuguaaauagaaaaacacuuaaauauauagauauugaugugcacacacacacacacacacacacacaaauauauauggacaguggcauguuucuugaaaguggcccauuuauuuagcuuaacauucauuucuuuaauuggcaccuaauaaguaaaggugucaaguuaauauuuuaggugaugaaaugcaaggcacauauuuuuuuccaagaaaauagaguguuuuugcuggaaguuuugcuuuuauauucgcaucuauucuaagauuccugcuagcauauuguuucuauuuuuaggcuguugccaggcagauuuaaaauuucuucucuuauggcugucuaauuucuaucuuccugauugguuacaugaugcugcuuuuauuagccaaccacagugacuauguaaauuguauuucaguuucuguugcugugaaagaacugauaagauggcugcagggggcucccuuugggguauguuuuuuauuuuaaagaggguuuucaucaauauguaguaagaagcaaagguagauuucuuuuaaaggggcauuuuauuuuugaaaugggaaaucaaacuaagcaagcuuuauaaaaggcugaaaaaugacucucuuguguauuugauuaauuuuaaugcugcucuguuuugccucuauuaggcaacuuauaaauggguauauuuuauuacuuuuuguauguaaacaugccagcaugcuaguuuacaagucuguuaaaauguucuagauuauugucuuugcuuucuaaaagaauaguuuuuuucauguaggaauuauuuuagaugucaguuacguguacauagcgcaucauucuuuuagccaauacuuaauuguauucuaugugcucaacacuacguaguucacuaauauuauacuagaauacuucauauucuucuucuuuugugaaaugaccucagaagcacaucaucaugauaucagcauauuuaagauguuuucuaauaucaaagcuuuggacacuuaaaauguauuaauuuucccugagauuugacagagauuaaaauuugaaagaaguaauaauuuuauacuagauacucgauaaaaaugucaaaguguuccauuaaacaauacauaaauguaguauuagaguccauuuauaauaaaaauuucuaaaaggauaccuucagagcauuggcaaauacagagaaugguggcagaacaugccaugugaauaaaaacaauauugauaaaaugugacaaagccauauguaacaucagaaaguucaagaaguauaccucauuuaaaaacauuuaucaucauuaauuacauauaaggccuuuugguuauaguaccauuuuauaauaaaagagaauguuucuguuucacuuaagacuuucuagucuuucugguaaaagauaguuaauugaauuuuccauaugcggaagacuuuauuaauauuugcuccuggaggggucaccugugucaugcuuaguacugcuuugucuuuuguuuuuuguuuuuaaauaucuugcgugaguauuuuaugcccauuacugcaauccugcaagaugagcauacuguagaauuauguaccauuugggacagggaaaaagaguaaugagcucauccaagaugaggacauaagagaacaaggcugcugcuauuuuacacauacugccuuucaccaccaauauaaucacagauacacuuguuggccuaaaaaugugaacgcucuaaaguauaaaccaacacucgguucucuugguauaguuguucuguccauguuggaagugugacccaguaaagggguuuagguuaaaaauaaaugaaaaacacucaacugaaguucugcuauuuuuuuuaaaauaucuaguuuauugagauacaguucacaugucauacaauucaucuguuugaguguauaauucagugguuuucagcauauucacagucgcauaaucaccacaaucaauguuugaacauuuauauuacccuauaaagaaauccuguacccuuuagcagccaaccguuauuuccucccaggccuccaacccuaggcaauugguaagccacuuucugucuguauagauauagauuugccuauucuggacauuucauauacauuaguccccccuucuccacaguuuucguuuucugugguuuuagcugucuguagucaaccguggguaauauuaaguggaaaaauuucagaaauaaauaauucauaaguuuuaaauuuggcacuguucuaaguagugugaugaaaucucaugccauucucuucuguccuacguaggauaugaaccaucccuuuguccaguauguccagcauaucuacacuguagacgcuacccacccauuagucauuuaggagaugucuggguuauuagaucugugcugguaucacaauguuugucuuaaagucacccuuauuuuauuuaguaacagcuucaacgugcaagaguagugaugcuggcaauuuggauaugccaaagagaagcuguaaagugcuuccuuuaagugaaaagauuaaaauuuuugacuuaauaaaggaaagaaagaaucauaugcugagguuucuaagaucuauaguaagaacuaucuuauacuucugugaaacgaacaguauauuguuauaauuguucuauuuuauuauuaguuauugucaaucucuuacuguuccuaauuuauaaguuaaauguauguauguauguauguauaggaaaaaacauaguauauauaagguucaguacuauccaguuucaggcauucaguggguguuugggaauguaucuucuauggauaagggggaauaccguaaauggaaucauucacuauguggccuuucgugacuggcuucuuucacucagcauguuuucaaaguuaaugcauguaguagcauguacaguacuucauuccguuuauggcugaaugauacucuauuguauggauauaccacauuuuauuuauccauucauuagucacagggcauuuagguuguuuccaguuuugggccauuaugcguagugcuucuauaaagcauuuguguacaaguuuuuguguggacauauguuuucauuucucuuggguauauaccuaggaauggaauugcuggaucauauggcaacucuguguuucacauauuguggaacugccuguuuuccaaagcagcugcaccuuuuugcaaucccaccagcauuguuugaagguuccaauuuauccauaucauugccaauacucauuauucuuguugauuauagcuguccuggugugugugagauguuaucucauugugguuuugacuugcauuuugcugaugacuaaugauguuuacugccuaugaacuauuggcuuauaaaagccauagcauuaggagaaaaaccuaauguaggugacggguugacgggugcagcaaaccaccauggcacuuguauaccuauguaacaaaacugcacauucugcacauguaccccagaacuuaaaguauaauaauaauuuuaaaaaaaacagaaaaagaaaaaaaaaagccuuuuuguggaaaugccuguuaaguccuuugcucauuuuaaaauggaguuauuugguguuuuauuauugaauuguaacaguuuuuauauauucaagauacaagucucguauuggguauaugguuugcaaguauuuucguccauugugugaauugucuuuucacuuucuuagugguuuccuuugcagcacgaacaguuuuaauuuugaugaaguucaguuaaacuuuuuuuuuuuccuucuucuuuuauugcuucuucucuuugggucauaucuaagaaaccauugccuguuccaaauuuaugaagauuuuaugucuuuguuuccuucuaagauuuuaguuuuagcucuuaaauuuaggucuuucauuuauaggaauuaauuuuuguauaaggcaagaaauaggacuccaacuucauucuuuugcauguggcuauccaguuuuuccaacacucuuuguucaaaauacuauucuuuccccauugaauggucuuguaacccuugucuaagacaauuuacuguaaaagugaggguuuauuucuguuccaaaauauauccuaaggauauaccugucauuuuacugguaguaucacacugucuagguuauuguagcuuuguaauaacuuuuaaaaaugcaaaguaugaguucuccaaguuuauuuuucuucuucaagauuguuuugguuguucugggacccuugcauuuucauauuaauuuuaggaucagcuuaccagugucugcaaagaaaauagcuaggauuuugauagagauuguuuugaaccuguagcuuaauuugaagaguguugacaucuuaaggauuugagucuuuugauucaugaguauggaacgucuuuuauuuauuuaugucuuuaauuuauucaauaguauuuuauaguuuucagaauauuaaguuuuguacuucuuuggcaaaauuaauuuuugauauuacucuaaaugagauuguuuuauuuuuggaucauuuguuucaaggguauagaaaugcaauagauuuuuauauguuaaucuuauuauagugaacuuuguuaaacucuuauucuaauaaauuuuuaguugauuucuuacuauuuucuauauacaagauuuuguuaucuguaaauaaaaauaguucuuucuuuuuuuuuuaaguuguaugacuuguggcugggugugguggcucaugccuguaaucccagcacuuuggguggccgaggcagguggaucaccugagcuuggcaguuugagaccagccuggccaacauggugaaaccccgucucuacuaaaaauacaaaaauuagccaggcuuggugguucacaccuguaauucuagcuacucaggaggcugaggcaugagaaucacuugaacccaggaggcggaggcuacagugaucugagauugugccagugcacugcagccugggugacagagagggaccaugucucaaaaaacaaacaaaaaguuguuugacuuuuauuucauuuucuugccuaauucuccuggcuagaacuucuaguucaaugcugacuagaaauggugagggcagauaucuuuuguucugaucuuagggugaaagauuucagucuuugaccauuaaguaugauagcuguggguuuuuccuuggugcccuuuaucagguugaggaaauccucuucuauucuuaguugguugagugaauucugcucuuaauugcuauguuaaauuaaggaugagauaauuuaauacuuagaaagcugcugguaauacucuuguagcuaauacaugaagcagucagcaggcuggugaaauuggggagggagucuacucucaggucucauuuacugaguagauagguauuaccagugaucuuaaauggcaucuccauuuucaaagagauaaagaagacaauugcugaacauucuauuaaaaugguaccaaaacuuaaaugaugaaaugcauaagaaggguuccugugcugaagaaaacaacuugguacugaauugggugucugcuuuaccuuaccaaguuaaaauuacuauuuguguaauuauugauaguaauauaauuauugauuuauuaauucacaucauauguaaaguugaaauuaauauaaauuaucacauaaacuaaugagaaaaggauauguuuuguuauagugacucacauauauuauuccucgauaagcaucaguuucuuuuucuccuuucaagguguguaauaaaaggguuuuuuuucaagguguuaauaaaaggcagaauuuauaaggcaugguugggaauaauaaacaucaaauucaagauuaugcuuaucuuugcauuuaggagucaagaauggagaagaaggaguaagcuguuguguuguacagggcacuuuauuuuuauuucauaauaaaaaauuauaugugucaguauagcuaaaacuugagcuagaauggaacuuagcaagcaucugcccuaacuucuucaguuuuacaguugaggaaacugaacuccagagaguuaaauugauuuauucuauggugguuguauacuaauguuagaacauggaauagaaccuaguuuuguuaguucagaagucuuuuuguuaugccaagcuuuuuagaauauguguauuuuaaagugugauaguuugcaugauauuuuauaauuauacuucuuuacagcaagaggauuauaugucccuaccuuuugccaugugacaugagguguuuccccuugggagguuuuuuacuucccaugcccuuagugacuuaauuugguuuuagccaauggaaugugaaugaaaguaauguacaccaugucuaagcaaaagcuuuaaaauaagcuuguccugccgagggcccacaggcugcauagagcccagggcuguuuugaauguagccaaacacaaauuuguaaacuuucuuaaaacauuaugaaauuuuguuuuucagcucaucugcuaucguuaacguauuuuaugugugacccaagacaguucuuucauuguggccuagagaagccaaaaguuuggacacccuagcuaaaagcuauuguauacuguauaucucugucauauuggucuuuuaccucugccacaaggccuagauggggugagggggugcuguuccuucagccugguguccuagaauaaugaaaaaguauacaguuauuagccagugaaauuuuauuguuguugcugcauuaucaucuaguaaaaggugacugacacagaaaguuagcuguccagcuuuucucuuuagguuggguuaauaagaaaaguaagaguuauuuccaggcauuugaaggauuuacaucuuucagcuccucauaccucauucuggguguuuuacuucacccaagcaaaaugugaaaaguacguuuggacaaaugauuucuacugcugguuauuuauuuauuuuuuuaaugagaccuggucuugcugugcugcccagguuggucucuacccuuuaggcucaagcaguccacugccucagccucccaaguagcugagauuacaaguaugugccacugcgcccagcucuggacaaaugauuucuuaaaugccuguggagauaaauacaagaccuucuguaacuucacuccuuaucugcauagggauaguagaguuuggcaagcuagugaguagggccuugauggaaaauuggccaauuuucuaaggggguguaauuugcucuauguauucuaaaauggcauuuguuggaucaggucauuuaauuuuauuuugcccauguaacacaaugaucccaaaaauugacuuggagaaguaauuuuaagguaucuuauguuuuuaucauguggaccauuccaaaauuucugaaaacauagcacugaaugcaacaagaaguuagauuguagugacaguucuggcuuugauguaaccaaacuuuuaaggacaugauuuacuccugccuugucuggggaauuguugguaaccuugucuagggaauuguugguaaagcaaacucccaguuuccuuugugguugguuauuuuuuacaauuuaguuuggggauauugcauuccacauuuuggucggugacaggcagagggguuaauuugugaaagugucaaauauuaugaucacuugauaacuuacucaacugaguuuaugaguauuugauaaacagauuucaccacuuacuguuuuuuuuuuuuuuuaagauggcaggauagcuagugacaguuauuuuauaccaguuaagagaaccguagcugacaaugcaacaguguaacaucuguuuacauagccuuuauguuauacuggguauuauagguaauuuaaagauaauuuaaaguauacagcaauaugugcauagguuauaugcaaauacuacacuacuuuauauaagggacuugaacauugucagauuuuguuaucuguagggaguccugggaccagucucccacaaauacugauggacaugguauuuaaaauaaaaauuucaaaaucuuuauacuaaauuugagcagauaaguaucaaagugagugaacagauucaguagucuauuuaaugggcaguaagcaguaaagcagauuauuagcaucuuuugugcaacccacuauucuuuaugauuuuauuuuuagaguauugcaaauucucaagcaaaauuuagaaguguaaaauaaaaucauacaguuuucaacugagaaugggauucuuaaagaaucuaauagcagaguugcauuucuaaagagguuagaaauuaucagcauaaagugauuauuuaauauuuaauucagccauuuaaugaaaauaaacucaaauuaaaauuauuuucaguagaaaaaugaaugaaauuuuuauucagaaaaauguuguacucucaggcaacagcaugaauauaauuggaaugccuuugucaaagauagaaaugccauguccacuuaaaagguuuugcuugauguuuucuaagcuuuugcuuuaguuuuauuuugaaguauacuucaucagauauucauuacuuugaauuaauacagcauuuguuuugucuauguguuguauaugcuuuuugacccaacaaucgugguacuuaguuaagucuguucuuggaaagcaguacagacccuaguuuauuuaaucaaagaaacccuaccaugaccuguuuuucaaacagagcaucuagaguuauauuccuaauguuuccauuucauuguucaccuugauuuucacauccuuugcauuuuuaauagagcucuugcccucaucuucuucccuuguugcugggcaagguuugugacacugaugucugauugguuuuagacuauuucggcuuugagccaaucagacagugaauuucaguucucucacaggacugaaacauugaagcagcuguugauauauuuuuccuguggggagauuauauaaacuaagaguauggcugcagcaagcucccucuuggguauguuugaaaaauuacaagguucaucuguaaggaaggggggaaaugagguuuauuuuuaaaacuugguuauuaagaacaccuaauaaguagugaauuugagaaaaaaauucugauaacaaauuuuccauuuuuauuuuauaauccuauauuuaaagaacuauagaaugguguaauauaauaaaaaugucuuuaauuuucaugaauauuuacuuuguaauccacacauuuguuuuauaauaaagcuuugaaaggauaucucauauaaccuuuuguaacuugcugcgaaaggcaguuaaggagaaaaggauguaguaauuguacuuauaccacuuaauauagguuguccagaaucagacauuuagauuucauuagaugaauuaaacuaagucaguucagugcaguagacagcacaacacuucauaauacuaucccuaguaauccuuuggguccagaauacuauuaauuuuuggaaucggaaaucuguaacaauagugguagauggguaugaagauuuuuuuuuuacuugucuggauuuaagguuuugcuagauuuauauauuuuauauguauggucuauggaauuuuuaaaaagaaauuuacauuugaauuuugcauuguauagaaaaauauguucuuacguauauuguccauguuugacuuauuccucagguaggaaauuaauuuauauuaauguauauuucuugaaauguucauggauauuuauuaaagcaaauagcauaaaagauguaaaucuuauccauuuaugugugugguauauuuaaugcguguuacguggauuuaggguuuuauguaaacuguguucuagauuacuuauuucaaacaaagaaccacacuuaaguauugcagauacaguuuuuguuuaacuauguuuuucugaccuuauugucugucuccuguugcugggcaggaaucagaaugcuggcugcugauuggcugaguuugugagcagcucuugaacagccauuuaaauucuugagcuuuuugagcaggcagauuguaggcuaagacauaacagcuucccuuuguuguuucauugcuaugaucucuugcuagaaagaaguggguggagggggaugaagcagagaagagaguaauguuuucauuuaaagaagaagcucguugggcuuuccuuaaaaauauuuuaaaaauaauuuaccaaaaauuugaaaaaaaaauuuccaagccagagagacuuauuugcagguaacauacccuucucugguuauuuaaauauaaauuucuauagaaaaagguuuuauuagugauauuauuuucccagaguucuugaauauacagagacuuaaaaaacauuauuuugacucucauccucaugaaaaaaauacuuucaggagaaacuaguucaucauguuuugcaguuacuuuuagacauggcagacaucuucugccguaaaauaccaaugcuuuuuucugugaaaaugaauuacagucaugugaaagcuuucugauuugaguugccaccuaaaauacuaacauuuauuuuauagaauaguuuuaugaauggcaucuuaguucuaggcgacaguacuaaaaugauccuuggaaguguuuugcacugguauuacagccauggaaacuuguuugcagguaacacacccuucucuaauguguaucuuucucaaauaugcuucgcuaaugcaaaauacauuucuaaaagcagacugcugauugguuuguacagauauggcugaacuaguuugaacuaauuguucguguuacuuccuuauugcuuugucuguuuuuuauuauauuuagaacccauaagaucugguaaauggcuguagugugcucccuuguggguauggaugguaguuauucuauaauucuuuuuagagugcuuuauuauuacugaaguuaaugacaauuuuauugauaaaaucaacuuuucuugaauuauauauuuuuauuaaauauuauuuggugguggcaauuuaauauuaacugugagguuuacauguuggauuuucuaauuuauauaaaaaauaccaaagaggaauuugucuuagacucuuuaguuuauuccuaaaaacauuauccugaauauuuaguuuauuccuaaaaacguuauccugaauauauagauggugaugguuauaccauuuauugaguucuuacuacauuccaagugcuuaauguauagaaucucauuuaguucucauggcaaccuuugugacagguguugguauuagucccuuuuuaagguaaccaaaacuaagaaauugauguuagguaauuugcccagucucacacaguagguuuccugggagaguuggaauucaaaucugugaaucugucuacagucuacagaguucauguucuuaauuggguuauuaaaagugaugaauuuuuuuaaaggaaugcuuacuuuuaauguaagaguucauguucuuaauuggguuauuaaaaguuaugaauuuuuuaaaaggaauacuuuuaaugcaauugguaauaacuaccagcuguccaucuaauaucugagaaaugcggauauuaugaggcuaaaguucaaaagaauggccuuucaguauuuugaaauacuuaaaggguaacuauacuacuuauauuauaaacuuaauuauuuuguaguuuuggaauuaguaaggaaaagugacagcaaaauacaaugcauuguaucuguaucuuuugcagaaaauuuugcaguuagcaaaacuuuguaaugaugggaagggaaaaaccuugaaggugugaaauuuuagucuguaauuaaaaacccuuaacauaauguuuuguauuauauuauacaaauuuuguauaauuuuguauuaagguuuuguauuauuauauauacauuuuguauuaagguuucuguuuaaaugaagaguaauuuuucuaaauaguugauuuaguuauauaauuuaaauaaaauggcuagaauaagaaauauguucuaaguaauuggcuuaaagugagagaaugaauacagaauguaucacagucuagaaauucucugacaaagugcuagaaucucaagcugaauuggcuuccagcaaguaggcuaggcuuauuauuuuaugcgcuucagccaaagaccagcaggaacaccuuuguaauugaaaaaguuagguuuacuauuugcugcagggaggaaauaauguucacuauggggaaacuguaaggcacaucaaucaguaagaggauguuagaaaaaaccuaguauaggauuugaguauaguauagguuggguuauuuuggggagagauuaaggaaguagauccuuaucguggauugggugacaucagaaagugggggcacuucuauucuuggguaucucaauaaauuuuaucuauauagggaggacagacuauuacaagauaaagcuguaauugauaaagaaguuggccuggugugguggcucacaccuguaaucccagcacuuugggaggccgaggcagguggaucacgaggucagaagaucaagaccauccuggcuaacacgguaaaaccucaucucuacuaaaaauacaaaaaauuagccgggcgugguggcgggcgccuguggucccagcuacucggaaggcugagguaggagaauggcaugcacccaggagguggagcuugcggugagccgagaucacgccacugcacuccagccugggcgacagagcgagacuccgucucaaaaagaaaaaaaaaauaaagaaauagccaucacucauuuagugaggggggauguuuggaauuuuguggguugcacagugaccuugucugacuugaauguucucugaguugguuuuauguccaaccagagaacagcauggcuuaacuguaagcaucagauccauuaacaacauugagcccuaacugugaguaucaguuaaguuuccaggcaucaggggcugcuuuucuuucuuucucaggccaaagcaaauguauucuaccauaucauuccuacuggugaugguaaugguaagugacuauccaaugugaaaacaguauuccugccuccuguacaucuuaguccuuaaagcaauuuuguuuuauucuacuauugauugaugacauuguuuuucuucagaaccacauccuugugcucuuuuguuugccuuuauugcacuggccagauguuaacaaggaaaugguuacaggaaacauccuuguuuucuucugauccuauuucaauaucagacaugauaucucuaguuuucuugguagauaaccuuuaucagauuugaguaaguuuccuuguauucuuaguuucuggcaaguuguaauuaugcaucagucuugaauuuugucaaaugaauauucuguauuuguugagguaauccuuuguugauuuugucccucuguucuguuuauguggugaauuaaauagcuugauuuguuuugugguuuucuuuuuugcuuaacagaaguuuaucgucucagaguucuggaggcaacacauuugaaaucacgguguugucauugccauucucccucugagggugcugagggaaggaucuguuccaggccucucuccuagcuucugguaguugcuuggcuugugguaccauaacuucaauugucacauggcauucucccagugugcaugucugucuguguccagauuuuccccuuuuuauaaggacaccaauuguauuggauuagggcucacuuuaguacccuuauauuaccuugauuaccacuguaaaggcccuauccgaauaaggucacauucugagguacuggggcuuaagacuaauaucuuucuggggauguggggugugggaugcugcacaauucagucaguaacauccugguaccagacauucaguuuaggcaaaacucguaauuguacacucugcugggcaugaaauaaagucagaaugcaucauggcuuguucauggucaacacugcuugauuuuugaaugugaaaucagccuuguauuuuucuaagcgagcuucacuuggucagaauucauuaccuuuuuaagaaaccuacuucuaaauaagucauagaugaaagaagaaaucaugauggaaauuagaaaauauuuuaacagaauaauguaaaugacacauuaaaaugugagaugcaacuaaagcagcucuuagagggaaauuuauagcuuuauaugcacacauuacaaaagaagaaagauugaaaauaacacuuaagcuugaaucucaaggaaaaggaugacauguuaagcucuuuccaagaaaaaguaagugaaaagagauaauaaauauuagaguaaauaauuaaaacaagaaagcagauauaaaaccaagaaauaucagccaaguaaagguucauacuuuaauaagugaauagaauugauaaaacuguagcacaacuuaccaaaaaaagagaauacacacacacacacacacacacacacacacacacacacacacacaaccuuuguauuuauuuugaaauuuuuuuguaguggcauuacugagauaaaaccacauaucuacuauucacccacuuaaaguacaauucaguuauuuuuaguauauucacagagcuguauaaucaucaccauaaucaauguuagaacauuuucauaacccuguaaagaaauccuguacccuuuagcagcuacuccucauuuucuccagaaucuuccaacccuagguagucacugauuuacuuucugucucuagauuugccuacucuggacauuucauauaaauugaaucauucaguauguggccuuuugugacuggcuucucucacucagcauauuuuuaagguuuaugcauguaguagcauguucaguacuucauuccccuuugugguugaaugauauucuguuguagggguauggcacauuuuauuuauccauucaucaguuauggaacauuuagguuguuuccaguuuugggccauuaugaguagugccucuauagagcauuuguguacaaguuuuuguguggacauauguuuucauuucucuugggaaaugaauggaauggaaucacugggucauaugacaacucuguacuucacauauuguggaacugccuguuuuccaaagcagcugcaccuauuugcaaucccacuaucauuguaugaaaguuccaguuuuuucacauccuugccaacacucauuauucucguugauuguagccguccugucgugugugcaguguuauuucauugugguuuugacuugcguuucccugaugucucaugauguuuauugcuuauggacuuuuggcuuaggggucucuuucuggaaaugucuguucaaguccuuugaccauuuuuaaauugggugauuuauuauugaauuauagcaguucuuagauauucuagauauaaaagucuguauucuauauaaauauauauucuguauucuagauaugaaauucuagauucgagauaaaagucuuaucaggcauaugauuugcaaauauuuucucccauuguugugaauuuucuuucuugaugguaaucuuuuguuaauauguuuauaguucugccaaucuaaguaugcuugguugcaaauguaaucuuuccuuacauguuucuuaauucuuccuccuuuuuccuuuaucucuauaccuguuauuucccuacuguuguucuuacacuuuuauuuuucuuucucauuuucuucagguacuuuuuuuuuuuuuuuuuuuuuuuuacuuuaucuaccuuuuuuuugcuuaaacaucuccauacucugugaauuccauauuggaaaaaaaaacuugucccuuuucccccuaauacuuucuaguugauuuucuaguagacuauggccauuuuugauuuuguauuacacagaugcaguaaauaugauaauuaguauacaacaagcaguagguuuucuaugucuuaaacauuacaugaaaugugcugcuugcaucucuucuaagaucaauuuguauuaagucuacaauuagguggcuucuguuucaguuauuaaacucucuuucucuuuuuucuuaaagauucagaauggacaguuuagaagaaccucagaaaaaagucuuuaaggcucgaaaaacgaugagagugagugaucgucagcaacuugaagcaguguacaaggucaaagaagaacuguugaaaacugaugucaagcuguuaaauggcaaccaugaaaauggagauuuggacccaaccucaccuuuggaaaacauggauuacauuaaagacaaggaagaggugaauggcauugaagagauuuguuuugauccugaaggaaguaaagcagaauggaaggaaacacccuguauccuaaguguuaauguaaaaaacaagcaggaugaugauuuaaauugugaaccuuugucuccccauaauauaacuccagaaccagucucuaaacugccugcugaaccaguuucuggugauccagccccuggugaucuggaugccggagauccagccuccggaguacuggccucuggugauuccaccucuggugaucccaccucuagcgagcccuccucuagugaugcugccucuggugaugcaaccucuggugaugccccuucuggugauguguccccuggugaugccaccucuggugaugccacugcugaugaucucuccucuggugaucccaccucuagugaucccaucccaggugaaccggucccuguugaacccauuucuggugauugugccgcugaugauauagccucuagugaaauaacuucuguugaucuggcuucuggagcaccagcuuccacugauccagccucugaugaucuggccucuggugaucuauccucuagugaacuggccucugaugaucuggccacuggugaacuggccucugaugagcugacuucugaaucaaccuuugaucguaccuuugaaccaaagucuguaccaguuugugaaccaguuccugaaauugacaauauagaaccaaguagcaauaaagaugaugauuuucuugaaaaaaauggagcugaugaaaaauuagagcaaauucagaguaaagacucauuggaugagaaaaauaaagcugauaauaauauugaugcuaaugaagaaacucuagaaacagaugauacaacuauuuguucagaucgaccuccugaaaaugaaaagaagguagaggaagauauuaucacagagcuugcucuuggagaagaugcuauaucuagcaguauggaaauugaccaaggugaaaagaaugaagaugaaacuucugcagaucuuguagaaacgauuaaugaaaauguuauugaagauaacaaaagugagaauaucuuagaaaauacagacucuauggagacagaugaaaucauuccuauuuuggaaaagcuugcaccuucugaggaugaacuuacuugcuuuucuaaaacaucucuccuuccaaucgaugagacaaauccagauuuggaagagaaaauggaaaguucuuuugguucaccaucuaaacaagaaaguagugagaguuugccaaaagaagccuuucugguccucucugaugaagaggauauuucgggugaaaaagaugagucugaaguuauaucgcaaaaugaaacgugcucuccagguuagcauauaacuuaaauguuaaagauuuuuuauugacuuugaugaacuguuuaauaaaacauuaucauaauguuuuaaauuuauuuuagcugcagagaaaguugagaauggugaugacucuauagaaagaugucuuaacuucauagaauucagaauuaguguguguacucugugaguagcauuguacuaaauacuaagaagggagauaaaauaaguagaaaauaugcccuuauagucuggaaauagagaugaaguagagcaccauaacacugagauaacaguuuaaguuaguacauaauugacuagaguuguagcaguucuuucuugcuaucacuuagcgaacaaauaacuuagaacuaaaagccuaauaguuuaaucuauuugcuucaaguguaacaaauuauauuuucaauuaauauucccaaugaaauccuguucuuuaauauucuuuguccaggaaugacagcaccauuguuguaagccagaaaccuuaaagcuugauuauccauuugauaaagacuuuacccauuugcucccucagcccuuuugauucuacccaaccuauucucuuccucauuuucugaaugagcucccuguaacccaauucucuuauuugauauuguccgucuaugucuuagaucucuguuacuuuuagguugauuucaaacuccuuauguaaaagguacauuaacuuuaugauuuguucaguaccuaucucucccaucucuuuuauuuuauuuauuauuccuagagaaaaagaaugagaaaaauucuaccuucuuuuauggucaaacugaaaaacauuauuccucuaugaaacuuucuaagccuguggaagacugagaaaagcaugaauaccuuucuuuucccauuauaucacauucuuuuagauuuagacaucucugagagaagugaccuugcuagcauaaaacaccaucuaauuucuucaaagaaaaaaaaauggaggcaggucuaagagacagagacaacuuuuuuccccaauauaucauaccagcuuuuggagguagagauuuuuuucuuauuaaaaaauggcuuuuuuuuuuuuuuuggccagguaagguggcucacaccuauaauccuaggacuuugggaggcugaggcaggcagauugcuugagcucaggaguucgagaccagccugggcaacauggugagaccccgucucuacaaaaguacaaaaauuagccaggcgugguggcacuugucuguaguccaggguacuugagggccugagguagggggaucacuugaaccuggguggucgaggcugcagugagccgagaucgcgccacuacuccagccugggugacaaaguaagacccugccucaaaaaaaaaaaaaaaaaaaaaaaaaaaggauggcuuuuuauuuucaaagagcauucaacuaaaccuauauaaagagacaggccaggcccuucuugguucuagagauuugaagauaguauuugcccucaggauacacacaagaauuaaaucauaggccauuaaauacaagacugugaguacagugauaauguuaaauuggcauucugggagugcagauuaagguaacuuuauuagagcaccagauguauuagggaugucuugccccuuuuaauaucuguauaacagagguuuuuuuuguuugcuuguuuuuguuuugugagacagagucuugcucuguugcccaggcuggaguacaguggcacaaucauagcucacugcagcuuccacuuuacuggcuuaggugauccucccaccuaagcccccagaguaccugggaauacagacaugugccaccacacuuggcaaaauuuuaauuuuuuuguagagacagggucuugcuauauuggcucugcuguaacauaggguuuuaaugagucuaauucuuuuuuuuuuuuuccgagauggagucucgcucuguugccccggcuggagugcaguggcacgaucuuggcucacugcaaccuccgccucccggguucaagugauucuccuccccacuccgccuccugcguagcugggauuauaggugcgcgacaccacgccuggcuaauuuuuguauuuuuaguagagucgggguuucaucauguuggucaggcuggucucaaacuccugaccucgugauccuccugccucagccucccaaagugcugggauuacaagcgugagccaccgcgucuggccaagucuaauuccuuuuaauggcagcuccauccuacuugcugaggccagaaacuuuggaaccauuuuuauuuuuucuuucacaccccauaauuaguccaucaggaaauucuguugguacuacuaucauaauagaucuagaguccaauucacaacuguuauuacuccugcugcgagucaccaucaucaggccaaaacggugccuggcacacaguaagugcccaguaaauauuuguaaagugaaugaauaaucaauaauguaagagaagcauaucauggaggaccuugguuauaaugcuaaagcuuuaugauggcgcuggaaugccaauaaagaacuucaagcagagaggagaaugaaauuuacauuuuggaaagguaauaggugacaguguugagaaugaauuucauccauuuccuauaagugucuauacagaguguggcacuaggccaaguccauaaaaaagccuuauaaguccuuuaaaaaaaaaaagucuguauaagaaaguuaaaaaagcaaauugcagcuuaugauuuaaugaguaccuuuaugucagaaucuugauauuggagggcaucccacacaaggcaguuaagugcugagagaugaauauuaagccauccauguugcauacuuugaaaauucaaaguugggaauauuuuugguuacuugccuuuaaucugaugguaugcuauuagcaggguaaauuuagugauagauuuaauuucuuggcucauaacuaaacuuuuauuuuguaucuuuuccccuuccucugaagguaauuuuguguauuuugaguuuaagaauaguuucuuaauugguucuuaaacuguacucuguucucuuuauauggcgacagaaucuguugcaugucauuuauguugcuguacuccuguugaaauguuacuuaaauaaaugccuuuauucuugacuaauuuuuaauauacucagaacacagaauuauuagcugaaguacuaaaguuggcuucaguacuggcucuuccuucuagcuacuaacaucuaugaguguaguaaaaggaaaauagcauaaccuucugucauuucaggcacuuguugagcaaauauguuuuaaauaaagcaauugugauguguaucagcagcaacaagaaauaaugaaagauaaagcaaauagaaaagcuauuuuaauuuuacaaaaguagaagaaagaacuaaaaaaguguugcauauauaccuuaauaggucuagagacauuacugaauugugacauaguauuauguuauaacuaauacucacuaauuauuaaaaugauaaucuguuuaaagaggauagcaaaauaaagauuuaucucucugggaaaguucaaacacuagaggagcuucaucgccauaccauauacuuuccucuaacuacuauuucaucucuuuccuuucuuuuagugccauucuucaaguuauauuaacaaagcuaggaccauuucuucuucuguuaggccuuccacuuaauuggauuuugauuucugccuugguagcugccgcccuccuaauuuuucucagugaaaugacauugaugaucauguuauuaaauccggggacaucuuuucuuugucuuaucuauucuuccauacuuggaugaccucuuaauaacaguucuucccucuugagacuccccuuagcuguuggguuacugcauucuccaucuucccuucuuuuuuggccuuucucauucuauuucuuguggaaaaauagggauaggccuccuccacgugcuuuuuuuucuuaaacauaagauuuuugaagagaaaaaucuguuuuagagugaacuagauuuuuuuugcauuaaacacugacauaguuuccuugcagauuuuauuucagauuaaaauaaaaaucugugguugauauuuuccuccccuuguucauuggaucuuuaagguaaauaaaauaaacauaaacugaugcuaaugaggauaauuacauuagacuagaauuugagacuuccuucuauuuuugcuguagguuaguauugauagaauuggcaugauuuagucaauuuacuguuaauuuguugucacuguuuauuguguucaguuaaaauucuuuaucaucucaauccauuuauauuuagcuguuacuuauguacuuggcuucucuuuguggagcuucuuaguucuauucacuagugugcaaguugcagauuuuucuuuucagaguugaggaagaccaaagaugaaguagauuuuggaaggagguguauaggaggaagaucauuuuucaaaugaguacuguuguccaaguuagauguguaagucuggauuucagaucagagacuugacuuguauuagaaaaauauaguagguagcauguagcuauuaggugacaagaugaaaucaccucagaguaaguauacauggagaaaagauccaagaauugugcuuuuggcauuucaguguuuaggguuggggagauaaggaagaaccaacaaaggagcugagaaagagcagccccugagguaggaagaaaauggagagauuuugguguuucagagauuuugguguuucagaagccaaguaaaaacacuguuuugaggagggaauaagguaaccguuuacuauaucaaaugcugcugugugugcucauaagauggaagagaaguauuuaacaaucuggagaucauuggugacuuuuaccaaggggcaguuuuggugaaugguggaguggaaaaccugauuuggguuucagagagaaugggaggggaagaauuggagauaauacaaugggacuuuccccgcuagguuuugcuuuuaaagagagcacaaaaauucacauaggagauauuauuugccauucuguauugguuaaauaaaacuaauacaaaaugucuggaaaagucacauuaccagucaugccuuauuuuucugauagaucuuguuagguugagaaucuuuauauguuuauuggccuuuuauaguuccuuaucugugaauugccuguucaucuccuuugcccauuuuucuaauggauauugucuuuaauuugucuguaggaauuucuuguuuuguuacaaauauuuucauggagccaguaaucuaaaucagugaaugggguagacuggccugugagcccuguuuuuguaaauaaaguuuuauuuacauaaacauagcuaugguaauuuguuuacaugucacauagcacuuauugcacuuauuuguuuacaugucacauagcacuuauugcugauuccugcaacaaggacagaauuaagagguugugucagacagaggucauguggcccacaagauugaaaauaucuauuuuuuggccgcuuacaaaaaagauuugccaaucucuuaucuaaggcaaugguuuuuguccuccauuuuuccuuagaauaaaguucuauaaaguauaauucugaaaugggaaacuaaguccccuaauguaaauucuauuuuguaauccuuuaaaaacacaguuuucuaccuuuacuuaauggaaccuuauuaaagauaguagucaucugauaguauuaaacauguaauuugucucagcuauuucucaaaguguuugggauuaccaaaauuaugagaucugguaucugcccuuaaugagcuuacugucuagucugcuugaaaggaaagaauauggaacuaugaaaacuugccaaauugugauaaggcuauagccuuauccucaagaaaaucaaaggaauuauaacagaaacuuaucuguaaguaaggacagauucuaaaaaaaacauucuuuuuuuuuuuuuugagauggcgucucgcucugucacccaggcuggagugcaguggugcgauaucggcucacugcaagcuccgccucccggguucaagcgacucuccugucucagccucccgaguagcugggacuacaggcauguaccacuacauacagcuaauuuuuuauauuuuuaguagagacaggguuucaccauguuagccaggauggucucgaucuccugaccuugugauccgcccgccucggccucccaaagugcugggauuauaggugugagccaccacacccggcaguaaaaaagacauuguuaaccuacuauuuggaugaguuucaggagucccaggaacuaccugaaauuaugucuaaaguugucuguguaccaagggccuuugauuauuacucuggguugaaggagacccauucuuaguuuuucuucaggcuuuguggacaaaauaaaauuaaagaaauauaaggcccuacccgucucuguagaauuuguuaauaccauuuuuuaaaucccaaguucuuuccguuacaaaaaacucuagcaacucuauuuuaauucugugaauucugaguguuuuaaguguuggggauccaguaauaucuucuaagcauaucuggaaacugggaguugggugauaggaggagguuuuugaauaaaaugaagaaaucucaagcugagcuugacauauggagaggaaacuaacaugcguauaaaagaggcaaaccauagcaggccaguuuauucugcuguguucuggaugcucuggcuuggagucacucuaauuggagccauggcuaauuuugugcuuugugcgaugugaggauuugcuaaauaaagacuauguaaaccuuucaucucaagcaucccaguuacucugucucucuggaaacucuggggacuaggaagcucaggaguuacuaacaaugaguauuaaaaucagaaagauauggaaaaauauagaaagaaaaauguauuuuaaugaguuugugaucuguuuacaagaaagcaaacaaauuuuuauuucacugaaacugagguugagagaugaggucuuaaaacacuuaaaaugagcaaaggguaguaaauggagaguuaauuuucaaauaauuuauuuuaaaguucaaaaauaguuuuaguaauucuguguacuguguuagcuuauuguuuaucuuacagugaaaaaaauacuucuagcgccuuaauagguauucaucaaugauccuuguccuugccuauuuucaccuaaaauaucuuuuaaauuuuuuuaaccuugacuuuugcuauuagggcuguugugauuaaaauccugaugauuggagaagaaaugucuuaucagaaucuuuauauagcauaauauacuuuaugauuguuuauuuaauauuaguugcagaacgugaugaaacauagcaugcuuuauugaagccacugagaagcaaguugcaaugacguaagggggaaaauagaagucaaacaucuuaaugaauuuuuuuuuguagcucccuuauuccucauuuaaugaguagguuaguugaagagacauugauugauugaccaaaagaacguuuugguaccucuuggauuuuauuuaauauaauuguauagacauuuuuagcaauaucuuuuggcagcacucuucaguuguuacauuuuauaugacucaugcaaauuaacccuucugggccagucgagguggcucacgccuguaaucccagcacuuugggaagcugaggugggaggaucaccugaggucaggaguuugagaccagucugcccaacauggugaaauccugucucuacuaaaaauaaaaaaaauuuaggcccagugcaguggcuuaugccuguaaucucagcacuuugggaggcugagggggguggaucacgaggucaagagaugaagaucauccuggccaacauggugaaacccugucucuacuaaaaauacaaaaauuagcugggccugguggcaggugccuguagucccagcuaccugggaggcugaggcaggagaauugcuugaaccugggaaguggagguugcagugagccgagauugcgcuacuguacacuagccuggcgacagagugagacucuaucucaaaaacaaacaaacaaauuagccggauguaguggcgggugccuguaaucccagcuacucaggaggcuaaggcaggagaaucacuugaacccgggaggcggagguugcagugagacgagaucgccccacugcacuccagccugggcgacaagagcgaaacucagucucaaaaaaaaaaaagaaaagaaaauuaacccuucugaauguuuuccucaucuauaugaugacaaaaaauacaguuuacagugugagauuauauuguggccaugugauaacuauauuaagcaccuagcucaguuguuggcacuguuaucaaaguagguauauauuuaaaguuuuuauuauauuugggauagccuuuccauuccuuauuuaugaacucucuauaccauaagcauuaaaguaacuuaaggauucaaccuguuuugaauuuuccaguaguuuggaauuuuuuugauaauugucacaggcacuauuuuaguuuuaauuauugaauguaaaggaaucaaaaugcucuacagcaguuguuuucacauuuuauuaauguuacuggugacagaaaauuauuaaguaauuuuuuuaaauuacuuaaaaucuauauuaagauuaaauccuguguugaguuuguucugaauugcagaacaguugaauguggacguggucauucauucgaucaguuccugcuccccuuuuccccuccccaaauuuuacauuuugggacucugauuucauaaaagguugguuuuguaacuggauagugacuaaaaauguaaauuagugagcuguuaugaauucuaguagaaguaagauuuucuuuucuauauuuguuaacagcagaaguagaaaguaaugaaaaggacaacaaaccugaggaagaagagcaaguaauacaugaagaugaugaaagaccuucugagaaaaguaugcauguauaaacaaacuugaacuggauugaaaaauaauaauucacuguuucuauauuuacaaccguguaauauucuuuuuugcccaugaaauaauuguaaaauuuugcaauuucacaacuauaccauuuuguugauggcuaacugaaggauuucugaaaguauguuucauacacuucaauauuuuauuuuguuuauuuauacuuuuuauuguuccacagaaagauuuagcuuaaaauuuacuaaguuacugaguguuuugagauaaauuguuuuagauuuauguuuagagaaugaaacuacaagaauuuuguaugggcuaacguaagugaauggaaggauguauuuuaguucacuuaagguucuucaucuucauggggccagauguaguggcucaccccuguaaugccagcacuuugggaggccaagauggaaggauugcuugaggccaguaaugcaagaccagccugggugacauagcaagaaccugucucuacagaaaaaauauuugaauuagccaggcaugguggcacacaccuguagucccagcuacuuuggaggcugcagugguaguauugcuugaguccaagaauuugagguuccagugagcaaugauugagccacuguacuccagccugggugacagagugacaccuugagagagagagagagaaggagggagggagggagacaggaaggaaggaagagggaaggaaggaaggaaggaaaagggaaggaaagauaagguucuuuagcuuuaugggaagggaaggaaaugauggacugaguguccuuagguuuauggaaagaucauuggacuagaagucaggaaagcuggguucaguaacuuuccugucaugcugcuauccauauaugaccauggguaaguuaagauuguaagagaaauuguagaauagaguggauuuacaaguaggcauauagauacagacacauacagagggauaggcauggucacauaagagcauuugcguuuaaaaagugugaagauauuaguguuuuaauuuuuuuagauauugaagaagccagauacaaauuugcuuaugaucucaugaauauuaacagcacgugaaacagauuuucuaagugaagucuucuagucuauauucuuuauaaauguacuuuuaaugacauuaauuuuauuuuuauuugaaauucauuaggauauguuaagaauaacuauuacugugcuaguuuuguaaggcugaugauuaagaauuuuuuccuauacuuacggaggaaaaagaauaaauaauuaaagcugugcauaguuaaaaaucugacaugagaaugaauacuauauuuugucagaggauucaugugcacugugacauuuaguuacaggaaugaauaugagaugauuucaucuaccuucuucaugacacaauugugaggcaguucuuaguaugaagauuucaaggaaauucuguguucacagugugcauugcuugaccauuagggaguucuuauuuaguauauugaaagucauuugaaguuuaaagcuaaaagcuauauaccuucuaagaucuccaaaacaguuuacaaaauaguugguugagaaggcuauuaugauagaaauaauauuuugcuaaggauggauaauaugcauuaagagcuauaagaaaaacaccugagugugaucauugugguuuuccuucucagaugaauuuucuagacgaaaacguucuaaaucagaagacauggacaauguacagucuaaacgucgucgauauauggaagaagaauaugaggcagaauuucaaguaaagauuacagccaaaggagacauuaaccagaaacuucaaaagguauugugucaauuauaaguuauaaaccauauugaauaaauagcaccacuaucuucuucuagguuucugacauuauucuguauuuuauugacauaaugugguuuaucauagaaagaaagaacuugaagaaagugguugagcuuuuaaagucuauuacuggccagaugugguggaucaccccuguaaucccaauccuuugggaggcugagguggauggaucaccugaagucaggaguucaagaccagccugaccaacauggugaaacucugacucuacuaaaaauacaaaaauuagcuggauguuguggugggugccuguaaucccagcuaccugggaggcugaggcaggagaaucacuugaacccgggagguggagguggcagugagccgagaucaugccacuucacuccagccugggugacagagcaagacuccaucucaaaaaaauaauaaauaaauaaauaaauaagucuauuacuauccuugauaauuuaauuuuaaaauucuuucugacuucuuuuuggcuacaucuuuuuuuuuuuuuaaaaaagguuaugauuaucaaaacaagggagagaagguaacauuuuuauuuauuugcuuugguaacaaaacugaauguuguuuuucagcuuuucuuuuuccuucucacauugaacuuuaucuuauugugaaaaggaaauguuagaguuuuaaauauuagcauuuuaaucuuuauaaagcugguuucaugguuauaagucuacauucuaaacucuuuauuguguacuugaggguuaguauaaaagugguagagacaggguguuaaaaggacuagagaaaggaguauuuagaauacggaguuugaaauuccccuuacaucuguuugacuagagauagaaauaaugaaaauauucaguauuuuauguuuuucaacauguguucacaaauguuuuuacaaagcuuuucuuagagaggaauauuaaacuucgaugauaacuaguuuuucaaggucuuauauauuuaaggaugacauuuuacaaucaauguuuuaggacaaaauucuuucauuaaaauauagcauacauauuugcacuuuguagaaaaaagaauagugaggcuguagaaacucucaguguuguuuuuuuccccuaguuucuuuuuauuugacauauggagauaauaaugcuuauucagucuuucuuacagagcuguuagaauuaugaagguagcuaugugaaagaauuuugaaaacugagguuuccugagaguuuacuucuuuagaacaguguuacucaaguaugguucauggguaugugccaaugucuuuguuguggacccauaaugagaauauggaacuuuuuaaaaguuuacucucuggaaauuuucuauuuuuaguauguauuacccucuugaaguagauuuuauauauauaaaaguagaggauuuuagcagauaguauuguguuacagauucuagcauguuuuauucauuaaguuaguuugucauuacugucuucuugguacuuaagaauauuuacuggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagauccugccacugcacuccagccugggcgacagagcgagacucugucucaaaaaaaaagaauauuuacuguuuauugcuugcuggaaugccuucuuggcauaaugaaggaauauuuguuucuuuagguuauacagugguugcuggaagaaaaauugugugcgcugcagugugcuguauuugauaagacuuuggcagaauugaaaacacgaguggaaaagauugaauguaacaagaggcauaaaacaguucucacugaacuacagguuuguacauugacuugaguuguauacuccaugugucauuguuuuuauaacuuauuuucugagauauauauuugagauuaacuauaaaauacauuuaaauucuaaauguaagaaggaaaaggaguuuguuuaguuugccagggcugcuguaaagaaagugcaauaaacugagugguuuaaacaguagaaauauucugucucacaguucuggaggcuagaaguugaagaucaaggugucagcaguguagauucuuuuugagggcugugcugugaggaagaaucuguucuaugccuuuacuguagcuucuguugguuugcggacaguucuuuggcauuguagaaacaucacccugaucucuggcuuuaucuuuacaugguguuguccuuguaugugugucuguaaauuuccccuuuuuacaaggacaccagucauuggaguaggggcccacuauacuccaacaugacuucaucuuaacuaauuaccucugcaaugaccuucuuuacaaauaaggucacagucugaaauacuggaaguuuagacuucaauaugugaacuuuuaggggacacaguucaaaccauaacggagacucagaaauuccuggaucuaacuuagugcuucauauuuuuuuuuccagucacuaaaggaaggcugucauuuagcaugcuauaauaaguacuaaauaauauuuguuagggauucuuuuuauguuaaucuaccuccuuucguggaccuuauguuuuaaagauguuaguuuaauaacacguauuuauuaauuucuacuugucauuuuuuauuaaguacaacuauaucuuaacauacaauaccagagcuucuggucagcugaaaugagcacacaguagugugcuguaguaaucuacuuuauuccaaagcuaagaagcugguauuugaaucaguacauucauucugucauaaguaaguguaugguuccuauuggguuauuuuauauaugagcauaucccaaagaugcugagugguaaaccauguauagggccuuauuuugcaaaugaaggaaaaguggcccauggaagucaaaucacuuuuuccguuacgaauaaaauuuuagcuaaauaggauuagaauuuaagugugucucccagacugaccuaucuaauuauuaaacuucauuuuacuaguacuguucagacuuuugaauuaaauuugaaaaugccugaagauuugaaagaauaauuuuauucauuguuucucaucacacccacgggugcaacuaugaaauuguguuuuuaaaaccuaaguuuuuggcugggcauaguggcucacgccugugagcucagcacuuuaggaggcugaggaaggugaaucucuugagucuagcaguuagagaccagccuggccaauauggugaaacccugucucuacuaaaaauacaaaaaaauuagccgagugugguagugcaugccuguagucccagcuacuuuggagguugaggcaugagaauugcuugaaccugggagguggagguugcagugagcugagaucgggcuacugcauuccagccugggcaacagagugagacucugucuccaaaauaaauccauccauccauccauccauccauccauccauccauccauccauccuaaaacaguuuucgacaccuaucaucucacacauaaggugcaauccagauuucuuaacauuuaaauuuguacuuaaauguugcuuguagucucagaauuugaaucuuucuaacaccaagccaaucaucuucucugcaaauguuccuguuacugacaauuucugaauucuuggaaaacucuugaaggaaaaucuucccguuguuccucuuauuggcagcucuugaauucuuggaaaccgaucccucucaaucauuucauauacacagugaguugccaaguuacaacuugauuauuuccuagaaaaaauaaaucucaauucuuuucacuuuucauuaggccaucauuacccaauuccuugauuauaguaacaccuuuuauaugagcacucugguacuaguuuuuaaguucuuucugguccuuccaaagcauuguacuaauuuuucuaaaauacugauuacuucagucucuuuauaguccaaguuccucaauuguguaccgguaaaaccaguauucauuuuuaaaauuuuuaaauuuuaaucucuuaauuuucaauccacuuuuucuaauauccaccaguugcuucacuguccuacaggguacuauuaauguuuauuguauuuugauaccaggcuuuugacuucguauuguuuccccuguucacucacccaugaucaugugcccaauuuaauuccaucucuuugugucuuguuccaguauuuuguuuuuuuauggaaauaaaauucagauaccaaacuguuuuaaaguguacaauucauuguuauuuaguacauucacaauuuuauacaaccacaaucucuaucuaguuucaaaacauuuuugucaacucaaaaagaaacguuuugcccauuaagcauuugcucuucuuuuccucuuacacuagcccuuggcaaccacuaaucugcugucucuaucgauuuaccuguuuugcauauuucacaugccucuuucacuuagcguguuuuccagcuuaaucuguguuuguagcauguaucaguacuucauuccuucuuagggcuaaauaauauuccauuauauggcgguauaugccacauuuugcuuauacguucauccauugaauggcauuuggguuguuccuacuuucagcuauugugaaugaugcugcuuugaacuuguauacaaguguuuguuugaauacuuguuuucaaaucuuuuaggaauauaccuagguguggaauugugggccauaugguaauucuuuguuuaacuuacugaagaaucacccagcuguuguccacaguggcuauaccauuuucuguucccaccagcaauguaugaggguuccauuucuccacauccucaccaauacuuguuauuuuuacuuucuuuuuuuauuauuauagcaucugaaugguaugaagugguaucucauuaggguuuugauuugcauuucccuaaugauaaaugauguugaucaacuuuucauguacuuguugaucaaucauaugugcuuguuuauagaaaugucuauuaaaguccuuugcccauuuuuaauuuggauuuuuugcuuuuuuguuguugaguuguaagaauuauuuauauauucuggauaccaaagucuuuuuuuuuuuuuuuuuuuugagacggagucuccugccaauucccaggcuggagugcaauggugugaucuuggcucacugcaagcucugccucccggguucacgccauucuccugccucagccucccgagcagcugggacuacaggcgucugccaccacgcccggccaauuuuuuguauuuuuaguagagaugggguuucaccauguuagccaggauggucuccauuuccugaccucaugaucugcccaccucggccucccaaagugcugggauuacaggcgugagccaccgcgcccugcccaggauaccaaacucaccgcacccggcccaggauaccaaacucuuauuagauacaugauugcaaauauuuucucccguucuguaauuugucuacaacuucuugauaaugccuuuugaugcacaaaacuuuuaaauuuugaugaagucuuacagaugguauauaguuuggucaugauuuauuaucaguuccaccaaucucuaccuuuuaaucaaggaguuuauuuacauuuaaaguaguuacuaauaaggaaaaacuucugcaauuuuacuuuucuucuauaucugauaccuuuuuuguuucuacuuucuccauuacugccuuguuuugcaauugauuuuuuccugguauaucauuuugauuccuucuuguuucucuuccuauauauauuuuuaguuuuuuccuuagugguuacccuggggauuacacuuaacaucuuaacuuuauaacaguuagguuucaauuaauaucuacuuauuuucaguagcauacaaaaucaaauaucauuaugauugugcucuagagagggaaauauguuuuuuugguguagauacuacccauguggcaauuguuggcaaccguucuacccacauuuugcugccuguuuugcaauguguacauaguucagccugauucugcccuucacucuggguauaguaacacuuagccaaucgaguccuguuacaacaaauauaaagcauagugcaagaucaugagaggaguuuguugagaucaguugugcucauuuuggcuaaauuuauguggugcaguugguuuggaaauaaaacuuugaauucguucuuacugcguauuucagaacaauuuccuguuagcuaauaugauauuuugacuuuuggcuuaauauguuuuaguauaauuauccagggacaauuuguucaguugaauacaucugagacaaauuguucuauuggucugauaaaucuuugaccuagaaauaaaauaaauacaaauaaacugcacaaggauuagaaaaggagacaagauccagaagggauucuuuaagaacguuuuuauguuaacaaccuuguaccaaugaaaucuguuguauacaaaaaggaagcaggaggccaggugugauggcucaugcuuguaauccgagcacuuugggaggcugagacagguggaucacuugaggucaggaguucgagaccagccuggccaacauagugaaaccucgucucuacuaaaaauacaaaaauuagcugggcuugauggcacaucccuguaaucccagcuacuagugaggcugaggcaggagaaucgcuugaacccaggaggcggagguugcaguuagccaagauugugcccuugcauuccagccugggcaacagagcaagacucugucucaaaaaaggaagcaggaaagcuagguuuugaggaacuguaucaaaacuauagucaaagaucuauuucugaagaagucauggaacccagaaagcuuugccagauaauucugacaaaucauugaggaacagguaauucuugucugauguaaacuguuccaggguauggagaaagaugagacuuccauuagaugaaguaagcccaucugugaaaccucuagcacaagaagagaaaaaaacauaguuuaguuuuauuccccagcauagauuucucuuaagaaugcaaacuugguucaguauuaacaauuauacguuacucugcuaauguaggaaaggugaaaaauagugugaucaucucaguacaugccaaaucaggauuuguuaaaauucacuggucauucauggaaaaaacaggagguaaauaccuugaaucucuuaaaggguuuucagaaaccuguuguaaauaucauauuuaauaauggauuauuggaaauauuucuaccaaaguugagaaugagaaaaugccuauuaauagauguugcuauuuagagcuuuggugucagucuugggcaauacagugagacaggaaaaagaaaugaguaacaauugguaagugggaacccaauagaauuaaguuggcaaacuguugaaugaagaaggaaauauagcaacuaccucauauaaggacaauauauucuaauaguuuuccuuauaucaacaauaaccaauuagaaaauauaaugagaaaaagauuucacauaugguaguuauuuaaaaaugaguaagcacuuaagaauaaaccaaaaaauaaaauuuuaagaccauuaugaagaaaaaggacagaaccagaaaacaggagucaacagugauuaguacuaugcucuuaaauaggaagacuugauuccucucaaaucacaguauaguucaaauucauaauacucggaauuucaacuagauuucuuacagaaauggaaaagcugucaacacacucuggaauauaacauuccguugguuaugacuuagaaaaugccauuuuaaguagauuuaacuaaaaaugucuauuuuacuuuuuccuuucagccucggcuccuguucccuaucaaugaaguaaauuuaugacagccuaauacagagacaguuuuaaauaauagaaacugugggucuguuuauuuacuugcuuuuaugagcaguaauauuuguuauaggccaaccuugauguuaaggaaaccucuuuuuuuuuguagacagaguuauuuccuaagagguuuccuggguacauaugcagugaaauucuugguuugucuaguuucccaaauaaaacccaauguaauagaauaucacuuuucuggaguuacaaaaaugacuuguuuauucauuuuuuuaaaaugucucagaauaucuaccaaaauagccauucuuagacacaguauggcagauauuuugaauuauaauuaaaaaagaauuguacagcuuccuauguaaaaacaaaaaggcugcucuuugauuucucuguuuuauaauauuaaauaucagaaaacuauaaaucaguguccacauuuugaguuuguuuuucugcuacuggauucauuuuuaaaaugauaauucuuuuaaaaaagaguuugaauaccacaaauguaugugaugugaaaaugagguccuuaguucauuuucuuucccacuuucugccaaucauagcuuccagcggugacuacuuuuaaccuuggaauguauagaucuuuuucuauacaugugacauauacaagaugauuuugggggggcuuaaguaaaaauagaauaauaauauuaugcauacuaugcaauuuuuaguguaaccaccuaguuuuuuuuuuuuuuuuuuugagacagagucuugcucugucauccaggcuggagugcaguggugcgaucucggcucacugcagccucugccuccugauucaagcaauucuccugccucagccucccgaagagcugggacuacaggcgcgcgccaccacgccuggcuaauuuuuguauuuuuaguagagaugggguuucaccauguugaccaggcuggucuugaacuccagaccuugugauccaccugucucagccucccaaaguauugggauuacaggugugagccacugcgccuggcccaccuauaugauuugacuaaagaaaaaaugacauucucgcaugagcugggguacagaaaauaccuucccuuucccauauaccuuucuuuucuuuuucuuucuuucuuuuuuuuuugagagagagucucgcuuugucacccauccgcccaccuuggccuuccagaguguugggauuacaggcaugagccacugcaccuggcuuucccauuuaccuuuuuagaaaguuauuugagauauuuuagucaucagaaagguaaauccauguuaaggauaugaaauuaugcuuuaugaucuugagccuuaauaacaugcauaaauaacuaaguccuuagggaaaaucuuuaccuuugagagucauagguaacugauugccuaggccauaauauuggacuuaagcacauuuuaagauuuggguucuccucuagaagugacugcuuucugcaagaaacuuuaaaaguaaaucauaacauuuucucauuuuuaugaaauguaugcccuuauuggauaaaauaaauucucuggcagagcucuuccuuagguagggccucaugaauacacucagaaguuuaauuuucuugaaaauauguuuaauuuaaaauggcuucagcagcaacagcaacagaaacaguugaauauuacgucuaugcuuaguaaaagacugaaaggagauacuaccaaauauucauguggugaaaugauaauuuuuauuuuucuuuuuguucugcuuuuuuuucccucagauuuccuuucaauauguauuugggcaaaauaugugaucagggaguuuguauaaguacaacaaaugauuaauaaucucacugaccauguugacacaaacaagguaauggguuuuuuguuuguuuuuuguuuuuuuuuugagacagagucuaacucuguugcccaggcuggagugcaguggcgcgaucuuggcucacugcaaccucugccucccggguucaagcgauacuccugcuucagccuccugaguaacugggauuacaggcacgugccaccacgccuggcuaauuuuuguauuuuuaguagagaugggguuucaccauuuuggccaggcuggucucgaacucuuggccuuaggugauccaccugccucggccuccuaaagugcuggaauuacaggugugagccaccaugccuagccaagguaauguuuuuaucagauuguuaaagacuaacagaauauguaauuuaauuugugaaaaaguaauauaugagcauucauuuacacuucuguugaaagugucacaguaaagccuauacauccauccauauguaguauuggcaagggaucuuuuaugacuuacagauauuuccacuuuauaauucucaaugagaaaaucaagugugauuacaacuguguuaaaaaaauaacaaaacacaggcuuacauauucaggaauguacugguaagugagcaacacucaaaaguucgaggaagaaauaggcuaaccuaauuaagaguguuuacaucugaguacugaauuuaggggucacuuaguuuuagucauaacuguauuuuccaaguauauaguuuauaaucaacuuaauuuauuuucuuuacucagcuaucuucugaggauccuguuuucuauagguuucuuuuuauauauucaugguuuuuuuuuuuaaugcuguaauacuauuugauuuccauucauuuuugucuuuuuuuuuuuuuucaggccaagauagccagguuaaccaaacgcuuugaagcagccaaagaagaucuuaagaaaagacaugaaguaaaauuuuucuauucuugcauaauuaauauuuagcacuaagugguaaucuuaggaaaugcugaauuaggaggaaacuguauuacaaaucugaaauuugcuuucauacuguguacuccucuauguaauuucuggaucuucagcccuagaacuaaugaaccccuuucaaauccucauuuacuauucucauauaucaacauuuauauucuauuuuagguuaugcaauucuuuuuuuuuuuuuuuuuuuugagauggagucucucugucgcccaggcuggagugcaguggcaccaucuugguucacugcaaccucugccucauggguucaagugauucuccugccucagccucccaaguagcugggauuacaggugcccaccaccaugccugacugauuuuuguauuucuaguagagacgggguuucaccauguuggccaggcuggucucgaacucccaacaucaggaguccaucuaccuuggccucccaaagugcuggaauuacagacaugagccauugugacuggccccuuagguuaugcaauucuugaagcuguauuuucuguccaucuuuaaaauuaggcuucagggauuugucuuaccuuguuucuuucauuuugcauucuugucagauucccaguauggucucuuacuauuuuccccaaaguauuuuaguauucuacugccuguaguauuccuguucuccccuuccuuucuuccccauguagucaguccucuuuuaugcuuuaauuguaauauacagagauuagauuaagucacuuuauugacuuaaacaguuugaauauuuuuuaaaguauacaauuaaguccaaacauagcauaaauugacuuccauagucuggcuuuugcuuguugguguuuccuucauuuuuccuuuguuuaucauuuugccacucuucuguuauuuccuuuauuauucauauuuuaauauaguacuuuguauauugcauuauaguuuuuaguuggauuuauuuucuuuuccuccugaauuuuuuuuguuuuuaauuuuuuuauuugaacaagguccauuucuucaucuugauaguuccauugucuggcacauaguaaauugccaauaucaauaaauaguaaucauuuuuccuagagguuuucuguauugauacauguucauauauucuuuccuguuuuugcagcaauaguacauagagcccuaugaacucuuccccuagcuuccccugaguggugaaaucuuaucgcuguaguacaguaucaaagugaagaaauugacaauuuuguuuacaaaguaguuuacagacuuaacaguuucuaccaguuuuuacauguguauuuaaaaauucauugugcauuuaugucugucuguguuuaugauuccaugcacuuugaucacauguauagauuuauguagcccccaucacagucaagauauaaaauuguuacaucaccauaaguggacucccucaugcuacccuuuucugguuuuauuuuuauuauuguuacaucuguugauggacacuugguccauuauuaucuuugggcuauuuugaauaaugcugcaauguacaugggagugcagcuaucucuuugagauccuguuuuuaauucuuuugcauauauacccagaagaggaauuacuagguuguaugguaauacuuuuagauauuugaggagcccccauucuguucuucauagaggcugcaccauuucacauuuauaccaguagugcucaagaguuccagauuucccauaaccucgcuaacguguuauuuucuguucuuuugauagugaccauccucauggauguaugugauaccucauuguaguuuugauuugcauuucucuaaugacuagugauguugagcaucuuuucauaugcuuguuggccauuuauguaucuccuuuggagaaaagucucuucggguucauugccuauuuuuaaaucaaguuccuuauuuuuguuguuguuacuaaguuguaggcauuccuuauauaugcugaauauugacucuuauauaaauuauuugcaacuuuuuugcauccuuuguuuccuuuucucucgauuguuuccuuucauauacagaaguuauuaaguuugaugcaguucuguuugucuauuuuugcuuuucuuaccugugcuauuagugucauauacaaaagaaucauugccaaauccaaugucaugaaacuuuuuccguauguuuucuuguaggaauuuuaugguuuuaggucuuauauuuaaaucuuuagucaauuuugaguuaauuuuuauauauuuugucagaguccaucuucuuucuuuugcguguauauauccaguuuucccagcaccauuuauuaaagaggcuguccuuaucccguugugugguuuaggcaguuuuguugaagaucauuugaccguauaugugaguuuauuucuaagcucucuauucauuuccuuuggucacugucuauuuuugugccagcaccucacuuuuuucgauuauuguagcuuuguaauauauuuugugugguucccccaccccccgcccccuuggcuaacuuagccuaauauguaauauguuuucaaaucaggaaguuugaaaaccuccaacuuuguucuuuucaaaacuauuuuugcaauucaagauccuuugagauuccauaugaauuuuaggauuuuuuucuggaaaaaaaaaacaaacccacuauugcaauauugauagggauugcauugaaucugcagguugcuuuggguaauacagauauuuuaacaauaauaagacuucccaauccauaaacacaggaugucuuuucacuuauuugugucuuuaaacuuuuuccaacauuguuuuguaguuuuuauuguguaauuguuuucucccuuuaaguguauuccuaaguauuuuauucuuuucgaugcuauuauaaauuauauuguucauuucuuuuuuauauuuuuuauaguuuauagauaugcaacugauuuuugcagguugauuuuguauccugcaacauugcugaguuuacauauguuugaacaguugucuuuaggguuuuuacauaugagaucauaucaucugugaacaaagauauuuauacuucuuuuucugauuuggaugucauuuauuucuuuuucuugcauaauuguuugguuuagaauuucucauacuauauugaacagaaguggcaagaguaggcaugcuugcuuaauuccugaucuuagaaggaaagcuuucgguuuuucaccauugaguaugauguuaaccauggaguuuucauguauggccuuuguuaaauugagauaauuuccauuucugguuugaugaguguuuuauuuauuuuuuuccaugaaaggguguugaauuuugucaaguucuuuugcugcaucaauuaagaugaucauguggguuuuguccuuuguucuguuaauauguuacauugauuuuuauaucuugaccuauccuugcauuccucagauaaaccaacuuggucaugguguauaaucuuuuuacaugcuguugaauuugguuugcuaauauuuucuugaggauuuuuauaucaguauucaucagggauauuugucuguaguuuuaguaucuuuguuugacuuugguaucaagguaaugauugccuaauaaauggaauuugaaaguacuccuacuuggaaguacuccucuuggaauacuaccaauuguuugguaguauccuccagugaagccaucuggucuuagguuuuuguuuguuaauuuuauuuuuaaaauuuauuauuuauuaaugauuauuauuuuugcaacagagucucacucugucauccaggcuggagugcagugaugugaucuugguucaagugauuugugugccucaaccuccugaguagcuggaauaauaggccugcaccaccacgucuggcuaauuuuuguauuuguaguagagacgggcuuucgucauuuggccaggguggucuugaacuccugaccucaagugagccaccgcaccuggccuuaggcuuuuuuuguuaggagauuucuauuacugauuaagucuccuuaauaauuauagauuuauuuauuuauuuacuuuuaauaauucagucuugguggguuguguguuuuuaggaauuuauuucuucuagguaaucaaguuugcagguguguaauuguucauuguagucucuuguaauccuucccauuuauguagcaucaguucuaaugucuucucuuucuuucauuucuuuucaucuuuaaagucaucuguuuuguuaguuagccuaguuaaggauuuaucaauuuugcugauuuuuuuuaaaccaacuuuuaaguuuuguuuuuguuuuucuauucucuauuuuuguuuacuuccacccuaauuuucauuauuucuuuccucuugcuaauuuuggguuuaguuuuuccccucuaguucuuugaguuguaaagcuagauuguugauuugagaucuuuguguuuguguuuuaccacuauaaacuuccuucuuaccacuguuuucacugcauacaauuuauuauauuuuguuuucauuuucauuugucugaagauaucuuguaauuuaccuucuucuuugacuuguugguuuuuuuuuuuaaacagcauguuuaauuuucacauauuugugacuuuuccuacuuuucuucugcuguugacgucaaguuucauuccauuauugucagaaaagauacuugguaugauuucauucuuucuaaauuuguuaagaccuggguugugacaugcgaccuauccaugagaauuuucuaugugcucuugagaagaauguguauucugcuguuguuugauccaagcuuauccuaugugucuguuagguccaauuagcauauaguguuguuaaaguucucuguuucuguguugauauucugucugaugguucuauccauuauugaaagugggguauugaaguuuccuacuaucauuguguuacugucuguuucucccuuccauucuuucaauguuuguuucauauauuuggagcucugauguagggguguguguguguguguuacagcuggugaaaguacccuuuuaucauuauguccuucauugucuguuuugacaguuuuugaccuaaagucuauuuugucauacauaaguauggcccauccuuacucucuucuuguuaccauuugcaugguaauauuuuuccauccuuucacuuucauucuguguuguauuuuggauccaaagugagccucuuguaggcaccauauaguuggaucuuauuuuaaaaaacauuaagucaaccugucguuugauuggagaauuuuauccauuugcauuuaaauaaacugcucauuggaagggacuuauuguugucauuuuguuuuuuucucuaugacuuguagcuuuuuuuuguuucuugauuccuuuguguuucauugcuuuuuguuuuucuuuugguauaguagugugcuuucauuccuuuuacaguucguuuuguguauuuucuuuagauguuuccucugugguuaccguggggauuacauaaaacauccuaaaguuacaacugucuauguuaaacugcaaauaacuuuaaucauauaagagcgcuagucuauaucugccucacuaugacuugauguuacuguugucguauaucacaucuuuuuauguuguguaucuguuaacauauuuuuaguuuuuuuaagcuuuuaaguucuauaccagaauuaaaagugguuuaugcaccaauauaacaagaauacaggauucuguauuuuucuccuuaucaacauuuucuuagagaaguuuauauuuuuguaugcuuccaugaugcauacacucuuuaguuuccacgugaagggcuuucuucagcacuucuuuuaggacagguauagugaugaaacuccuucagcuuuuacuaaucugggaaaaauuuuaauuucaccuucauuuuugaagcauauuauugccagguauaguauucuugauuggcaggucuuugauucagcccuuugauaauauauuaucucacuccuucaggccuacaagauuucugcugagauaucugcguguuaucuuaugggaguucccuuguguguuguuaugaguugcuuuucucuuacugcuuucaagauuauuuacugugauucagacagcuugguuauaauguaucucaguguagauguuuuuggguuaacaauaguuggaggucuuugagcuucuugaauuugcaucuccauuuucuucuuccaguuucagacauuuucagcaauuauuuaucuuucucucugucuuccuuuacuucccuuauguguauauuggucugccuguuggugucccaaaaguccuuuagacuuucuuagcuuuuuuucauucucuuuuugcuccucuggcuugauaauuucaaaugaccugucuucaaacuuguggacuuauuuuucgguuugauccggucugcucuugauucucuacagugaauuuucauuucaguguauucuucagcuuuuuaauuuguauuaugauacguuuuuacaguuucucuuuguugauauuuucauuuuguucaugcacccuuuuccugauuuugcuguuuucugucgucucuuucacuuucaccuaauugaguaucuuuuuuuuuuuugagaaggaguuucgcuccugucgcccaggcuggaguguaacggcgcaaucuccacucacugcaaccuccgccuccuggguucaagcgauucuccagccucagccuccugaguggcugggguuacaggugcccaccaucacgcucggcuaauuuuuguauguuuaguagauacaagcuuucaccauuuuggcuaggcugcucuugaacuccugaccucaggugaucugcccgccucggccucccaaagugcugggauuacaggcacgagccaccaggccuggccagagugucuuaaugauaguuauuuugaauucauuggcagauaauucauagcucucuguuacuuuaggguugguuuuuggagauuuauuuuauuuauuugauuggaccauguuucucuguuuauuuguaugcuuguugaaauuuuagcauuugaaaaaacagccacaucucccagucuuuguggacucuuguacacaggaagggcuucaccagucagccuuguuagagagucugugggccucuaacaccuuuuuuuggcuaugugucuucucugggcuuuugcuuguacucuuccaucugaagagguuugccucucuacucugaagcucccucugguaccugucuuugcuauagcagccucugguacuuuggcaagcuguuguauuagugcuuccccugcugucugucuguguuacugcaauuucucuggugcucuaucaaguugaggguccugccuuuggucucugaggcucacaggcauccgaagugccauagucacaguucuugcuccagauuaguccuccauguuggguaagacaaaaucuaaugcguugggcaucuuucuuaaacaguuggauucaagcuccaacuuucucuuuccuuucugauguagaagcuguguugggagguugaugggguauagugaguaaaugcaauguauuuuccuaacuguuccagugugccucuuuuuggccuugugcucaccugggauggcauacccucucaacuaauuuguggaaaucucaugcaggcaauaugaugcuuaucuuguuaagucaucuccauaugggaagcagaggggacuuccuguucugacauguugcugaucauaccacaguuuucaaaaauccuccaucaaaugacuccuguguucuaaaccauuuauuuauucucuaugcuuuuauucuucuuguuuuucuccugaaauauucuuuuaucuuaaccauuuugaguguaauaauuacucaaugauggccaggcacaguagcucaugccuguaaucccagcacuuugggaggcugaggcgggcagaucacuugaguucaggaguucgagaccagccuggucaacauggcaaaaccccacgucuacuaaaaauacaaaaauuagccgggccugguggcaggcaccuguaaucccagcuacucagaggcugaggcaggagaaucgcuugagccugggaggcggaggcuagagugagccaagauggugccgcaggauggugcacuccagccugggcgacagugagacucuaucucaaaaaaaaaaaaaaaaaaauuacucaacaaugugcuuaaagaugcauuccuuucccuaaaagcuuuucuuuuuuaagcuuuuugcauucgccuuacacaguuauuuuaaugugcuuuucucuuguuuuacauuuguuuaucuugacagccagauuuuaagcaccuuuauagcagauugucuuaauucuauuguuuuucccucuacacguaucuaaugcaaugucauacuagaagguugaaauuauuguugugucauauaaaaaguagcaagauguauuuguuguuaagaagagugauuaauggcaucugcucaauguaauucuaagcauuuacuaccuuugguuuaauauguuauucuuacacuugacuuagucuugaguagagauauuuuauucuuccauuuuuuguuuguuuguuuuugaggcauguucuggcucugucacccaggcuggagugcagugacacaaucucagcucacugcaaccucugccuccucggcucaagcuauccucccaccucagccucccaagaaggugggaccacaggcguguauuaccacgccuggcuaauuuuuguauuuuuuuuuuagagaugggguuuugcuacguugcccaggcuggucuguaacuccugagcucaagcaauccuugccugucucagccucccaacgugcuaguauuacgggugugagccacugugcccagccucguuuuaagagauaaaugaugauaguguuauuaaugauggaggccuaaauaaugauaguuaauauguaggcguuauaauuccauuucuguauucccugguuuuggggggaaaggcugaaauaaguuguuacugaagcuuagauuugugacauuuuauuaaauaauuuaagucacauagugguagguaguauuuuuuuaaaaaacaacuuaaaaauaauuuugauuugugacauuggauaccacuuauuuguugaauugguggugcuaauaugaugccugcuacauaguaggcauucacuagcuauuuguuaaaugagugagucugguuauucuuuagauuuauauuguuaauguuuuuuaaacucuuacagcaugugagccauucugguguuuuuaauuuauucuucauaagaacacugagaugcaggaauuauuauauuaaucucucaaaugauaagcaguugucuucagcaaaguaaaugauuugcuuaagauacaaugaacaagugauaaugccaagauucaaauuauugucucagcuggcaauguuucccauuauauuagaacagugacagauaauauauugacaggcaucuacaggucuaauuuuuuuuuaaagauucccuguguguugaguuuuauuuuuaccuugauuuuuuuuucucccccagcauccacccaacccaccaguaucaccaggaaaaacuguaaaugaugucaacagcaauaauaacaugucuuacaggugagaauucauagucugucuaguuuuuaaaaacagaacaaaguucuacuuucuuuauuuggucaaagaaucuugcaguguaaucaugguauuuauguagaaauaaguguuugguguacuugguuaguauauuuucuuuuucugcuucauuauauuguucaucugugaauaauacuuuugcuaacuuauuauaaggcauucuuuggucacuauauauuucuuuaaccacuugucuuaaauaguauucuuucaaguaauugagaaaugcuucuguuaagggugagaaagacuaaugucuguauauauuaggaccuacuuuugguauucagguuaaguacugauaacagacauuagaauacaagaguuaagaguuaagaguuaaugccacagaccccagcauuuagaagucuuugugccagcuaugccucacuguuuuugcuugcaguuuaggauugugaaacccaagucuagccacccuuuuuccccugugggccacugcuuauucuagauaucaguugguauucccugaguggcauaucuauugacuauugguguguauauguauuucauagaaaugcaggcacagugagacagaugcuggaguccaaaagaaauguaagcgagagugcaccaccauccuuucaaacuccugugaauacagguaacuuuuuuuuuaaauaccaaaauacauuuucuuaggaauuaaaggcuuugguucucuuuucuuacauucuuuugagguugaaauggauuaagaaauugggcacauuggucuaaguacaaaaauuuuguuaaaaauucaggaucaaacuggguaugguggcacaugcuuauagucucagcuacuuaggaggcugaggaggauuacccaaacccaggaguucaagucagcuugggcaacauaauggaauccaguuggucucuuaaaacaaaaaaauuuagggucauagauaaguauaugugaaaauacaguauagauauucaaaucucuauuguaguaguucacaaacuuucuggucucuagaucccuuuacaaucuuaaaaaauuauuaagaaccccagaacuuuuguuuauguggguuacauccauugauauuuauuaucagucgaaaugaaguagaaauuaaacagaaauuuaaaaauguuuuuaaaauguuuauucauuuaaaauaauaguaggcugggcuuggucgcucaugccuguaaucccaggacuuugagaggcugaggcaggcggaucacuugagguuaggaguuugagaccagccuguccaacauggugaaaccccaucucuaccaaaauacaaaaauuauccaggcaugauggcuggugccuguaaucccagcuacucaggaggcugaggcaggagaauugagcuugaacccgggaaguggaguuugcggugagccgagaucacgccacugcaccccagccugggcaacagagugggacuuccucucaaaaaaaaaaauaauaaauaauaaauauaaaaauagauaaaguaauaguaaacucauaaugucuaacacaaaaagcuuuuuaaaaugaaacuguguauuuuccaagcuuaaaaauagcagcacaaagagcauuauucucuuacauuuuuuacauaucucuuuaauacuuugagacauuaagacagcuaaagauagcuuaaagguauguauacucauaucuauaucuguuuuuagucuguuuuaaaauguugauuuggcugaagcauaugaaagaaauccagucuuuuacaaauauauagauggaaaagggcuagcccuuacagauaauuguggauauucuucuuuaauacuauccaguaguaguuucuuuaagguugguugugaaguguaaucugaaaccacaccaaagaacuuuucuaacuccuccauuaaaauccauuuauuggacaagcgugguggcuuacgacuguaaucccagcacuuugggaggcccgaggcagguggauugcuugaacucaggaguuccgggccugccggggcaacauagugaaacucucucucuacaaaaaauacaaaaaguagccagacaugguggugcacaacuguggucccagcuacucaggaggcugaaguggaaagauggccugagcccgggagguguaggcugcugugagccaagauugcgccaguguacucgauccugggcgcuagaggcaaaccuugucuuagaaaaaaaaaaaaauccauuccucuaucuugcacuuggauggaguuuuacuaauauuauucauugaucauuugaaaacuauucaccaaguuaugcaaaucuuccaaaugacacauuuuauuaauaaauauuauuuuuaaaaauuacauuuacugauuuuacuaucaguucuacucagagaaguauuuuaaggauuuagggagcugucaugcuuucaaugacagauacaaguuuuuucuaauguucuuaguuuugcuuuaaaacccaaauguuauuauugcugauaaauacaguugggcuuuuuucuuugaagugacuggcuuaccuaguuuauuuuuaagaaaagaucuucaaaauacccaaacgugaauuaucagugugucuguaggucauucauucaaguaaaaauaguguuucaugggaaagacugcuaguugaguuuacagcucaauugcacaagcauuuuuccuuaacuauccuacuuuggcacgcaguaguugucuuauauguacugccuauuucuucacauggaauauuaagaaaagaaccccuauucaaagguugagauauaauaaaguuaauaguuuuuaccgcuguaucauggggauucuuaaguaaaacugacuuuguuuuuuacuguaagcaugugaugaagaaugcagcgauguuuggucccauuauacuaccuugauuuuuguacuaaagcaucagaaguuuuacuuagcauugcuuuugcuccauuggugcuaaugucugcuuauuuaaacagucaaauaaugucucauuguuaugaaaauaguuuugacauugcaaacucccugaaagggucucagaaaaccccaggcaccccgcuggaccacacuuugagaaacugcugcucuagugaaccuguuauuuuuggaaagacuauaaaucaaugagaaagaaguuuggucauguauuuuaaaccuguugcaaugagaauaaacacaaguaguugaaaauuauuauaaaacuagugaccagcauuuguauuuucucuguucuucuguauaugcuaccucauuucuucuuaauucaucugucaucuucgcucagugcuguuuuccauaucauacaaugucaguagggugucaguagagggaaucuccccucaauaguuccucucccaaggaauucaaucaaacuugauccaaagauacagacaugguucaaauaauaaaauacgaugaguaagccuaccuguuauucauuaauggucaugacucuuuuuagauuuacuauuugaguuuauauauuacuuguguuguaaggcauuuauaauguuuuuaauguaguuucaaaaauauauauuuuuacuuaacuuuuuaguauuuuuuauuuguuuacuaguuagguacucuaaagugauuauaguaauuuucagagaccguuuugauccucaguagucuugcauauuaaucaucgaucaugugcuguuuuuguaauuuacuaaaacuacaugcaaaaugcuucuaugaauuuaauucuaaauuaaauuuuggaauuuaaaucuggaaaaaaauuucaugauaaaagacuuuacagucuuugcaauguauuacgcaauguauuuaauuugugucugucauauuuucuuaguugauaaauuaauauaaccauuuaaacugaggcuucuguuuucuuucuauaguaucuucaaccaaucuugucacuccuccagcaguugucaguagucaaccuaaauugcagacuccagugacuucggguucccucacagcaacgucaguucuuccugcacccaauacagcuacuguaguugcuacuacucaggugccuaguggaaauccccagccuacaaucucuuuacagccuuugccagugauuuugcauguaccuguugcaguauccucccagccucagcuucuacagagccauccagggacuuuggugacuaaucaaccaucuggcaauguugaauucauuucugugcaaagcccaccuacagugaguggucuuaccaaaaauccaguauccuugccauccuugccaaaucccacuaaaccaaacaacguuccuucugugcccaguccuaguauucaaaggaacccuacugccagugcugcaccauugggaacaacacuugcugugcaggcuguuccaacagcacacucuauuguacaagccacaaggacuucuuuacccacagugggcccaucaggacucuauaguccaucaacuaaucgagguccuauacagaugaaaauuccaauuucugcauuuaguacuucgucugcugcagaacagaacagcaauaccaccccaagaauugguaagucaccauguagguuuaauacuagaaaugcaagcaucuuaauagccuuguaaugauugaacuuuuuuuuucuaaguggcuagcguuauuggaaguacaaaauaaauagaauuuucuugauuauuuuuaguaauuuuuuagauaccugagagaaaugauguugcuaaaauggggcuugagagggguuuuauuuugaauuagaaguuaguaucuguguuuuaucuuuuaguaauuuuccuaaguuuggugaauuuuuaauuuauggcuuuguggcaagcauuaugaguuacuuuuaugauacauuugccagcaauaucguuuaaaacauuuuaaaguaucaaauuuacauaauauaugcuuuuaagaaaaaaagacacguuuauguuccuuacccauuuggaaaauccuuugugcacucacucauagcuuccaaauuugaacaacuuaaaaauaaguuuuucuuucacauuugcuauaaaauguuugaguccuucuuguuuuaucuuuuccguguuuucccauaugacauauuauaugauuguuuguauuuuacuuagaaauauugcaaaaaggagcacuugauuauaccuguuuaaaaucugccaaacucugugucuuccuaguuccuagaaagaguuuguuuuguaugcauucuugaacuugcuuauucuucauuucugacuucacauuuaugugcacuacuuuuggaaagucaugcaaggguaggcaucaugugucuaguaaaauugcuacaguauuuuucuuauugauguuguaagugaccauguaauauaggaaacaaauucuaaaguacaaaauuacuuuuauaagugagauguacaagccuuaguuuuuauuugucauauagccauuacuaguguaguuacucccuaaguguuuucucauauaaaacaaugacgguauuucacagaguuguuaagaaaguaaaugaauggcagaucaaaauuaauguuggauugaagcuggauaucacucaucauuaucauauuuauaagaauaaacuaauguuuuauaugaaaguguaauuauuauuuauaguauuuacaauuuaaauguuugcauaguacagggcaaauguuuguuaguguuaucugcuaccacauuauuuuuuggauauucuuucauguuuacaacacuaaaagagaugcuuacuuuuaacugaggucaguggacauacaagauuuuugggugauaguuuauuuuucuguaacuucuuuuucuuuuaguucuuaguauuuuuuaaugucagaucauuuagugauggacauuguuuuaugugauuuuggguuuuccuccuuaugaaauuuugaggcaagguugacauuguuuuaaauucauggucaugagaugagauauauucuuaaauagagaacuuuuccugaaaaaccauggcuugaaauauuuuaagaguauuuuguuuaaugucaugcuuguacuccaaacacuucuaaaagugucagaauuauaauuucauuauucuguucucuuacaauuuuuauagaaaggauauauuccccaaauuaucugguugauguacacuauuaguaauucaugucagucuguuucauuugacuauucuuaacuuuuuuauauaaaaguaaguuuucacaaucauuaauugguauagcauucugagauaaugcacaauuauuucuaaacauaaaauuguauauuuuaacauguacauuuauauauuuuuaauauguaauuauaucaagaucuucauuucaaguuccauuuagaaugcuuaccuacauuugauaaugaauaaaugugaaugacaagcuuuguauuuuuuucauaaugcuaacuaaaaugagauuuuaugaauuugcuuauucuucauuucugacuuuauuaauaaauuauuacuuauaauauguuauuugaucagguauaauuucagcagugccauaaaugacguuaaaguaggcauuuggcuuuuuaggauucccaaaaccuaaacugaaaccaaacuuugguacaucucuacuacauuuaguaguuugugauuaauuaauuagguuauauaauuaaaauuuucuaagcucuauacuuauguggguauuauguuuacuuaaaagaacauaugcuauauguucaugcauuuguauguauuuuauuguagcuaaguauauccuuauggauuuuaaaucacuauuuucuguuuauagugagguaaauguccuaagggcuuggaaauuuaaagcucaaacuauagcuaauuucauucauucacaaaguaaugaaugucuguauuaucuuagguucuuuagauacacagaaauguauaaaauagucacuaugaucucaccaagcuuacaaucaaauagggaaugugguaauuaaauaacuaauuaauuauaaaugugaugaguguuagaauuugcagguuuuugugagaggacaaaagagaacaugggaaaucuggaaagauaugaaguaaugaacagaagaaugggggaaauacgguuaaaggguuuuuguaggggguaaugugacauccaugaacccugguuacaguauggagaaugguuuggaagggguaggaauaguguuaggaagaccaauuaagaggcuggaggcucuuguacuguacaagaugagagauggugguaugaaaaagauuuaaaaguuauuuaagagguagcauuggcaguacuugguaauuaauaaaaguucagauguguggaagagauggagaacucaaagaugacucagcuuucuaagacauuguuaaaugcuguuccauuuacuaaacuagauauuaaaaaaagaacagauuugggggaaaguuauauacaauccauauacaauguacucucucagauuucauuaaacaucuuguucuaagacuauauaaaacuagaguuggcuaggcaugguggcuuaugccuguaauaccagcacuuugggaggcugaggcaggaggauggcuugagcucaggagcucgccaccagccuugcaauauagugagacccccaucuguacaaaaaauaaaaaauuagcuuggcauggugauacaugccugcagucccagcuacccaggaggccgaagcaggaggccgaagcaggaggauugcuugaacccaggaggucaaggcugcagugagccauggucgugccacugcacuccagccugggcaacagaggaggucccugucucagaaagaaaaacaaacaaacgagaguuuaaacacagcaauuauuucuucaaccauuucuucaaggacauaauuaaaugagcgaaguguuugccuuuuuucuguucauacaauuauccagagcuacuaagagauaacugccaguuuaacuccuguaaagugcuuuuuaauuuuauuuacuuuuauuuguauuuuuauggagacguauuccauaugauagaaggauuuuaagcuauaauuucuuauuuuacauccugaccaguuuuguugcuugauagauggaguuauaauauuuauauccagaagucauccaagguagaucuuguagaagaaaggaaaagcaaugcaauggaacuauaagauguuacauuaagaaucaagggaaaaaaucuguaauaacgggcaaggaauguuaguugagaaucuagaauaaggaauaucauuacaguuuugugaauaauuaacauagcucugaggcaauuaggucuaagagagaaucaugcuggguaacaaagaaauguguguguaacauuuuauuaagcagucuaaaucuuucuugcaucuuuaggaauuuucuuauaugaaaauguuaugacaaaaaauaaaaaugaggccagguauguuggcucaugccuauaaucccagcacuuugggaggcugaagcagguggaucacuugaggccagaagauugagaccagccuggccagcaugaugaaagcaggucuuuacuaaguaaacaaaaauuagccaggcaugguggcacacacugguagucccagcuacucaggaggcugagacgugagaaucucgaaccugggagauggagguugcagugagccaagauugugccacugcacucucgccugggugacagcaagacucugucucaaaaagaaaaaaaauaauaaauaaaauaaagaauuaaaaaauaaaaauauaaaagugaaacuuccucaucuacuuuuuauguaaaguuaucuuuuauuuugauuugaagauggaaguguuucaaaugcaaaugaauguauuuuaacauuguauauaaaaaccuuugguaguaaucacugauauuuugguaauaucaccuaguguaucuuaauacuccacuguguaacaucaguagccuaaaauuaguuuuguuagucuuucaggaacuucauaguccaaaacagaugcucauuuguaauaaaugagguaauuugaauauauuuuuaaauaaauagauaauauauuaauauucuucuuacaaaaagaagguaauucagauaagguaggagaaaucaaagggcauucuuuuuacuucuguacccuggaauacuucucuuuuaacaggugaauauuaacccaacuugauuuuuuagacauacagacuuauauauauacauaugggaauacauagguaguuuaacuuccuguauuuuuuuaaacauaaauuguuuacucuguaugcauucugaagauuugcaaaugaaaggaaugccauaguuugaccaagaggguuuuaucuccagaaagaaaggaugggcuguuucaacauuuaaaaacuccauguuaccaaacaggaaacccuaaauaaucucaauaggugcaaaaaaccuuugauaaaauuuaauacauucucucuuuuccucccauuagaaauugggacaaaauauacuuuguuuauuuucugugcuguucugaaaguaacauuuuuuaacugcgaacucauuacaaguuaguugaaaaaugaacaaagaaagaaaaaucaccgaugauugaacuacugagaaauacacauguguauuuucuuggauuuacugcaacuguuucuacugaauuuauugggaacauuuuugacauacuaaauuuuuuucuccaaaagaacauaguguggaggaauuauauuuuguuuaacuauuuccucauguuagaacauuuaaguuauguguaucuuaaauuauuuccaugagauacugcuuagaguuaaaauugcugggccaguggaaaguuuuuuuuaaucuguauugugaucuguauaguaaucuguaugguaucugaaagauacuauagcaguggucugugaauuugaguuuuuauuuauguaugugacauguugacggaaaaguaguuggagaaaacuacaugaauuguuucauauaaagcaacuuaacuuuuuacauuuuguagauguuuuuaaaaauggcuuuuuuuacuuuucagaaaaccagacaaacaaaacaauagaugcuucugucaguaagaaagcagcugauagcacaucacagguaagauuuuuccuucuucuucaaaguaaaauccuaauuaugguccacaggaaaaugaauuuucaucauucuuugauugaaugaaaauuguucuauguguguuuuuuauaacuauccaaacauugucucacagcuucucuguaauguuugacaagaauugagguuuuuguguuuugucuuguuuuguuuuugcauaacaguucucuuagagguaauaauuaguuuauucuauuaacugacugauuugauuaauacaauugacaauccagucauuugccuuuacauacuguaaagauugucugcaaaaagaaaacacauguaauuucuuccagguacaucuuuuuuaagagugucucauugguuuaccuucacuuguaccacacucuaccccuaccaccuuuuuaauuuccccaaagguaaucagaaauaccuuuugaggaagaauuuuuugucugucugcuuguuuacuagcacuuugccagucuuuguacuuuuucauauuaaaucuuaaccacccgguaauagaauaacuacuucuuuccuguauuaacaguguucuuccuuguucuuuauggcuuuagguguagugaauuuauagugauuagauuguugauaguuuuauuuuauuuucuucacuuccuuugaaucauuucaaggagcucauauauucccagcagaacaaaaaucucgagcaugucaggcaugaaaaaaugacaagaauuuuaaaacaagggcaucauuugaucuuuaaauaugacuauuuucuuuaaaaacgauggauuuugaccaaccuagauguacaccauaguuuauagaucaaauaaaagcuauuaaaaauaucuuaacuucuuagaaauguuagcagucuuugugugcaguauuagagaucagaguugugauuguuucugagcaugucuuguggguuauaacuauguuuucaauuaaaauuauaagauugagauacuuucuggaagauguauagaaaauguugauauauucagugauacuuaagugacauuuauaggaagucuaguuaaacuuuaaacaaaggauuuaugaacaucucuacuucccucagugaguuuuuuuuuuuuuaacaaguaauauuuucaaggaaaggaaaauggacauuaugauggcugucuuuuguccuuuuguaaauggugguucuucuagagcugugcuaucuaauaugauagccacuagucacauguagcuauuuaaauuaaauuaaaaauuuaguucuucagucaaaaccccauuucaagguucaguagcuacaaauggcuaguggcuagcauauuggaccacacagauacagacuguuuucaucauugcaaaaaguuguauuaaacucuauuguauagaauauuuugcugaaauauaguauauguggcugggcauggugucucacaccuauaauccuagcacuuugggaggccgaggcgggcagaucaccugaggucaggaguucaagaccagccuggccaacauggggaaaccgcaacucuacuaaaaagacaaaaauuugccugguguggugacgggcaccuguaaucccagcuacuugggaggcugaggcaggagaauugcuggaacccaggagggcggagguugcagugagcugagaucauaccacuuuacuccagccugggugaaagagcgaaacuccaucccaucucaaaaaaaaaaaaaaaaagaaauauaauauauguaacaucauaaauacauaagugaaauuaaaauggauauaauauaagacacuugaggugggguguaguggcucacgucuauaaucccggcacuuugggaggugaagacaggaggaucacuugagcccaggaggucgaaaccaaccugggcagcaaagugagacuccgucucuauaaaaaagaagaaacuuaaaaaaaaaaaaaaagacacuugaaacaggaauugacuucaucagaaagcaaagcaauaguacaaauuaauauuaagcucucaauagauauuuuauuuggcuucaaggaagaggaauuuaauaucugaguauaaaaaaugcguacaagcaguuugagcagcuagccugcugaagcaaugccuuaucaaaaauaacaaaguuucaguuuugaaucagugucaauuauguauaugaauaauaaauauaauuacaggaguuuuauuguguaauaagaaaccauaauggaaguauauaugugcuuucaguuaugaaguuaugcuugucagccagaauuuuuugaaacaaauaucauuuuuguuauugugaugaauaccuuuauuaauguuacacuauugacuaagaaguuguuaucuuuuuacccuaaugugcaccuugcuagcagauagaaacuagugugaaacagguagccugugauucuuugaauugucacauuuuaaguacaauuggcuaacuucauuuuucugucccaagccuacuuaguuguacuuguuaacacuuuaagguuauuuagaucagaagaaaucuggaugucucaggccaggugcaguggcuuacaccuauaaucccagcacuuugggaggccaagacgggcagaucacuugaggucaggaguucgagaccaggcuggccaacaugucucuacuaaaaauacaaaaauuagcuggucgugguggugcacgcuuguaaucccagcuacuugggaggcugaggcaggaggaucacuugaaccugggaagaggagguugcagguugccaagccaagauaaugccacugcauuccagccugggugacagaaugagacugucucaaaaaaaaaaaaaaaaaaaaacuuggacaucuaguguggaaaugcuugugagcuguaguuaauuagcaaaugaugaaauauguaaaauacucuuucuguaguuguuaaaugaagauuuaucugauauccccaaauaaguauuuauuaacauauugcauauaauuuauuauuguauauuuuauuacuauauaucauuuuauauaaugaauuguuuuauauagugaaaaacaaauuuauucaaauuaucaacauaagcuauaaaauaguguugcuaucuguaauuguuguuuugaaggacucaagauucaccuuuaaguuugcugauuugcuagaaggauuucauaagacccaguaguagguuauacucaccauuaugauuugucacagcaaaagguauagagcaagagcaacagggaaaaaaauuugcagaguugaaguucagagagaucaggcaaagacuuccaagucgucugucugggaucgcacagaauuuguuuuuucucuggcuuauuaaccuuagagacaugugccaagagucuucccagagaagccugacugagucucagggucugagguuuuuuggaggucuggucacauagugacauuuuucuauauaaguggccauggcauuggaaacucaggaucccaacaaugaaacccaaguguacaucaucaaucuucauucacuguucagaguguauauaagagaauuaauuguuaacaugacuuccaagggcaacguucuugauaacuaaccaagucucaauuauggguccaaguucccuuggagagaugugcaaggaaugaacaaccagcucuucugcgugaacucuuucuucacauuugcugaagugugccuuucaaguauauucuuguuucauuacaaaaaagcuacaaagccaauauguuugcucucuugaaauuuucuuaguguuugcuuauugagacuggucguuuuggaaaacgacacaugauuagcuaaguuuuuaauaaaauuucuacuguuaaaaacuauuugauauaauuuuuuaaugauuucaaacugaagguuucaguuuguaaaaacauaaacguguuucugauuagauuucucagacaauguuuugucaggaaaagauguaaagauacauguauauguauacaugucucuguuuguucauuuccaccugguggcauagaaauaauaaggucuacagucagacagccuggagccugucacuuaauagugggugcuuuggcaaguuauugaacaccuuagauuuuucacuuauaaaguagagcuagagcuaguacuuaccacauagaaauauugggaagaguaaauguguuaaugcauguaaagcauuuagcacagagucuaauuggaguagugcuagcuaucaugacuaucuuauaaauguaguuaauaauuauggaaauaauuaccaauuuuauuugucaaaaaagaaagucuauucaggaaacuacuuguaguauaugauaauaaauuguaucugucaguuuaugaucaauaaaaaucauaauuuaucauuaggucauugcuuguagaucuucuugaucuauauaagcauuuaaugauacacauauuccucugagcacugcuuugccugcauuccauaaauuuucauguguugcauuuuuauuucauguaguuccuugucauuuccuuuuggguccuggguuguuuaguuaguaauuuguuuaauuucguaauauuuggggauuuugcaaauuuuuuauuauugauuuuucauuuaaugcuauuggauuuagaaaauauccucuguaugacuuuguuacuuuuacacaaauuaaauauguguuauaaagccccaucuaugguauauaucuuagugaauguaccauuacacuugaaaagauuaugcugcuauuggguguaauguuuuauaaaugucaauauagcaugguuaguaguguaauuuggauuauuuguauguuuacugauuauugccuuuugcuguagugguuuuaucuauuacuaagagugguaugauugugaaucgauuucuuccuuuaauuuugucaguuuugcuucauagguuuugacacuguauuacaugguguuuuuuauguauaauuuguaaucuugccauacuuuuaucauuauaaaguuucccucuuugucucucugacauuaacauaguuacagcagcauuuuuuuuuaacucuuaaagaaaaaaguuuaauugagucacaguuccacagggcuugggaggccucaggaaacuuauagucauggcacaaggggaagcaaacauguccuucuucacauaagggcagggaggaaagaaugagagcagagcaaagcgggaagccccuuacaaaaccaucagaucuugugagaacuuacuaugagaauagcaugggggaaacugcccccaugauucaguuaccucccacccagucccucccaccacacauggaaauuaucagaacuacaauucaagaugacauuuggguggagacauagccaaaccauauaaggagguaggacccuguauucauuaucuugcuacuuuucuaaguuaccuguguguauagaguuuaagaaaugaucauuggaaaaaggcaaugaugcucuuggaggaaugcagaucuaacaauugaauguuuaaaaccaauauuccauguauauuguauuaaaagccuuuagaauaaaaguaucuauccauauuuauuuuuuaaagccaaaguguauauuagugccacauauaucguauagccuuauaguguaguauuuuaaggacaucuuaacugcccucuaaugccuugaaaucuggcuacauaucugacuuauuacccugccccuaauuaguaguguuuuaugcuaaguaagcauccuuaucuauugaauaaaugcuaauaguaaaugaugagacaaaaguugccaucaaguugcguuuuuaugaaaaaaaugugguuaugaaaagcaugaaaaagcaugauuuucauuuauaaauuagucacacauuucuuuguuauuuagaaaauaaaaauuauacuaauuagcaaucauuuaucagcaccaagugaauauucugucaacuguuugaccuuguaguugcuauugcccagcuugaauguguguagggauguagguauauacgcauaccuauuuucccaccugcaccccaccaguaacuuuuguugcccuuucuuuccugaaaccacccugguccagaucuuucccauuuuucuucaccuugacuucuuaauaacauucagcaccacucagucuccuuccuuuuugaaacauuaguuucucuugguuuccaugccauucacaugcuuuugauuuuccucuacaucucuucuugggagaucucauucacuccugggauucaguuacugcauauauucuuaugucuggcauauuuaaaccucuaguucaaaucucuguucaucuucagucauccauauauguauaugaauguaugcacacacacacacuauauuaaucucuucucacauugcuaaaaugaaauaccugagacucagugauuuacaaagacgagguuuaauuggcucaugguucuacagcagcauuuuuauguuuacuguuugcauguuacuuuuuucagcuuuuuacuuucaaucugugucuuuauauuuaaagugaauccgcaagagaaaaaaaaucauauuucuugauuuguugcuguguuaucccaucugauaaucucuacauuuuggucggaguuuuuagaccauuuauaguuaauauaaguauugauaggauuguguuuaggucugcuauuuugcuauuuguuuucuauucauuucaucuguuuucuuuuuuuguugguuucuguguaccuucuuuccugcuuuauuuuguaucaguuuuuuuuaaagcauucugucuuaauuccucuguuagcuuuuuagcgcgcucucucucucucucuguguguguguguguguguguguguguguguguguguguuuuagggguuguucuagaguuuacaguauguaucuaaucuuaauuauaggaaccuugcaauuuuauguguacauuuaccuccuuaaugaaguugcuuuccuuaaauaugacguucauguuuucacauauauuguggucuuguuugcacauauauuacauuguuuuuaaucuucauguuguagaucucuaaauauauuguuuuuaauuuuugccuuauagaauuuuaaagaaauuaagaacagaaaauagauauagucuuuaauauuuauccuuauguuuaccuuuucugguccucuucuuccuaugauccaaguugguauuuccuuucaaacugaagaauguccuuaagcucaucuuuacaguguagaucugcuagugauacauucucuugguuuuuuaguaucuaaaaaauguacuuuuguaucuuuugucuccuuuuuucaaggagagcaucauuggauauagaauucuuaaagguuuuuuuuuuuuuaaauuaucggcacuuugaauauguuguuccagugucuucuugcuuccauaguuucugaccaauagucagcaguuacucuuugcuccuguauaacguauaauuuguucuguuuauuuucaaaauuuuucauuauugguuuucaguauuugaacuaugauguguauaguuaugauuucuuaguguuucuucugcuugagguucguugaaccucuuggauuuguaaacuaauguuuuccaccaaauuugggaaguuuuugguuauuauucaauuuuuucuuuagaucuuuguuucuucucauuuaggguuuugcugaacuguuucuuauugcacaaguuucaggcguuuuucauauuuucuucuguuuuucuuuguguccuauggacuagaaaauuucuauugaucuagcaucaauuucauuugaguuuuuccugcccccuccaaucugcuuuuaugccuacauuaagcuaauuuuuauuuuaguaauuauuuuuucagcuuuauuauuucuuuuuuuuucaguuucuuuuucucuuuugaaauuuccuguuugugcauucguuauuauuauauuuaauucuuugaauuuuuuuuuuuuuuugagauggagucuugcucugccaccuaggcuggagugcagucgcgcaaucucagcucacugcaacguccgccucccagguucaagcgauucuccugccucagccucccgaguagcugggacuauagacacccaccaccaugccuggcuaauuuuuguauuuuuaguagagaugggguuucacuauauuggccaggcuggucucaaacuccugaccuugugauuugccugccucagccaaccaaaguacugggauuacaggcgcgagccacugcuccuggcuuuaaacauauuuuuaauagcuacuuucgagucuuuaucugcuggauguaauaucuggcucugcuuagagucaguuuguauugacuuauuuuuucguccuaaguuaguuccacuuuucaaagcuggaccuuaaugauaauauguuguagugaaagauuauuuuacauuuguugaugauuuuugggaucuuuuaguuugggauuuuauagauuuuugguguuuguaaauaacccauuuucugugaaaucauuauuguagaaagauuuauaagaaugagaauugcauuauugucuugggauugggccuggauauuauaaagucaaggcauuauuuucuuuaauuucucaacuugaguaucgcagaugaaaaccuuuaucauuuggaauugaucucaguauaauauaucaaaguaaauugugauuaucaguuauuaagcaauugccauguaucauauaugguguuaagcaccuuauauacacauuuggauuaauccucacaauagccucaauauucaaauauuggaaauugagauaauuacccaucugaaucagguagcuaauaaguuagaacuguaagacacacugacuucagaguccuggcucuuuagguuuaugucgucuuaccuuccuuuuugguugcugucaugugguuuuaaagguuuuucuuauaauccuaauauuucucaugauuuuggaugauggguuacuggucagcuuggaugugcaguuaauagcauagcauaccauaugauuucauaguauaccauaccauuuuuuuagggcaaaaauuuagauuauuuucuauaacccaauucuagcuuuaaugauugccuuugguguugugguagauuaauauugauaauuuagaguaguauugaucaacauuuuaaaugucacaaaaugaauaguguuucuguuuaaucuuauuugcucuaugcaacagauagcuuaguuuuuuuaagaaaacgucuugaauuucuuuugaaaauuauauuucauauaguagauguuuaacacaugaguauccugggacauuugucugacaaacucucuuuauucagguacagccauuuaaggguccagauugaaccagguuacucauuagucucauuuuaccucacuuaucaucucauuuuuuaacacguauaucugccagaguuuucuuuguaaaauguagaaguuuuguuuuucaguguggaaaagccacuggcagugauucaaguggugucauugaucucacaauggaugaugaagagaguggagcuucacaagguacuucaauaguaauuguacuaagcaacguuuugauaccauuuuuuuugucuuaauacgguacaguauucuacaaagacagauguuuauggcauuaugcuugguuuauuuguguucuuuuuggaauggaaguuuuuuagauuagaauuuuaaaauuuggccaggugcagugucucacaccuguaaucccagugcuuugggaggccaaggcaggaggaucgaggcaagaggucaggaguuugagaccagcccgggcaaugcggugaaaccccgucucuauaaaaaauuuaaaaauuagcugggugugauggcaugugucuguggucccagcugcaugggaggcugaggcaggaggauagcuugagccugggagguugaggcugccgugagcuguguuuaugccacugcauuccauccugggugacagaaugaggcccugucucaaaaaaaaaaaaaaaaaaaaaaaaggauagaaucaaaucuuaaaugaguaugaacaauguguagaggaaaacagcaauuaagagaauauuguaauuuuuggaguaccucuguuuuuguaucuguuauuucacuugauccuugcaaaaaaauccuguaauacucauuuuagacuugaggaaacuuguuagccuuagagaaaacaauucagacucaguaagggucuugggaguaaaauccagcucuucugucucuacauuaaauguucuuuuucucucucuguuuauguuucagugcagauacuguauauauauguauucauuuaauuuuggucauuugaauuaauuucuuuuaucuagcauuauauaaauaaaaauagaaguaauuucuaaaaacguucacauccaaaauaauaauguucugaguuauaauauuuagaaacuguaaaccauauuccuaguuauucugcaguguuaauagguguuucaugaauauaaaguuccaugguuaaguauguuuggaaaaugcugaguuuaaaguuaaauugauuuuuuucuuaaugcagacuucucugagccuuuacuaugcuaauuuauaauguaaaucuccaagaaugauuuaagauauaaaguauuucucaaacuuacuuggcugugcaaaauaacguucagcuacauaucuauaaaacuggugauuauugcacauggaaaauauaauaucaugugcugaguuacuucuuauuaucuuaaagacauuacuuuuuucuaaaacacccaaauauuuuaaaaauaauauuuuggggaaucagucuaguugagcuuuggaaaacaaaaguuaaauagcuguacaacugauuauaugacaguaaagucgguuuuguuauuuaaaacugaauugagaaauguaugccauccuucauccggguugaacucaagccaguaugauuauucuuuaaaaguuucaaauuaucucuauugcuuucacuuaucucuauugcuuucacuaauuuuuaauagacagccaugacuauuauaauggaucccuaaagaaaaaaauaaauacagguuuuugagaggacacagguaggcuuaauucuggauuaaaaaguaaaguccuaaaaguuuguuuucagugcucucaccauuucccuagcauccaugccucauggggucuuuuuguugccccaccuuugggucugucucaaauucucacauuccuaaagcacacuguuuuccaauggcauuaaaguauccauuguuaaagccuuggguuuuauuuacauuuaguguggaauucuauaggacagaaauugauggggauuauuuuggauagaaggacuuuugggucacaaucuucauagugguuuccuguuuuuaagaguuuuuucugagaugcaaauauuuauuucauaggcuauugaagaccuuuuuugagauuagucauucuuugacuauuuuaaagacuauauagugaugauaagcaacuaucuguuaucaaagaaccuaaauaauuguaguaauugaaauucaagaucacagugaaaacucaucaguuuauagauauuugucuagaagaguguucuuccuauagguagguagauuauauauuuaugcaaguaaugaguuauucuaguugacauauuguacugauuuacaaguaagauuauuucugaauuucuguaaacgugaauuugaaucugugauagaaccaccagcaaauuacauaugcucuuaacucaguuuucaaaucagcaaaaauacacguaaguaaaauggaaauaaauuauucucuuagagguaaaugugacacacaaguggcaagcaaaaguaaaauuuguccauagaggaaagacuuguauuuccugauuuuuuucuugucagucauaauauuucacuuuuaacuaacagaccccaaaaaacuaaaucacacuccuguaucaaccaugaguucuucucagccugugucacgaccauugcaacccauacaaccagcaccgccucuucaaccaucuggggugccaacaaguggaccaucucagaccaccauacacuuacuaccuacagguaaauuuguugaaucauugaguagaagcuuugguuuugccuguagagaacuaugacuauggaguuaaguggaaagauaagacagaaaauuaauauucaucuuguuaauuugaggacuacagugcauguccuuuugaaggcaguauaacuuaguuuuucugacugucuuaagcagcggcacugguaaagaaugauuuuaaagaaaaguauauauuuauuuacuuaacauuauauaaauaaaaguggagguaauuuuaaaaagcauucacauccaaaauaauaauauucugaguuauaauauuuagaaacuguaaaccauauuccuaguuauucugcaguguuaacagguguuucaugaauacaaaguuccaugguuaaauaugcuugggaaaugcugaguuuaaagcuaaauugauuuuuuucuugaugcagacuucucugagccuuuacuaugcuaauuuauaauguaaaucuccaagaaugauuuaagauauaaaguguuucucaaaguuacuuggcugcgcaaaauaauguucaccuaauaucuauaaaacucuggugauuacuaaugcauguggaaaauaauacuauucugaguuauauucuugagaccagccugggcaacacagugaaaccccgucucuacaaaaaauuuaaaaauuagcagauuugucaucugccacagcaaauguucuguaaauggcagaaaugacuguaguuucucuggaagggauggauaugacuuauucugaguguaaccaagaaguuauaacugacugaucaaacaacaauuuuuaaaugugucuuaucuugaaauagcuuuaacuagucuaacacuaccaccaggaaucauaugcuugcuaccuuucaagaagcuguaaauucaaaauuuucaagauuuagccuguaucuccuaaacuguucagaaaccaaucaacaugguuugucuucuguauagcagcaguccauugcuugaagauuuaucugcacaguacuuauauaaguacucuucucauuaaggaaaacauugaauuuaagugggguuuuauccagugaaauuuauacuuaaaacaccagauaucuuguaggaaucaggauguuuuccauagugauuuagcaaacuauuuguuaauuaaccuuugaguuaugaaauuauuguugaugcagcaaaugugugguuguuuugguagggacuguuuagauuuguugaauuucagaaucuuagaugcuuaugcagacuuuccuaucaguuaaaauaaauuuuaccuuguuggcauuuccaggcaaaagaaugugccuaugugacuuuauuucugguguguagauuuuauauugguucucauauuucaauaccauuguucuaucuaaauaggcaguuauaaguaaguucaaccuugggagcuguauuaucugucuuucuuuacauuuauacaaaguuauaaugacagucaucaaaauuagauauuuuggaaggaaaugucauuauucaaacccaugggcaguguagauuauggaauggggaguaaagagaugaaaaaauaaauguucuuucuuguuaauacuuucuucuuucuucccguuucugaagacucacaucgaaaguuaguaucuguaaagacugaagagucuuuaguaaagaaaccguuuuaucuuuguuauagccaguauuuuccuccaacuuuauuuuuuuauaggacccauuuuuuccauaagaaaguagauugauuuguuacuuuuuauuauauaguuacuauguggucauuuguaagauaugauucuaauucagagaguuguuaacaagaaagugucacuaaaaaucauuauuauagauacaugcugucagugaauguuuaugacucauuuuuugauaaauauuuauuaacauuacucaaaguauuaaugcuuucuggaacauacaauaggaggaauaccagaguagagaagggagaagucuguuguuuaauggauuuuauuuacuguuuuaaaaaaagauagauugguucagcuaaacaaaaugugaauuauaauggucaaagagauagguuggcucacuugaaaaauaaaugugaauuaacaauagcuggucaguuucuugaucuuugggaauacaaaaauacucuuuuggauuuacacccccuugguagaaggccgagagggcuuaugauucuacuuugcuaagaacaauuaaaauuaggagguuuuucucuuuuaagucacuccuguggcaucauacucuuaauucugcaccuuuuuaaaaaaucuucacauugcuuauuaucuggucaaaccagagugggaagggaauuggaugugguggagauguucuuuuccucugaagcuuggauuuuaauauuauuaauguuuauuggcccuaucauuuuuaucuuagaagaucauaaaaggagacuguuauuucuguuucugucuuuauuaguuaauuagauuuuaugcaaagauaacugccauuuaauacuguuugcuuaacguagaauuuacuguauucuuaauaucuuuuucugccuugcauuagcuccaacuaccgugaauguaacacaucguccaguaacucaggugaccacaagacucccuguaccaagagcuccugcaaaccaccaggugguuuauacaacucuuccugcaccaccagcucaggcucccuugcgaggaacuguuaugcaggcuccugcuguucggcaggucaauccccaaaauaguaagagauuuuucuuguauauggccccaagauacauguaguucucuucagcauuuaguuggaauggcauauaauaauguuaaauuuugcaaaaauuucuuauaaugucauauuaaaaguauuguuauaaguucaagagaucuguacuacaacauagaaacuauaguauaguuaaaaucaauguaguauauucuugaaaauagcugauagagcagauuuuaaguauugucaccacacacaaaaaagguaaguaugugagaucaugcauaugucagcuagauuuagccauucugcaguguaugcauauuucaaacauguuguauaccauaaauauauauaauuuuugucaauuaaaaaauaguuuucaaaaaagaaauggcaguauaaccaaaacuaaucuauuauuauuuuucuucccuuaggagaguuaaacagagaaaauuguugauguauacuaguugauuugugcucugaguguugucuuuaauuuaacuuuauuuauggccuguauuaguauaguacacaauuugauauugguauauucucuacucuauuaagaaacaccuuaccuaguuagagugggaauggucaauugugauuuaccccagaugauggaaaucaugguaaaggauagccuucaaugagagucuuaaagauauggaaaguggcugagaaaagaagggaaaauguuaaagaaagcuuguaguuucuuguauauaucauauauuaguuacauacauauguuacaugcauguuacauauguagaugacauuuuaaaauuauauauuaaccacauguauauaagcaguaguagaauauaucacauaaacacaagcuuauauaaaagguauauuuaaacuuuaaaguaaagaaaaauaauaaaaugaacuacguaugaacucuucaucagguuaagaaguagaaauuuuucaguauccuguaaguggucuuguauuccugucuugacuacaucccuuuuccuuuccaucaaagguaaccacuguuccuacuuuucuauuagucauucugcuuuucuuuaugauuuugccaccaaaauugauaucauuuaaacauacuaggguucucuagaggacagaacuaacaggauaaauagauauauaaaggggaguuuacuaaguauuaacuuacaugaucacaaggucccucaauaggcugucugcaagcugagcaaggaaagccagacugaauccccaaacugaagaauuuggaguccagugucgaagggcaggaagcauccagcacaggagaaagauguaggcuggaaggcuagccagucucuccauuucauguuuuucugccugcuuuguauucauugacagcugauuagauugugcccaccagauuaaagguggaucugccuucuccagcccauuuucugccugcuuuguauucauugauagcugauuagauugugcacaccagauuaaagguggaucugccuuccccagcccacugacucaaauguuaaucucuuuuggcaacacccuaacagacacacccaggaucacuauuuuguauccuucaaucaaguugacauucaguguuaaccaucacaaguccaccccuugucaacuugaauccauacacaucuccucagaucauacauauucuucaaauaaagagaguaauaaggccauaauuaaaccuaacauaauacaacuauccuuuguacaaccggaaacacaccaauccccaagccaaauacuauuacauaaaguuaacaauacuuaaauguugguaggaagucaauaaaucuuauguuacgugaugaaggaaaaggaaauaaagauauuuucuuguacaaguguauacaugcacaaacauguuuuuagcaaaagaaggaggaaauacucaugacaauuacagucucugaguuggcaacuggucacaugguccuggcugguauugaugacuaccuucuucuacuacccauucuguguucucuuugccuucagcaagcaccucagcuggucgugguuuauuccugguggaaugacccaaaccuucauucuugaguauuuuuauugcugccuaaauugagcuauuauaguuuccuauuggccuuaaucacagggcaugguaauacuaagagacacccuaauggaucuccuguauuccaugcauacucuuccuuaccuccguuguggagcaguagacuaacuucuucuugguaguccgggacagucaccacaaccaacacuaacuccuucgcuagccuguugacuuaaagguaagaggagcccaaaguguccagguggcaaucuuaaguuccaguuuaauggaaucauuuugucuccuggugggagcguuccucccucuggaacuaagaccucuaggccagcagaaaguaaugucgcaggaacaggaagcaaaaauuuugcuaguggaucccuaggggugaaggugaguggugcuacuuccacuuccacccccugauuccuggacccaugaauccuggcuaugggagaaacagcaccauauauaauggaugcugauucagagcauacacggccuucuggagaacuuugccccagcccugcaaaauacugucaccugguugggguuguaauugugacuucaaaaggccauuccuuuugaaugcuucaggacaaaggggaacaugguaagaccaguggauuccaugagaacgagcccacugcugcacuccuuuagccauaaaaugagugcuuuggucagaggcagugcuguguggaaugccaugacgguggauaaggcauucugugaguccauggauaauagucuuggcagaagcauugugugcagcauaggcaaacccauaucuggaguaagugucuauuccagggaggacaaaccucuucccuuuccaugauggaagagguccaguauaaucaaccugccacccgguagcuagcugaucaccccgaggaauggcgugcuguaucgagggcucaguguuggucucugcugcuggcaaauugggcacucagcaauggccauagucaggucagccuugguaaguggaaguccauguugcugagcccaggcaucaccuccaucacugccaccauggcuaccuuguucaugggcccuuugggugaugacagggguggcuggggaaagaggcugagugguguccacagaacaggucauccuauccacuggauuauuaauauccuccucugcugaggucacccguuggugagcacucacaagggauacaaauaucuucauaguuuuuguuacaacccauaaauauauauaaucaugcaucuggccaucuacccuuccaagcaaagugcacaacuaggugugcugcuugaaguucugccaacugggaauauuucccuucaccgauguccuucagggauguccuagaaaggggcuguagugcugcagcugugcacuuuacaguggugccugcauauggugcagaaccaucugugaaccaggcccuagucaucuguuccgcugucaagugaucauagggaccccugugaggccaucaguacaggcuggggaagagaacgcagcgugacaggaguggagauaugggcauuugagccacuuccucauguaaauuacuugugccuucggaaccugcuugagcccaaucacguauauacugcuuccauuugaugauggaaugcugcugugcaugacccgcuuuauggcuaaaugggucagaaagcacccaguucaugauagucaucucaggucacauggugacuugaugacccauagucaaauguucaguuuccaccaaagcccaguuaacaggccaagagcugucucucaaaaggagaguaguuaccugcaaaagauggcagggccuugcuccaaaauccuggaggccuccacugugauucaucugugggguccugccaaaggcucucacagcaucccucucugccccucacaccucaagcaccauugaaucugcuggguccuaugguccaaguggcagaacagcuugcucaguagcauggaccuguugcagagccuucuccuguucuggaccgcacucaaaacuggcagccuuucaggucacucgauaaaugggcuggaguaacacacccacaugaggaauguguugucuccaaaaucuaaaucggcccacuagauguugugccucuuucuugguuguaggaagggccagaugcagcaacuagucuuucaccuuagaaggccccacaccacuggacccuagaaauuuuacugagguagaaggucccugcauuuaguaggauuuauuucccauccuauggcacacaaaugucucaucaguaaguucaguguuuuugcuacuucuugcucacuugauccaaucagaauagugucaucaguguaauggaccagugugauaucuuccaggagcaaaaaccgaucaaggucucucugaauaagauuaugacacaaagcuggagaguugauacaccccugagguaagacaguaaagguauauugcugucuuugcccacugaaggcaaauugcuucuggugggccuuauggacagaaauggagaaaaaggauuugccaagucaauggcugcacaccagguacuaggagauguguuaauuuucucaaggaaugaaaccacaucugguacagcagcugcaauuagagucaccacuugauuaagcuuacaguaauccacugccauucuccaugauccaucugucuucugcauaggccacaugggagaauugaauggggaugugguggcaagcaccgccccugcaucuuucacguccuugaugguggcacuaaucuccucaguaccuccagguaugggauauaguuuuugauuuacuauuuuuuagaggcagcucuaauggcuuccauuugaccuuucccaccauaguagcccucacccuaccagucaaggagccaauguggugguucugccagcugcuaaguaugucagugccaauuaugcauuuuggcacuggggaaaugaccacaggaugaauccaguaauccacuggacccacuguaagucagaccugagauaaaauuccauuaauuaucugaccuccauaagccccugcuuuaacuggaggaccacaaugaugcuuugggucuccugggaucaauguaagcucagaaccaguguccaguagucccugaaaugucuggucauuucccuuuccccagugcacaguuacccugguaaaaggccagagaucuccuuggggaaggaugggagaaagauucacugcguaaauugucaggaauguaguggggucuuuccucaaggggacgaggccuccccuucauucaagggguucuuggucuguaaacuggcucaagucuagagauugauugagggguuauaauucucuuuuuauuauucaauuuagucuuuuguuccauugaccuagaaguuuuuugguuauauaaauuaaguaggaaugcaguaggcuuccuaucaguuucaucucuaggaacacugugauuaauuauccaaugcuagagcucuauacaagucggacucuucuaacugccacuuugccucugcuguccauuacgguagcuacgcccaccuugccuuugacaguugagugccaccacuuggccccugccaacuuaggauccaguuauuuccauuguauuuaaauuuuguaguucagugacuaagguucccaccguuagaucugacauacagagacgagcaauuagagggcucuucaaagauacaagugcugcccucacaaaucuguuucgcaaggcauuggucaaggguauaucuucuggacccucccagcugggaugacuagcucuaaagugacugauucacucuaccaucccaaucuccuuagucuuuggaucccuuccucuacauuaaccaagggagauaaaucauuuccagcucacucacagugugccaucuuuuaauccuuauuucaacuaaccaagcaaauaaucuauuagaaccuuuuuuuuuaacucccugagcugcaacauuaaaugcagagucccuacuuagugggcccaaaucaagaaauucagccugauccaacuuuguuccuuccaucauaaucuuauacccuuaauauccauccccaugccuguucucuagguuucuguuuauguaaauuagagaacucaaaacaguucucugaguguagcauaccuccuuauaggucacaccuucaaccucaccucuaggggcccaccaguacuuuaguguaguuauacaucuagaagcaaagagagguguuuggaggggcuccugagaagagucaacauugucuuaccuggcaacugccucagaggaggccaucacuguugccucacauaucacaggcuuuauuuccucagacaaaguuggaaagacugauggcagcauggaucagggaggguacguugcccucacuggguguagggaagcuguuccaaucaauacccucacuuuaacuguagacaccuggugagucugguacaugccucuuuuguuguagguuagccaauuguaugauaagagcuugugucuguuuuucuacaauuucagcucuuucucuauaggagauaacugucucucacucaaggcagucuuagcagauuucaggcucaguauuugcuucagaagccaggagacagaaucccugaguucaucauuuucuuuuaucacuuuguccacugaacuuaggaggaaccgaccaguuucauuauguuccuugguucuccacauaugguccaagguaucguguauagagucccuaaacuccuugcuucucacaaguggugauucaggagugucaaaugcauuuauuuugcauaacucucuaaacaguucaugccagguacuaucaguguucuuuauacuacuagaaguagaguccuuagcauuugugggucuaaucauauuaagcagccaacuccagaaaccccaaaaucaaugaaagaacuccauccuuaauauucgguucuucuagacccccaauccugguaccaaaaucugaauuaggguucucuaaagggacagaacuaauaagauggacacacacacaugcacacacacacguauccuauaaauuuguagauauaguauauuuuuauauauaucuauaguauaaagaguaguuuaugaaauauuaacacgaucacaagaucccacaauagucuaucugcaagcuuaggagcaaggaaagcuagucugacacccaaaaacagaggaacuuggaggccgauguuucaggguaggaagcauccagcacaggaaaaagauguaggcugggaggcuaaggcuaagccugucucuccuuuucacguuuuucugccugcuuuauauuuguuggcagcugauuagauugugcccagcagaugaaggguggaucugccuuccccagcccacugacucaaauguuaaucucuuuuggcaacacccucacagacacacgcaggauuaauacuuuguguccuucaauccaaucaagugacauuuaguauuaaccaucacaagucuaccgcuugucaaccugaacccauauacaucuccuaauaucauacgcagccuucaaauaaagaggguaauaaggccauacuuaugccuaacauaauacaauuauccuuuguacaaccagaagcgcaccaauccccaagccaaauacuauuacauaaaguuaacaauacuuaaauguugauaggaagucaauaaaucuuaugucacaugaugaaggaaaaggaaauaaagacauuuuguuuguacaagugcauacaugcacaaacauguuuuuagcaaaagaaggaggaaauacucaugacaauuacaguccccauuucugcaacuggucacaugguaguagcugguauugaugacuaccuuuuucuacuacccauucuguauucucuuugccuucagcaagcaccucaucugguagugguuuuacuccugguggagugaccccauccuucauuccugaggggucugggccauuuuuagugcugccuagauugggcuguuauaguuuccuguugaccucaaucacagggcaugguaauacuaacagacgccuuaauggaucuccuguauuccauguauacucuuccuuaccuccauuguggaacaguagacugauuucuucuuggcaguccgggacagucaccacagccaacacuaacucccuuguuagccuguugacuuaaagguaggaggaucccaaaguauccagguggcaaucuuaaguuccaguuuaauggaaucauuuugucuccuggugugagcguuccucccucuggaacuaagaccucuaggccagcagaacguaaugucgcaggaacaggaagcaaaaauuuugcaaguggaucccuaggggugaaggugagugguaccacuuccacuuccacccucugauucguggacccaugaauccuggcuaugggagaaacagcaccauauauuggacgcugauucagagcauacauggccuucuggagaauuuugccccagacuugcaaaguauugucaccuaguuggcauuguaauugugacuucaaaaggccauuccaccguucuguaaauccagcugcuucaggacaauggggaacaugguaagaccagugaauuccaugagcaugagcccacugcugcacuuacucagccguacagugagugccuugguuagagucaauguuguguggaauaccauggcauucugugaguccauggauaguagucuuggcagaagcauugugugcagcauaggcaaacccauaucuugaguauaugucuauuccagggaggagaaaccucuucccuuuccaugauggaagagguccaauauaauuaaccugccaccagguagcuagcugaucaccccgaggaauggcaugcccgagcgagggcucaguguuggucucuucugcuggcaaauuggguacucggcauuagccauagucacgucagccuugguaaguggaaguccauguugcugagcccaggcaucaccuccauuacugccaccauggcuacuauguucaugagcccauugggcgaugacacggguggcugcggauagaggccgaaugguguccacagaacgggucauccuauggacuugauuauuaauauccuccucugcugagguuacccauuggugagcauucacaggggauacaaaugccuucacaguuuuugaccacuuaaagagguccaugcccagagcucuuccccaaauuucuuugucaccaauuuuguaaugaugcuucuuccaagucccugaccauccaaccaaaccauuggcuacagcucaugaaucuauauaaucacacaucuagccauuucucuuucuaagcaaagcacacagccugaugcacugcuccaaguucugcccacugagaagauguuccuucacugcuguucuucagggauguccuagaaagggacuguagugcugcagcuguguacuugccgguggugccugcauauggugcagaaccaucugugaaccaggaccuagucuuaaucuuccacugucaagugaucacagggacuccccaugaggccauuggugcaggcuggggaagacaaggcagggugucagaggggagacacgggcauuugagccacuccucauguaaauuacuucugccguccgcaccugcucgaacccaaucacauauauaccacuuccauuugauuauggaaugcugcugugcaugacccacuuuauggcuaagugggucagaaagcacccaguucaugauggucaucucaggugacuugaugacccauagucaaauguucaguuuccaccaaagccccuuuaacaggccaagagcugucucucaaaaggagaguaguuaccugcaaaagaugacagggcuuugcuccaaaguccuggaggccuccaccgugauucaccuaugggguccugccaaaggcucugacagcaucccucucugccccucacaccucaagcaccauugaaucugcuggguccuaugguccaaguggcagaacagcuugcccaguagcacggaccugcugcagagccuucuccuguucuggaccacacucaaaacuggcagccuuucaggucacuugauaaaugggcuggaguaacacacccacaugaggaauguguugccuccaacauccaaauagguccacuagacguugugcuuauuucuugguuauagaaagggccaaaggcagcaacuagucuuucaccuuaacaggaauguguugacaggccccacaucacuggaccccuagaaauuuuacugagguagaagaucccugaauuuggucagauuuauuucccauccucuggcacacaaaucucucaccaauaaguccaguguuuuugcuacuucuugcucacuugaucaaucagaauaaugucaucaacguaauggagcagugugguaucuugcaggagcaaaaagugaucaaggucucucugaauaagauuaugacacaaagcuggagaguugauacaccccugagguaagacaguaaagguauguugcugucuuugcccacugaaggcaaauugcuucuggugggccuuauggacagaaauggagaaaaaggauuugucaagucaauggcugcacaccagguacuaggagauguguuaauuuucucaaggagugaaaccacaucugguacagcagcugcaguuagagucaccacuugauuaagcuuacaguaauccacugccauucuccaugauccaucugucuucugcauaggccacaugggagaauugaauggggaugugguggcaagcaccgccccugcaucuuucacguccuugaugguggcacuaaucucaguaccuccagguaugggauauaguuuuugauuuacuacuuuuuagaggcagcucuaauggcuuccauuugaccuuucccaccauaguagcccucaccuuaccagucaaggagccaauguggugguucugccagcugcuaaguaugucgaugccaauuaugcauuuuggcacuggggaaaugaccacaggaugaauccaggaauccacuggauccacuguaagucagaccugagacaaaauuccauuaauuaucugaccuccauaagccuguacuuuaacuggaggaccacaaugaugcuuugggucuccugggaucaguguaagcucagaaccaguguccaguagucccugaaaugucugaucguuuccuuuuccgcaaugcacaguuacccugguaaaaggccagagaucuccuuggggaaggaugggagaaagauucacugcauaaauugucaggaauguaguggggucuuuccucaaggggacgaggccuccccuucauucaagggguucuuggucuguaaacuggcucaagucuggaaauugauugaggggucaucauucuguuuuuauuauucaauuuagucuuuuguccauuugaccuagaagcuuucugguuguauaaguaggaaugcaguaggcuuccuaucaguuucaucuuuaggaauauugugauuaauuagccaaugccagagaucuauacaagucagacucuucugauugccacuuugccucugcuguccauuaugguagcuaugcccacauugccuuugacaguugagugccaccacuuggccccugccaacuuaggauccaguuauuuccauuguauuuaaauuuuguaguugagugacugcaguucccgcuguuagaucugacauauagagucgagcaauuagagggcucuucagagauucaggugcugcccucacaaaucuguuucgcaaggcauuggucaaggguauaucuucuggacccucgcagcugggaugacuagcucuaaagugacugauucacucuaccaucccaaucuccuuagucuuuggaucccuuccucuacauuaaccaagggagauaaaucauuuccagcucucucacagugugccaucuuuuaauccuuauuucaacuaaccaagcaaauaaccuacuagaaccuuuuuuaacucccugagcugcaacauuaaaugcagagucccuacuuagugggcccaaaucaagaaauucagccugauccaacuuuguuccuuccaccauaaucucauacccuuaauauccauccccaugccuguucuucagauuucuguauauuugaauuaaagaacucaaaacaguucucugaguguagcauaccuccuuauaggucacaccuucaaccucaccucuaggggcccaccaguacuuuaguguaguuauacaucuagaagcaaagagagguguuuggaguggcuccugagaagaaucaacauugucuugcauggcaacugccucaggggaagccaucacucuugccucacauaucacaggcuuuauuucuucagacaaaguuggaaaggcugauggcagcaugggucagggaguggauguugccacuacuggggauggggaagcuguucuuucuggcaaaaaagcuucaucagaauuuacaaacucaguguccccagcuucaucagggugcuucuacacacccccauuccaaguuucagggucccauucuuuuccagucagugcccucccuuuaacaguagacaccuggcaaggcugugcauguaucuuucauugcaggucagacacucgcaugauaagagcuugugucuguuuuuccacaacuucagcgcucucucuacaggagauaagacucucauucagggcaaucuuagcaguuuugagccucaguaucuucuucugaggcugagagacagaauccuugaguucaucauuuucuuucaucacuuuuuccacugcacuuaggagcaacugaccagcuucauuauguuccuugguucuccacauaugguccaagguauuauguauagagucacuaaacuccuugcuucccacaagcagugaaucaggagugucaaaugcauuuauuuugcauaacccucuaaacaguucacaccagggacuaucaguguucucuauacuauuagaauuagaguuuuuaacauuuuugggucuaaucacauuaagcagccaacuccagaaaccccaaaaccaaugaaagaacuccauccuuaauauucuguuccucuggaccccauuccugguaccaaaaucugaauuaggguucucuagggggacagagcuaauagaauauauauauauauauauauauauauauauauauauauauauauauauauguguguguguauauguauauauacacauauguuuccuauauauaguauucauauaauauauacuauauauaaacuaauaggauauauauauuuuauauauuauauauguauuaaacuaauaggguauauacauaaaauauauacuacauauaaacuaauuguauauauacuuuauauccuacuauauauauacaguauaucuuaauuauauauaaauauuaaauauauguaaaauacuuuauauauagugaauguuuauauauauaaaggggaguuuauuaaguauuaauuuacauaaucagaaguucccacaauagacugggcaugguagcucacgccuguaaucccagcaguaugggaggccaaggcaggcagaucacuugaggucaggaguucgagaugagccuggccaacaucgugaaaccucaucccuaccaaaaauacaaaaauuggcugggugugguggcacaagccuguaaucucaccuacuugggaggcugaggcaggagaaucucuugagcccaggaggcggagguugcagugagccgagaucaugccacugcacuccagccugggcaacagagccagacucugucucaaaaaaaaaaaaaaaaaaaaaaagaucccacaguaggcugucugcaagcugaggagcaaggaagccagucugagucccaaaacugaagaacuuggaggccaauguuccagggcaggaagcauccagcacaggaaaaagauguaggcugggaggcuaaggcuaagccugucucuccuuuucacguuuuucugccugcuuuauauuuucuggcagcugauuagauugugcccaccagaugaaggguggaucugccuuccccaguccacugacucaaauguuaaucucuuuuggcaacauccucacaggcccacccaggguuaauacuuuguguccuucaaucuaaucaaguugacacucaguauuaaccaucacacauauguuguaguuuugcaaaaugugacagcaagggaaaauauagcuauuuaaagaaacacaguaaugcuaucauuuagaaaauaaacugauuggagucccuggaucauagcuuggcuucaacucucucaaguuuacaagagcguugucugggaaaauuaaucaacaagguuagaaaugaguucugggaaacuuggcucacuauaguccaggaaccaggccgaacuacagcaugggccagguacugaauaaauggcaggaauauaguuagggcaguagguggcucuaaauuuucucuuuuuguuucccugguguaugucacagcaguuuucuguggggugaagugaguauccucaaccaaggagcugggcauggagaaaaugagaggaaccucauuaauacauggcaaggaugacuuauucuggcuuucuguccugguugaaaagaugagacugcagagauuuuuaugaagauacucccaguuugucugucuuuugagucacacugcuccauuauggccauuuaccuuuuacaugugguacacaaccaguguucuaggauuuuuguucauaguucuccugguaacgauccauuuauuucucccugugcuggaccuccuguugcuugugucucguguuuuucucuuuauuuucucacguacugguggcacauauucuccauugacuauuugagaaaggguuugugguaguuagaauuuuuuuuuagugcuugcauguaagaaaguuuuuuuauccacaggcugauugauagcuuggcugaauacgaacaggaccucuagguuagaaauaucuuuccuuucgaaucuugaaaacauugcuucacugccuucaaauauuuaaucaguuuuccaccaaauuuacaauagaauuaucauuuuauccuguaauuuuuuuguuuguuuguagguguuacaguucgagugccucaaacaaccacauauguuguaaacaauggacuaacccugggaucaacaggaccucagcucacagugcaucaccgaccaccacaagugcauacuguaaguguugaugcuugguuuugcaaaauucucaacuguagagguauaaaauauuauuguauuuggcauuuuucuuuaaaaugguuauauccaagggaaguguuaggucuuccugcuuuuucagaaguuuauuucuaaaaauugaucuuaccauuaugaacacauaguuccuagggaugaugaucauuuagaaucauugaguuugcuugugguguacaguguacaaaaacagguccacaguugggguauaugaagugaaauauagaccauuucuaauucauaguuaaauuaaaaaggacauuuuucauuucuccauguguuaauuuuauucuuucguucuaaacuaugccacaucuaacugcuacauugucaucaauuaauuguucuaaagaauccaaugauauugggaauucauuaguuaagagguaacagagauaaccaaagauuucuccuuagauuuagccuccaaaacaaugucacauuauccugugacacaauuuugucaguguuugacugguaugaaauaucauuauaaugaugaugauguuccaguguuagaaaagucaauaggacuuccuaaaguuagagucauguuuuuucaucaucuggccuuaaccuaccuuuccagauuuuucuucauguacccuauguccaagaaaaaguuaauacuuguucuuguccauacguccccucacuuuacuguccacaugccuuugcucaugcuuuauuuuuggcugaaagguacaugauuauuucugcaucucuggauccuccuucacaguugaguuuaaauaucaccuuuuucuuguaaauuggccaagaauauaguacacauuuaguguuaaugugcuuauuuauaaauaacuuaaaaaugaaaguauauuuguauucuccaauuuuauaugaucuugguugccauacaugauauuuaaaaauguuacaucauacugaaaugauaaucuguaacauagauaauucaaucauaaauuauuuuguuagaaauagaucauuacuuccguguuccucaaaaugauguuccgucagcaggggcuuuuuauuuccuaagaaaaacucaaaauauuuuaggucuaggaaguauaguaggaauaaccucagcaucauuguuuguagcaugauucauuacaaaaccccaaauagaacuugccaaauuugauaugguauuugguauuuccuagaauucuugauauaaaaugauacuucuacguauguucucuaagguguuuuaauucuaacauucuaaaauaguucuuuuugcaaucaucauuaaucagugugaccuguuucuucaggagcccccacgccccgugcacccagcacccuuaccagaagcuccacaaccacagcgucugcccccagaagcugccagcacaucucugccucagaagccacacuugaaguuagcacgcguucagagucaaaauggcauaguacugucauggaguguccuggagguggaucgaagcugugccacuguugauagcuaccaucucuaugcuuaccaugaggaacccagugccacugugcccucacaauggaaaaagauuggggaagucaaggcacuucccuugcccauggcauguacucucacccaguuuguaucugguagcaaauacuacuuugcaguacgagccaaggauauuuauggacguuuugggccuuucugugauccucagucaacagaugugaucucuucuacccagagcaguuaaaccuuggagccuuuauauuuuccucuuuuaaaauuuccaccuuuuggucuuguuuuuaaucuugugcaugauaccccauguaaaauccaccuugugcaagauuucuuggacagauguguguauacacuacauuuguuuauaaccagaagcaaaauaaacucagcccacaaagcuagaaucuuuuccuggacaguuuaggcuuugggguuuggaaauguaaauguguaccuugcuuuaguuuugaggcuggggaauauguguggguguuuauguguguuuuuccuuauguagguguuauugcauuggagucucccauuuucauucucaaauuuaccucuuaaaguacgaaguaaguagaucaaaggauuugagauguguaacuggcaugauucugcuuuugaaggaucuauaguaucauuuuaguuaagugggucaaacagaaucaaaacaaaacccaaagaaauaaauaaaaaacaaaauggcuaaauaguuuaaaauagguuaauucgaacacaggaaaggaucuauuuguuguuucuuuugucuggucuccugaguuguuaauuaggugaaaaaagaucugcaauggcccccucccuuuccuaaucuggcuuuuacauuuauuuugugccuuaaagauuaacuacaaagauaaacauggccaaaaauaaauaaauaaauauggccaua

SEQ ID NO: 191703 - RNA, 126130 nt, Homo sapiens
cccgggcccgcgacuccgccccgggagcgggcaggggcggggcgagcgcuccagcuggcgggaaggaggaagggccgggcgcggcgcagaggcgggcgccuaccagccggcagcuccggagcugcccgcgccauguccgcgcacaaucggggcaccgagcucgguaaggggcccgcggggcuccccauccccucucccucgcguucagcgccgccgggacuagcgcggggccugcugccgcccagugcccuggcuguggguccccgagggguuuucgcuggggcgggaagcaguggcgucuggucagcccucaccccaaguaaaggccgaacccggcacguucgcgccgcuugucuuugcaccuaagcuuuuacucuuguaugcggaaggaguaggaaaggguuagauuauuaucuuccugccuuuucguucacucuagcucgcugguuggaaaacccaacaacccaaaaaacaaaacccaaaacaaacaacccccaagcagguaaaaacagauaaaaaccuucuuucuccuccuuuuaauagaauacuuguguaauuuaaugcaguauuuccguagauaauuuuaaccguaaccuugaaguggccgugcucguggaaaaguugucagccgucugugcucaaaauguaacacugcagauucaugggauuuuagaguuacaaagauuuguuaaaguaccuguauuauuucccaguuuucaucuuuuuuuauauuguucaaauacuggcaagaaaccuuaguucagauuucuuuuuuuuuuuuuuuuauugaucauucuuggguguuucucgcagagggggauuuggcagggucauaggacaguaguggagggaaggucagcugauaaacaagugaacaaaggucucugguuuuccuaggcagaggacccugcggccuuccgcaguguuugugucccuggguacuuaagauuagggaguggugaugacucuuaacgagcaugcugccuucaagcaucuguuuaacaaagcacaucuugcaccgcccuuaauccauuuaacccugaguggacacagcacauguuucagagagcacaggguuggggauaaggucacagaucaacaggaucccaaggcagaagagaauuuuucuucagauuucuuaacaugugaaaaauuuauaauucaaacagcaaaaccaugaucaagagaagguuuaagcgucucguuuaaguauuauagcuuggauaucuguguauccaggaucuuuaacuucuuaccugugugacuucggacaaauuaauaacuuugcgcuuaaguuucuucaucuguaaaaugguuauuuuagugguaguuaccuuauaaggccguuaggagauuaaauaggauacauguaaaguaguuugguauauuguggacaccuaguaagucuucaguauagauaguauuaguauauggaguuaugguuuuaggggcuaauuuugagaaaauuggcuguaaauuauauguaacacauacagguagguccuuuucgcccuccuuaaaagugacugguacuuaaacagucugcacuuccaagagguguucuggauuuuuugucgaaugguaagagaguaaaucuaucauuuuaaagacaguugauuuacuaaccugguugauuuuguuuuagucacuguccucuagcugauuauguuuuaaacucuaguccuaucucuggaacguggucuuuaguaauaacggcauuauuucuuagauuggaauauccuugaaggugguggauauggggcagguuugggguggugucuuaccuggguauucccaggaauaugaccaugugacuaugcauacaucaaggaugugcccuaaauuucccaaaacuuagacauuuuaaauuuuucuuucaaaaaacauaauugaaccauuuuuaaauuuauuuauuugcaguaauuagaaucaaucacuuccauucauuuguugaaaaguaauagacauaaauaauugccagguagaacaauaguaaaugugguuuuuaugcagcuaucgaaaugaucauagcuuuguauuuauuaucuuauuuguuaaaaucagauuuuuuuccuucacggguauuaauccuuaauccaaacagguuuaaacugaaaugcuaaaauaaguuauuugaauuagguacuagggaaaaaaaucuuucaguauuaauuuaugcaguauauuaacugaugauuuuuaaaauaguuuucuaauugaaagucuuuuuaauaaacaucguaacuaauuucuaaaauaaauuaacauuuuugcuucccuuuucuuauuacaaaaggaauucaugguuauuguaaaaauucuagaaaauacaguuagcacaaaaauguuguaauauuauuacuaguccaaucacuguuauuuaugauuugguguauguacuucuaguucauggacuuaaaaaaacauugaguuccuuugagacuaaaccugacccucaugauuaaaaagucuuuaaggaaaacauuggcauuuggauguaugaaagauguuuuccaaauagggaauguacccucuagcuuucauauuagaggauggggcccagcauucugaguuuuaacaaauccuguggguaguacugaagcauacccaaguuugagaaccaauggcuuaaugaucuccaagguacuaucaaguuuuguaccuagacuauuaugcccuauauagucuauuaaaauguacagauauucuucuauuuuauuagaugccacuuaacuauugccuaaaaugcaggugucacguggguagugaucuuucuuuuguucacugaugugucccaaguaccuagaauaguguuugguacacagaaggcccucaaaaaugucuugaggcugggcaugguggcucaugccuauaguccuggcacuuugggaggcucaaggcagccggaucacuugagaucagaaguuggagaccagccuggccaacauggcaaaacccuaucucuacuaaaaauacaaaaauuagcugggcauaguggcgcaugccuguagucccagcuacuugggaagcugagguacgagaaucgcuugaacccagagaguggagguugcagugagcuggaauugugccacugcacuccauugggcaacagacuggagacagacugugucucaaaaaagauaaaaaaaaaaaaaaaaaaagaaaaagucuguugaaugaaggaaugaauugagagcugcuucuuacuugggggaacuggggaaucuaccugguccccguguaugguugcauggacagaugcugugaagcuuggcaccuucuuccucuuuguaaguauuauuaagauucaguuuuguuacauccgucuucagagcuaucucaagaagccuauaaaggauguagauaguguaacuuccuugcaaauguuaucuuuggaggcgucuggagaaugcggguguuauuagaugacuucuaaggaucucccugcucugucucugugugucugaaaacucuucuguucaaaaagcaacauuucaaagauaucugaaaaauaaccaugaugggauuuuguauuuuuuuucgagacagagucucccucuguugcccaggcuggagugcgguggugugaucuuggcucacugcaaccuccgucucccagguucaagcaauccuccugccucagccucccgaguagcugagauuacaggugccugccaccaagcccggcuaauauuuuuauauuuuuaguagagacggguuuuugccauguuggccagguuggugggauuuuuuuauuuuaagaagcacauuuauuuagguaguuauugaguaccaaucuguacuggguaguauuacccuaggcuggggguacaagauaaucagggauggucacugccuucacagagcuauuaaucggucugguucaggaccuggacaucaagcuagagcuacaauuaaaugcaagugugaugugcaauuauuuuucauuuauuuuugucuaaaauuagauagauguaccuagacugugcuuuaaauggguugugaaaacagaauguccugggccuuuugcauuauaauuuuuaauuuccuuuuaaaagaaccuaugaauuagggauuuagggagcucauuuuuggcauuccugcuaaaguauaacuuggguacagaauguuucugauuugggugauggugauuuuccacugcaaaguuaacguuuaauuuuuggaauggauauuuauuuauuuauuuguuuauuuauuguuucaauagagaccgugugucaguauguugaccagacuguucucaaacuccuagccucaagugauacuccagccucugccucccaaagugcuaggauuauaggcaugagccaccgugcauggccuagaauggcaucuuaaaccucaacaauaggcaaaggcuaucuguuugcauaauaauucuucaccuuauuuaauaccuacugugugcagacacugugcuuaggugcuggguauaaugauagugucaacacagagcucuagcuacuuguaaggcacuaugcugaaugcuugaaauucucauuuaguccacaauggcccugugagggagauagcaugauccagguuuacacacgagcaaacugagguacagggaguuuuaaguaaccugccgaaaaccaguuagguauagcuaauguggcagagccagaauucaagcccaggugauuuggugcuaauaaugcuacaugcuuaaacaaccacacugugucgacuggugcuaacugggagcacuacacccugaugucagaagagucaaauagauaacuggugaauacuguuaauguuacucuuuuagguuugauuugucuguuuaaaacauaaagguuacuguuuuauugccauaacccacaucuuaaccauugcaguuuguuucagagaagaugcaauuuauccugagggagaauggaaaaguccaaacuuugguagauuaugagaguaggguucgauguuagugaaguuuucaaggauggcaugucaaaaccagacuuccucaggaacugcuucauguggauauacugaugagccucagagcaucaugugauggugaccagggagugaccucaaggugaauagaguggggcuuuucuuuguguguguguuuguuuucgucucuugcaguuuuguaaaacguuaccuuucauacuccagucuuugggcuggccucagcuucuagguuuaaaaaccaauacuguuucuuuuuuuuuuuuuuuuuuuuuugagacagagucucacucugucacccaggcuggagugcaguggcgccaucucggcucacugcaaccuccgccucccggguucaagugagccuccagucucagccuucugaguagcugggauuacaggcaugcgccaccaugcccagcuaguuuuuguauuuuuaguagagaugggguuucacaguguuggccaggcuggucuugaacucuugaccucaggugauccaccugccucggccucccaaaguacugggauuacaggcaugagccgucgcaccuggcacaauccuguuucuugauguauucuuuuaaaaaauguuuaaaauaagagauggggucuugcuguguugccuaggcuggucuugaacuccugggcucaagcaguucucccucuguggccucccaaguggcugggacuauaggcuguagucaaugugccaggcucuuguucuuuagguuaaaaaaaauuaaguagaaauagugaaguauuugauaauuuuguuaauuuagagugacuuuuuugucccgaauuucuacgucuggaguuucucuuaguaguuuccugaaaaauagaacuggaaucucuuuagcuguaaacaagauaaacaguuuaaggaaucuaugggucacaagugagaagugaccuaauacaccuuacaaaguccccauauuucuuuuauugagauagaggccuuuaaauuuugccuuuaaguuaaaaaagucaauuccuagugaaaaaacaaaaacaaaaaacuaaaacauaaggcaguguauucuucauuagguggcauaugaaaauuugacucuagcucuuagcucaggugguaagagaauuuaaaaauuuuuagauuucugcagggaauuucccaacuggaguuaacuugagguuucuuuaaacaauaaaauugauuuguguaauuuuaaguuaauguggguuuuaugucugaaucuaauuuuuuucucuuuaauauuuaauacuuaacauacauauguuacuuuagauuucauagagugcuuuucuaacauaaucucuuuuaauucucccaggaauccauugugcuaggcauuaucauucucauuucauggaugagaaaacuaaggcucagaaaacacaaguaacuugcuuauuauaccucagagcuaguaagaguugaggucaagacucaaaugcagaacuucugauuacaaguuuuuuacccuuugcuuuacaccaacggucccggaccuuuuuggcaccagggacugaagugguuuuguggaggacaguuuuuccacagacugggguagggguggguguuucaacaagguauuucuggcuuaucuuauaauuucccuuucccagcaccaaagucagccaguucuccaggcagcauuuuuuucaguggauaacgauaugagaagccaagaucugagcacuagguaugcucauugugaugggugacucuguucccaaggcccucagcuggcagagcugaaaaauguauguacuguauacacacacacuucuagauucaucuaccuaucaucucucuguaucuacauagugaaaaccaugaguucacacuaauaccaccaguucugguccaacaccacaggauuuaucccaguguucucccuuuccauauuugaaacacuccacaugcuuccccuggccccagcagauguucuucucacuguucucaggcucugaccccugagcugggccucccuccugugagucugccuuccucaucccgcuggugcuuggucccccacagcaggcugcugccuacacaaaucucccuguuaccuuaguguggggcuguggaccucugugcccggccgccucgccucccucugcagguggauacccuccuuacccugcuugcgcuuccacucccuaugucuugcucccgcuuugugcagauccccuccuuguucugauuggacucugggcuaccccauucuguuuggcccacucugggccauaguggugcccccauuucaacccggcuugaaugacuacguuguucaccuccucuucagugccccaccccaacgguuuaggacaaucguuugggaaggggaagggggccagaauaauuuguuuuuuuuaauuuuuaaaauguaaauauauaagaauauuuuaaaaaccuuuauguggagugccugcuguuccuggcacuuguuacuugcugcucauggucauggcagggaugccaaggugagccugacuuggucucugcuuucccagagcucacaggcaacuaagggagauguuuauguaaaucaccacauacggcauguuaaaacugacaacaggaacguggugggauuggaaggauaaagacgaauucacagacaguccagggaggguuuuuuuggagaggauguuucugacggaguaguuucuacaaagggacuagcaaaagcagccuggcauguuucauuaacuauaggaacucaauuuucagguaucuaguguaaucuucucauuauacuauaauggcuaagaguaauguuuucaugaagaaagaaaaaaaauccuucauagccuaugugugaaauacauacacagagucaauaauuauguacauuuuagauuuuaacuggggcauccuuuugugaaugcuaacuacuuugauuuuaccuuagaagucuuuuacuuuuugcuuguaagcauaaaugaugaggcugucuuuuauuauugugauacuauuugauaaauagaaaaacuauaaaguaauaauuuggguuuguuguauaauuaaauaauuaaaaguccucugcggugccugcuaaguuaaaaaacauuuuuuuuuuuuuaaaaagcaucuaagcccgguggauuuugauuauuaggaaggaagaaaaacuucaagcacuuauuuaaaaugggaugcuucugccaggaaagaaagacuaguaaaugagacagcagacagagcccuugaggaugcgauuuaaacaugucaccagaaauuguuuaaguggagagcucuggcccuuuuaaaacacugucugucacuugaggauugggucaccuugaaauguguucaucuuuugaguuaaaggcauaaaaaggcacuuugaaauuuuucaguuaacuuugauguguguuguguaugugucuacgaauguacuucuccucagccugccucagcuguaacagugaguucccuagaaaccaaagugguugcaagggaaggauaaauguuuaaucuuggcuccagcaaacuauacagauuuuuuaaauguugagacacucuggcugcaacuucuggcucucuguauagucaggccuuccucccgcaaagcaaagucuaagacaagaguagcugcugguaguuauuuccuaaaaaggugccacuuaacuggugucuuuguucuuuuggaaggugguuaaugaugcuaaggucuuuaaagucuggaaaaauauccagauuaacugcucucauaauccagauucagauaagguuuucaacuguccgccuaauggacugccccacagccugagaaagaaaugugugugugugugugugugugucugugugugugugagagagaaagagagagagagggagggagggagagagacagaaaagggauuucauucaaaugucuaaaauuugacauugaacuagguaucuggccugcugaagguauagauagagacuccuuaucugugauguagagauucuugaauaaacauuaccucuuaugaauauuucagauacucuuuucuaggaaaauaauaguguccacacuuauaaggcuaccucuuuuuguuguuguuuuucaugucauggaauuuccuagcagaaaggcauguuuguuaucaguccaacccccuucuguuguggguaagaaaacugagaccuagggaaguuaagccuguagucacauggcugguuagagguaguccuggaauggaaauucaggcucugucuaugcugguuuagucuagcacguugcguuaccuucuuuuccacuaguuuaccaugagcuuggcugggcucugacccugccuuagaaucaccuaagacgcuuguuaaaaaacacagauuccugagccccacaauagcuuuaauuauuuguauuauggaagcugggcgugguggcucaugccuguaaucccagcacuuugggaggcugaggcgggcggaucaugagaugaagagauugagaccauccuggccaacauggugaaagcgcgucucuacuaaaaguauaaaaauuagcugggcgugguggcacaugccuguaacaguuccagcuacucgcgaggcugaggcaggagaauugcuugaacccaggaggcgagguugcagugagccgagauugcgccacuacacuccauccuggugauacauccggagcgagacuccgucucaaaaauaccccccccaaaaauaccaaauuauuuguauuauggggagaaagcccaugagucugcauuuuuauaagauucccagauagcucuuaugaaugaauacugcaggggcagaaccaugcaguaagcuguggaguagacccagguucagauucagagaaucuuuaauuacgagcuauuguuuuuuugauaaaucuuaugucauuuuuaccuuaaucuuauuaucuuuauauaucauauauuuuacacugauaagcaaaguuucucuaagcaaauauggaaagaaauaagccuuuuuauuugauugagauaagugaagaaauguguuaaagugaaugugaaggcauguuggaaacaucggggugacguagugaaguaagugcauauaucugaaaagugcacugugucugaaaagggacauacuuuauucaaaugaugccagugguuaguggaaggauauaaucaguguucuugaugauuuuggaaauugacauaaggauaucuucucuguggucucagagacuggaggagauagaccucuaaucccauuagcugaagaugugagauuaaccagaaagaguaauuccguuaauuuucugguagaaaaaaacauauucauguuuccuugagauuauggauuaaguuuguauuuuggacucagggaagaaaguagguuguaacaauuccuauuguauuuggugaaggagcucaagaucuguauauugugguauuuugagggagauuauuuuuucuucaguaaguagcaagaaacuuaagugcuucuaauaauuuuccaaagaggccaggcaugguggcucaugccuguaaucccagcauuuugggaaucugaggugggcagaucaucugaguucaggcauucgagaccagccuggucaacauggugaaacuuuguuucugcuagaaauacauaaaaaaauuaaccgggcuugguggcgagcgccuguaaucccagcuacucgggagacugagguaggagaaucgcuugaacccaggaggcagagguugcagugagccgagaucacgccauugcacuccagccugggugacgagcaaaacuccaucucagauaauaauaauaauaauaaauaauuuuccaaggaauaaacaagaaauguauuuuaguuuugugucuuuauaagcagaguuuuccuuuuuuaacuuuugacuucuuaggaggcaaucauuauuauaaucucaaagucauucauucagcauguguauguugaguacugugaacucaucacuguccaugucuuugugaaagcuauaagagcaauagaacuuaggagcccugcccuugagaagcuuaccuucaucaaauuuuaaaauauccccggggaaguacgcugccuuauucuugucaaggaaagcaaacuguggccaucaucaggauaugcacuugcccuguuugaaaugauuagccagucaacauuguauuauuaaccuuuagauaaucauuuaaaaaugcugugggaaaucucuugagcuaggcaaagaucucauauggauuuuuauuagugaaaacauuuccauagaucugucuccagcaagaaaaaaaucauaauuucagucugcagaugaaugcuauauuugacugaguguugcauuaaacuacuaauauagagaaauuuugggacacagugauuagcauguagagucuagaaaauaggcauugaugcugauaauacugaagaccgucugaaagaaaagcauccuagagaaaguucaguuguuuuggugcuugacaguaguuguuuuuacaggccaaguugaaauuagguauccuguggaaagaaugucagggaauguguaccugcccauuugugcuucauugaaugcacugugguuuaucugggaaggauacaggauugggacccaggcacuuuaguuguagaccugauagcaucuagcuguggaaccuugcgggguggggaggggcuucaguacauuggcuuguacuuuccaagucuguaaaacagacacacgagaauguagguucaucaguuguaagguuuauaccacucuggugggggauguugauaaugggggaggcuaugcauguguggggcaaagcuugugugggaaaucucuguaccuucuguucaguuuugcugugagucugaaacugcucuaaaaaauagugguuuuuguuuuugcuuuuuuuuuuuuuuuuuuuuuuugagacggagucucgcucugucgcccaggcuggagugcaguggcgcgaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuguuuuugcuuuuaaaaaacagacacagauuucugaaaacccuucugguucugaacuucauugagucuucugaucauuccuuaaaaugaccauuugguggaauuguaggucuagaauguucccugugcuugcaguucagaccuuuuccuuccuucucuggccagcauaaucuucucuggcuuucaaggcucugaauuccagugaucaguuuacauuuucagcccuaucucugaugacuagacacauuauauuuucucuuucucuagaucuuaagucaaggucucaugaauguauaccuugacuuaaaaauucuuaugugaacagagccuuuuauuuuguauucauuccucugcauggcagaauauugguuauagucuuccuuuuuuuuuuuuucauaaaaauaucuugugaauucaucucuuccucucuucuauucccuaggcuuggcucauucuaucacacaucugaaucacaaugguggcuucauagcugguuucuuuaccucugggcuuucucaucugccccuggaaaauccauauuugguuaaacuuuuucuuguuguuuuuucaaauagaacacauuuauucaucuccaauuugcuuuucugauuauuugguuucuucagaauguucuuucauuucaugaaaaguauauaaucuuaaacaaauuacuguauucucagucuuuaguugaagaaaauaauugaguuagugaguaacagccaaauaauucuauccagaaauauuugaaugauguuagccagguaagaauucuaaagacugaaaauagaguugucuauaaaauucuauuaaaauuauauaugugguuggguuagguggcuuaugccuguaauccuaacucuuugggaugcugcagugggaggaucgcuugagcccaggaguuugagauuagccugggcaauauagcagacuccaacaaaaaguuucaaaauuagcuggguguggugguaugccgcuauggucacagcuaccuuggaaacugaggcgggacaagguuacagugaugaucauacugcuguacuguagccugggugacagagcaauacccuguuucuaaaauuaaaauguauauauauaaaaguuaaauaauugaacucaguaaauauauuuuucacuguagagauuacaaauacaauauucuagaaauaacuuggguuuuugaauuauagagaucuguguuuccaucuuagcccugacaaguauggugugaccuugaacaaguaauuuaauaucugagcuucagcuguuuccuuaucuguaaaauggaccuaauggcuaccugguagaguuagugagacuauuaagugagauauauaauuaaauuaccuuuaacuugaugagugaucaauaaaugguagccauuauuguaauuccaaucgauccuauauugugaaaauacuuggcuuucaccauuucaccuccucccugaaggcuuacuuggucuccucugcuagacuuuucaacacugaucugcuaagauacuuugccuucuuuuaugguaccuaccaauuucagccuuguguuuuuauguucuaaugcugccuuauuaauaggcugcuugaggguaggaucugugcuuaucgggcgucuguaucacuuaugucaccuugaacaguacuuuucauaaugugaagacuuguuuucaucaguguuuguugaaugaauaaggaagcauugcuccccuugucugggaaguuagaauggccuuuuacugccugguguaccaagcccagacacuucauucucucucucuuugaagauccugggucauuuggccccauuccuguuacccucccacccccgagccccaaccccuuugcuguugucaggcugucuuggucuuuguucuuugggaauguugguccuguuuagaaugccucuugauguuaucugcucugcuauuggaaauuaucccuagccuugaaggugaagcuuaaauuccuucacuuucauaaacccuucucuuauuccucuuguuccuuaaguuuuaaugcuuaauuauuuuuuucucuguaaauuuucuucuuauuauuuugaacacaugccccuuaacaccaaagacaauaacuagaacauaaaaaaggccuaccuaucuguaaacuuuggagaacgaaucaauguggcagcuuuacucuuuuaagugugaaaaaaaaagauguuuaaaacuugaaccaucugggagugaaauuguucuaaaauuaaguaucuuuaaaaaauguuuuugccuaauuguaaagguauacauagauuaccuuuauaacuuaucuguaaauuaucaaggaaauuaaaauucacagauuuucaaggaaaucagaauugccuaguaucaucuccugaagaaguagaacuuugaagguuuagucccugugggaggugcagugcaauggggagaauuuaaucauuuuugcugacuuagaggaccuuacaagcaucaaagcugcuguguuuucaugcagugaggcccucaucaacuccugaggcuuuuuuuuuuuuuuuuuuuuuuugagacagagucuuacucugucacccaggcuggaguacaauggcacgaucucggcucacugcagucuccgccucccagguucaagcaauucuccugccucccgaguagcuggauuagaggcgcccaccaucacacacccggcugauuuuuguauuuuuaguagagucgggguuucacuauguuggccaggcuggucucgaacuccugaccucaggugauccgcccgccucagccucccaaagugcugggauuauaggcgugagccacuguaccuggucaacuccugaggcuuuuacagccacuuuccucugaucaaguggccaguacugcucuucuuuucugaggcacuguuuuuuuuuucuuuucaagaugaagucuugcuauguugccaaggcuugugucaaacuccuggcuucaagcaguccucccgcuucagccuccucaguagcugggacaacaggugugugccacugcucuuggcucacugaguguauuuugauauaaacuuuucgauuccuccccugugaucaggcucucauucgucuaucauagcaauuuccacuucagauaugguauuucgaauaugcaguaggcaagaaacaagagaauuggccgggcgcgguggcucacgccuguaaucccagcacuuugggaggccgaggcgggcggaucacgagaugaggagaucgagaccauccuggcuaacacggugaaacagcgucucuacuaaaaauacaaaaaauuagccgggcgugguggcgggcgccuguagucccagcuacucgggaggcugaggcaggggaauggcgugaacccgggaggcggagcuugcagugagcggagaucccaccacugcacucccgccuggggcgacagagcgagacuccgucucaaaaagaaaaaaaaaaaaaaaaaaagaaacaagagaauccagguuaccagaauuguggguaaacuaacaggacgaugguucugaguggaguucuagcagcuuucaacaacuggaauucagcccucaugccuuagggcacccguuauauguaacgaauuaacucuccagugugucuagaaggauaccaguucuucacuuggagaacugaggaaauaguuguucuugaguguuuuuguuuugugguucaaaugagaaaccuuuguuggaaaaggcugcugggguccuucugaauagucaaguacauaaacuaucugcuaugucuaucaugcuaacacaugauacugaucaaguaguuacauaauaauauaauugauuuuguuaaaguugguuuacuuaaaacauuuugaaagggagaugcucuucaugaagaugguaauacauauaauaaagauuaauauuuacugauuacuuagaacaugcuaggcuuuucuaggucccugcauugucuucuacuccucccaacaauuuuauuccgauuuuuauccugauuuuacaaaugugggagcugauauuuugagagguguuuauuugguaagucucauugguaccauucugugacuauuuuagauaaauaaucagagacaaguguucauacacuauuacuuaagaacaguaacgcuuuuuugugguugccaaaauagacauugguuucagaauuuaaauauguaaguuuuaauagcaaaauuacuguuauaauucucaguaggucauuuaaaaaauauuugcuuaaaaaguuaggcaucaggaguaauaugaacucacaaacuucaggaaaugaaguuguuaacaccccacauaaguucauacaaacuuuucauaguuuguaugaaaaguaaucaacuugcccauagucauacggcuagcaagagaauggugagccaggaauuagcuguaguguaugugguuccggagauugcauucucaaucugaaaauuacuuuauauacuuuuguauguuuuauuauucauauaaccuucacauuccauauacaacuagcugcuaauuaucugucuuuuuuaaaaugcuuuuuuuaaaaauuaggaauucaaaauauaaugagauuacacggaugagauuuagauugauauggcauggaauaguggcuaaaaaccauauaagggaagaaaaaguagcagacgaauuagaaguuaauuuauauuucucuugcuaacuuuuaaugaaacuguucuuggcucaaaaauaguuaaaacuuuuuaaauuggaaaauaauaauuaucuauuuaggggauacaauguaauauuuugauacauguauacaaugugaaaugauuaaaucaagcugagugacuucaucaccucacauacuuaguuuuuguguugagaaugucugaaauuuacucucuuagccguuuugaaacauacaugaguauuaacuguagcuaccaugcugugcaguagaucucaaagacuuacuuuucuuguaugacugaaacuuuguacccuuugaccaucaucucuaauuaccugccuuaauuggaagaccaaaaugaagguagauaugaaaucuacagguaaucucuaaguguuauuuuaauuaacaaauuuuaaauuucuugcccauuauuccacuuacagagauuuuugaacaagaaacagaaaggauuacuuuaaauuucaacucuuucuguauuugcauuuuggacuauaugguggacaugccaugugcaaauugugagcacaggaaaaggcuaagggcugagaucacccuguuuggacuacuuaacccuugagucauugagccagcugauggcaaggacagcccuuaugaaguaggggagauuuugccuguggguguguuggacucuuauugcaugcuuuucccacccccgaggugucuacuuggagaguuuccccuauuaaaagcugucugggagaagaauagaaaauucggcucucacuaaagugugaaagccuauugguguaaauagcuuuuuccugggaaagguaaguuugguugguaccaaggaaugacccuuuauaugugcaguuuaaaauguuuaaccaaagggaauauuugguuguggggagccuuuugggugucccugaaaucuugccauuuugacuucuguccaucaugguuuuuguacacuugaccuuacuuuucucagccuucuagaucuguagcuguuaaauccuguccugcagacgggagcagcguucucugugaaaacuggacaggagucagcuccuuuagagcacuggcucagccacgugacuucuuccaccagggcuucggguucagcugggucaggggagcagaggcgggaagcuugugucccuguggagccccacuagggagaaugucucccagcaaccagcauccaggccacagugaucgcagagcuaacccacacuaacuucugaguggguacaucuaaggacucccuuuuuaaagguggaaugggguacuuuaaaguuuuugaugacuugucagagcauuugaaagcacugggaaaaccagccgccuugucaaaaccugugucacuucuuccagaggagaaauugcagaaagagagcaggugccgugggaagcaguguuuugaaucagcacccagcagguggugauuuccccucuaauucgguuuugaacagauacucccagacaguguuggcaaucacugugcuccauaauguagcggaggcuuguuuguuuguuuguuuugggagacaauaucagcucaagcccugucugcuuauagucacaguauuuuagcacauguuagaugccugcuguuuaagggguacaccuacauuccaagcuucuucugugugugugucugugugugcauguuuaaauauauauuuaagcacagaaaaaggcauuaccagagaucuugagacuguuaaguagggaucuggagaguauuugauuuuuuucugcaagucaaagguagugcaaagguacauauacaguauguacauauacaguagcuacacaacaaaucuuucuuuuuuaaauuuuucuuugaaaacuuagcucacuucaguuucgaaggaugacccuguaucccaguuagagaauuugguuauagaguuugagcccauccugauuaaaauuuucacaaauaaauauauauguugggauguuaguauuuaauuaccuguagcuuuuuugaaaagagauuggacuuucagugagacugacgggcauucaaauccugguucuucuaccuauaauuuuugaguuuuguaaguaaaaaauagugaauaaaagcuaggucauagaguaacugugaagauuaaaugagguauuauuuguagagcaguuggcguggugccuagaauauagugagccacaauaagaauuacagacccuucccuuuacucaaaauauauuaggaauguuggaaaauucugaccuuaaagcuaaagaauaauugugaacagggguauuugcugacuggaauauaacaugagguugugagggaaaaaaauucaaagaguguaggcaguuggagccucaaugugugcuaggauauaauggaaguugaaacuagacacguauucaauaccuuuaugcugauuuucuuucauauggaaaugugauuaaaggguaguuaucaauuguuuuuucuuccugagggaauuuauccaucccaaguucuuuuauuuuucagauucuuuuuugaucagcaucuuuaaaauuaaucaauagccaaauaacagaguagguguuuauuugauaagucucauugguaccauccuaugacuauuuuagauaaauaaucauagacaaguguucauacacuauuacuuaagaacaguaacacuuuuuugucguugccaaaauagacauugguuucagaauuuaaauauauaaguuuuaauagcaaaauuacuguuauaauucucaguaggucauuuaaaaaauauuugcuuaaaaaauuaggcaucaggaauaguaugaacucacaaacuucaggaaaugaaguuguuaacaccccucauaagauaugcuuuucauaguuuguaugaaaaguaaauguuccugggagaggucuuguauuaccuuaaauucaugguaaaguauaaaugaccaaaaauagauuuuuuccugaaaugagacuuaagugggguaguuugugguaagaguaggacauugaguacugagcugugguaauagggcaguaaguuucaggaaaaauagguacagauauuguauaaucuucaaguuccauuaauuguuucuucuuuuuuugagagcuuaauauacuuauuuaaauuuaaaugaaauaguuuucaaauuguuuuaaguguuuucuauuauggagauauaaauaauauuuaggauauuuucacaggauuuauuguuugcggaucuguuuuagcaugcaaguauucuugcagucacucuaacuugcgugacuagcacaacauccagcauaaauagcagcuuuaggaauaacauuuucaguugaccgauaguauaaauucaauaaguaacagagcauuauuggacauucuaaaauuuuaauuuuggaaaguucuucaucuaguaguuuucauugagaggaaagaguuaaguggauuuucucugaagcgcuugguuccuagaauaauugauuaaaucuuuucaaagcacugagaguugacucuuuacccaacagggggccaaaguuauccagcuucuugaugaauuucucuaagguguaaugauucucucuguaaguuaggcacauuuaggugcuugacaaaacugucaucagaaguuuucccagaguacauuaaguugaaaaacuacauguuuggaaaucuaaaugugcuuuauuaagucuuuuauggaguuaucuucaugagagcaugcuaugguuuggaugugguuugucuacacuaaagcugauguucaaauuugauccucaguguggcaguguugggagauggggccuagugagaggucuuugggucauguagguggauuuaugugaacagauuuaugcucucucuggggagggagugggugagugaguucuugcucucuugggaauagauuaauucucaugagaguggguuguuaaaaauaaucuggcuuccuuguuuuuucuucuguugcuucgucucuugaggaagaucuugugaguuuuuuugcacauaccugcuaccuuucacguguccgcuuccccuuugaccuuuugccauguuaugacucagcagaaaagcccuuaccaaaagccagcaccacacucuugaacuuugcagccuacagaacuguaagccaaauaaaccccuuuucuuuguaaauuacccagucucaguuauucuuuuauugcaacacaaaauggacuaagagcauauaauaauguaaccaagauauugacaauaaccaucuugugauaugaaaacuuuugucuguuaccaaauuuauccaagauguuaauuugacugaaaagcaugaaagagaacugauuuuuagaugacagcuuuccaaagcauuguuaguucaaggauuaacucacaacuuuagguguguaaauauguguguguguuuuccauauuugacaagaauguaugaacccauaugauacuuuaccuuaaaguuucacuauaauuuguuggcuggacaugguggcucauuccugucucccagcacuuugggaggucgaggagggaagaucacuugaguccaggaguuugagacuagucugcacaacaugacaaaaccccaucuccauaaaaaauacaaaaauuagcugggugugguggugcaugccuguagucccagcuacuugaggugggaggauugcuugagccugggaggaguggagguugcagugagcaaugauugugccauuacacuucagccugaguaacagugagaaccuguuuaaaaaaaaaaaaguuucacuauaauuuaaaaaagaaauuucacugagguguaauauguggugagaacauuuaaagucuauuguuaacgauuuucaggaauacaaugcauuguuauuaacuguaguuaacauauuguacaguagaucucuugaacucaauagaucuucuaaccgaaauuuuuguacccuuugaccaacaucuccccagucgucucucuccagccucugguaacaccauucuacucuguuucuaugaauucagcuuuuuuagaguccacauauuaagugaacccuuuaugugguauuucacuuaauguaauacccuccaggauuaucuguauuguuguaagugacaggauuuccuucuuuuucaaggcugaauaguauucuguuauuuagguuuacuacauuuucuuuauccauucuucauugacagacacugagguugauuccuuaucuuggcuauggugaauagugcugcagugaacgugguagagcagauguuucuucaacauacugacuucacuuccuuuggauauauacccgguagugggauugccggaucauaugguaguucuguuuuuaauuuuuugaggaaccucuauauaccauucuucauaauggcuauacuaacuuacauuuccagccacagugaacauagguucccuuuucuccacauccugucauuuuuuuaaauuaucuguuucuggaauuccuacuccuuagauauuggacuuuccacacugauccucugauuuuguuauuuuucccauuuccuauuuuauuaaauuaauuuuuuccuccuagauuuuaaaauaaguaaauguuuguuauaccaaauuggcagaaacuuggcuauaguuucucccuuuuuccagucuaucuuauacaccaaucugaucaaaucgaugacugugauccacugguauuucaagucuagaguuugaauuucaggauucucugugacuucauaucgguauacccaugcaaccauauuuuuacucccacauguaacuuuuaccguuguuacuguuuuggaaacaggcugucaccauucccaaauuggucuucauuuuauacucaguguuugaaaugucugucuucuccuugauucucaguuaauuucuacuaaucuaucagggcaggucugucggcuuguugaaaccuucuccgaccagccucaucuuuucauagugacagaguuggagcuggaauccaguuuccugcuuuguucuauacuguuaugcccuauauuuagcacugcugcucagaucaauuaaaugaugacugucaggccacguaagcugguucuuuccuuuuugucagugauugccuucuaauucugugguuaaguuacucagagaaggccuccaacaucaaguugguuguacuaggauaaagcacuguaaaacagcuaauaaagugccugguggaguuagugguucauaaauuguuauccaugguuuucaacugugaauccaguaauggcccauaucacagaaccagaaccuagaguucccuuuuuccaggucaaggcuguguucccagugcuggugccuugcauauuccugugaaucuccauccauggcuacccaguacuuggccucaguagacagccugcggguuuggauguauuagaacugugcuguuagaaguuuuacaauaggcccugcgcgguggcucacaccuguaaucccagcacuuugggaggccgaggcgggugaaucacaaggucaggagaucgagaccauccuggcuaacacggcgaaaccccgucucuauuaaaaauacaaaaaauuagcugugcgugguggugggcaccuguagucccagcuacucaggaggcugaggcaggagaauugcuugaaccugggaggaggaggagguugcagugagccgagaucgugccacugcacuccagccugggugacagugagacucugucuuaaaaaaaaaacaaaaaaaaguuuuacaauaaacucacuuggaacuauaguaaauucaaaacaaaaugggugggaaacuuaacagauauuuuaacugccucuuucuucgacuucuugauucaagacaagaaguacauuucucaaacaacuuuugauaugugaauugcugaggaaaacuauauagucccaaccuggcaaguuaagaguucuuugaaauuguuaaugaaauacuucaugcugggaaccugguagaaguacuuaauuucugaaaaaucuuuugauaaugcuuccccuaagaguuuaaggaaaaugcuagcagaguaaaaaguacuaccuuuuucauagguuuaaacauauuaaaacaauagcgaaaaagauuaugauaaagcugcuguuccucccagagaggucagucauugguugacaccacuuuuuuuauagcaaauauuuccagagcuaacaaaacucuuuggaggagaguuuggaaaaacaauugacagacaucaaguuaagguuuuugaaaaacuaaaaauauacuaguuuucuaaauaaauugagcugaauuuaaauacauggacauccauugcuaugauauuuuaaaguuucacuguaauuuuuuggcugaguaugguggcucaugccuguaaucucagcacuuugggaggcugagguggguggaucacuugagcccaggaguucaagaccacccugggcaacauggcaaaacccugucucuacaaaaaauauaaaaauuagccaggugugguggcauccaccuguaguccuaccuacuugggaggcugagcugggaggauugcuugaacccgggagguggaaguugcagugagcaaugauuaugccacugcacuccagccugggcaacagagugagacccugucucaaaaaaauaaaaaguuucacuauaauuuuuaaaaagaaauuucauugagguauaauauauguucaguuuucacauaucuguaccaguuucaguguaauuugauuuauuuauuuuuauuagugggauuuuaaauauuuacauuuuaaaguuggggaagauaaaaauaaaauaauuccuagucugccauuuuauuuuuaugaagcagguugcuacuagaaucuuuucauauugguuucuauauguuguuuguuguuguguaauauauuacuccaaaauuuaggggccugaaacaauaagcauuuauuaucucacaacauuucucugggucaaaaauuugagaauggcuuagcugggugguucuggcuuggggucucucaugagguugcaaucaaguuauuggcccaggcagccaucaccugaagguuuggcuggagcuagaggaucugauuccaaaguggcucacccauaugguuggcagcuuagugcugacaccuggugagaagccucagcccuuuaccaugugaacacccucuuaggguugcuugaguauccuuaugacauggcagcuggcuucucgagugauccaaguaggaaggcaaaagccaccauguguuuucuuaccaaauauugaagucacacguggguauuuccacaaucuccacuugguuacauaggucagcucuguuaauuauggaaggggcaugaauacuaggaggagagaaucauugugggucauuuuugaggcuagcuacccguuucccuuauuugcuauguuaauuauuuuaacuugcuuuuguauuaguuucuuccuauggcuaaagauuucaaacauucagaaaaguaggacuaguauaaagaacacucauauaucugucaugaccuaacacauuaauaauuuacuguuuguguuggcaguuuuuucugcaauaucuuaaaauuauagacauuuuggaaaacauuuuacuauaugaucuggcccuugccgcccucucuuucuuucacucauagacauaaaaaguuugcacuuuaaagaaauuaauauauuuucuuacaguaccauaacaucauugucacaguauccaaauuugaaauaauuccugguuaacaucuaauacugagaccauauuuaaauuuguucaguuguccccaaaauguaauguauuuuauagcugguuaauccaagccaugauacaaaugaagacuauguauuuuauucaguuguguuugucuuccuuuagagcagaacucccuuuuuaguaucauuauacuggguuauguuuuguguagauugucucaccacccggauuugucugauuauuuucuagugaugucauuuaacuuauuucugcaucuucugucuuguguugucuugucuugucuugucuugucuugucuugucuuguccuguccuguccuguccuguccuguccuguccuguccuguccugucuuguccugucccguccuguccugcccugcccugcccugucuugucuuucuuuuuugagauaguaucuugcucuauugcccaagccagagugcaguggcaugaacaugguucacugaagccucaagcuccugggcucagccuccuguauagcugggaccacuggcaugcaccagcacgaccuggcuaauuuuuaauuuuuuuguagagacagggucucaccauauugcccaggcugaucuccaacuccugggcucuagcgaucuucccaucuuggcuuuccaaagugcuaagauuauauaugugagccacugugcccagccuguauuuucuuuaauuuggaaguuauaucuaaaacuugauucgauucagauuaaacaguucugguaaaaguacuucagaagcgaugcuguguauuuuacauaucauaucaugaggcacagaaugagugccuggcuaucccauuauaagugaaguuaaguuugaucauuugcuuaaggagauuauagccacauccgccaguaguauaguuccaguuucccgcuuugaccugcauguccuguaugaguugauacuccaauaccaugugaaugucucauuuuucauuaacuuuuuacccagugucuuuagcauccauugguaaugcuaauguauuauuucauuaaggguuacaaaauaauguaguuugcuuuaguuugauucuuauguuguuaaauuacauguuuuucuucucccuucuccuuuggugguuaacacuaacugcacaauauuugugguuuugaauccuuuuuccuugccccuagaugucccuuucuuuuuaaguuuguuuaucaaguaguaguuacuuaauuaaucuugguuaagugaauggcuauacuuccuuuauucugguguaucagggcuuccccaaauuaccagcucccuuuuucauuaaguuauguguuuuugucaucaauucaucaaauauuuguagaacauuugcuaugugucaguuaaguacagugaugaggagcugggcuguuauuaaugaaguagucugaaucccuuuguuuugaggaagcucuaauaucuuguuggcaacauccaaguaaauaauucaacuaucacaacauaaccacuggauuaugugccagggccugauagacaaugaacaccuaaauauuuauuuacugacuuggguaagaguuguaauauugaucuguuaagguucaguggagcccagaggaagacuuagugguugaggagcuggagaaaguugcucagaaaugacauugacuuggauauuuguuagggugacuuagcaugcaaauuagacacuuuugacagcaaaagggagcacuaaaaauacuuaaaauuauauaauuaaaaauauugaaugauacauugccuuuauuuuauugguagaucuucuguucaagagaaaauaguuccauucaaacaguaaaaaauucauucuaacacuaaaauauacucauguacaucaaagccaaaaaauguauuuauauuaucucagcauuauaaaacaacacaaguugaauuauuacucugcuuuaauaagcuucuuagcuguaucaaucuaugugucuaaguugcauuuuguguuuauuaaguuuaaaauucuugauaguuuucaauugauucuuacccaugaaauguguuuuuaaaauugagaaaauauuuucucuauaaguguugagauacuugguaaauuuagcacauucuauaaauggaggauauuuucaauucacauuuuuuaauugaaauguguaaauauuuuaccagaaauguuuucacagcuaauauauuuuugccuccauucugagacaaaauaguaaauauuuuuauaagacaaaacuugucaaauaagauguuucuguuuaugauccuuugggauauuuugcuaauucaaauacuguaaaauuaaaagucuucucaauuucauuucuuuccaguacagaauguaagcuuaucuaauuuaaaauaggagcuugugguagcuagucuccagagauggaccacgucucugguauugaugccuuuguguaguccuguacugcauuaauucugggcugacccuguaagucccuuuaaccaauggaauaugguagaaguguugcucuacagcugcuucaacaauuuugggugcucugagcugccuauuaagaaauucagcuaccuuguuggaaaaggcacuuggaaagggagagguuugaggacuacauggagagaaagaaggagacuuaaugucccagcagagcccagucuuccagccguacccuucaagguaucagaaauaugagugaaaucaucuugcauuucccagucccagccaccaucugaguuuagccacacaagagaucuaaagugaaagcagcagcacaaccacucagcugagccccagucaaccugucaggagaaauagaaugacugcuguuuuuagccacaauguuuuguggugguuguuauguaacaaaagacagucaaaagagacaaguugaaguauuccaaagugcaacuuuagaauuuuaaaauuaaccccauguauacuaguugaaaucucauuauuuaauuuguucaaauccauucuuuuguaggaguaaauuuuaugucucccucuuugcaaaauugucauuaauaauugaaguucacuaacaguuucaaaaacaagaggcuuugguguuuuauuuaauauuuuuuuaaauaaaagauuuucaacugauuuugaaaaaaaaaagccaacauuuaaaggccucauuuagaagauaguucaagaccaguguacaucagcuuagauuaauugacagaauggcucuuaacucuucaaagaaucagauguuucuaguauucagcugaugagaaucagcagagagaguguguguauugccaugaagaaagauuuauguuuaauuuaaugucaccuuuuucacaaagaucagaucguucuuuuauucuguguauaaauaaaauguuuaaaauuuggcaaugacagcuuuuacuuuaguuguuagacuauggaagcauauuuggaugaaauuaugaauuaugugucugucacaaagagauccagguauauuucuguuccauagguuuccuaauuuaauaagaacauauuuuuaccaugauacuacaacaaaauuuguauccauguugucacugcaaaaucacauaauuauguguuuauccuaaccucuuuaacugaauuuauagugguagucacaacaaugucaguuauuuuaucuucagcaaaauagacuuccgguuuuuuuauuugauaaauuagauuuuuaaaaugagucaauauucaaauuaacugauuuucuguuugaggcaucuaugacucugcuaugaaacugauauuuucuaguauuuuuggagccaacaacuuaauaacuacugcuuuccuuuuuuuauuuuauuuuauuauuauuuuuuuauuugagauggagucuggcucuguuacacaggcuggaguacaguggcaugaucuuggcucacugcaaccuccaccucccggguucaaacgauucuucugccucagccucucgaguagcugggacuacaggcgcaugccaccacaccuggcugauuuuuuguauuuguaguagagacagaguuucaccauguuagccaagauggucuugaucuccugaccucgugaucugcccuccucgaccucccaaaaugcugggauuacaggcgugagccaccgcauccggccugcuuuacuucuuacacauucacuagaaaauuuagaucuaaaagugagcaauauuuagaauagucauuuauuuaaauggaagucaugcuucagaguuuucugguaacuguaucuucugaauauguguuaaauugccaucuuuggacacaggcauccuaacauaacuacuaauuuuuugagguagauaccgaugcuuuuuagcagauuuaggucauccuggagucugauauauaaauagauagauagauagauaucuuugguuuccauagcacguggcaaauguugaaaaacauuuugugcaaauugcagauaaucaacuuuccugagaaaugggaauugagaguaaaauuuuuuauuaaacauacuuuuugugaggucauuguaacugauaguuuuuguuguuguuguagaauuaaaaagccugacccaaagaaaauaguuuagauuuacagaauuugauaaaucauaaaagcauugcuuucagugugcucucugcaaggaaccuagugauuucccguacauauuucauguucaccuaaucuacaguagcggcucauugaccuacugacuguggguguuguguguuugugucucuugcaugauugagcucaggccggggcucaacuagcugcuauagcaaauggguauaacagagacacaacaguguugaauacuucuccuacugccacccaagaguagaaggacuuagccgucuguagccacaauuuuuuuuuuaauuucaauaguuuuugagguacaggugguuuuggauuacaugguuaaguucuuuaguggugauuucugagauuuuaguguacccaucacccuagcaauguacgcuguaccuaauauguagucuuuuauuccucaccccucccuauucucucccgcugaauccucagaguucgcuauaucauccuuaugccuuuguguccucacagcuuagcccccacuuauaagugagaucauaggauguuugguuuuccauuccugaguuacuucacuuagaacuguggccuccagcuccacccaaguugcugcaaaagacauuauuucguuuccuuuuauggcucaguacuccaugauguauauauaccacauuuucuuuauccacuuauugauucaugggcacuuagguugauuccguaucuuugcauuugcaaaaugugcugcaauaaacauacaugugcauguugucuuuuucauauaaugacuucuuuuccuuugggaagauaccuaauagugggauugcuggauugaaugguaaguucuuuaaggaauccccguacuguuuucuguagugguuguacuaauuuacauucccaucaccaauguaaaaguguucccuuuucaccacauuuauaucaacgucuauuauuuuuugacuuuuuaauuauggucauucuugcaggaguaaaguggugucucauugugguuuuaauuugcauuucccugauaauuagugauguugaccuuuuuaaaaauauguuuguugguuauuuguauaucuucuuuugagaaaugucuauuuauguccuuugcccacuuuuaaugggauuacuuguuuuuuucuugcugauuuguuugaguuccuuguagauucugaaugcuauucuuuugucggaugcauaguuugcgaauauuuacucccacucuguggguugucuguuaacuuugcuaauuuuuuuuugcugugcagaagcuucuuaguuuaauuaggucccauuuauuuauuuuuguuguuguugcauuugcuuuuggggucuuagucaugaauuguuuacuuaagcuaacauccagaagaguuuuucugauguuaucuucuagcauuuuuaugguuucagaucuuagauuugucuuucaucugucuugagaugauuuuuguauaaggcaagagauggggauccaauuucauuuuuauacaucuggcuugccaguuuuccuagcaccauuuauugaauagaguagccacgaauauucugaguacccucaguaaucagugaaugccuggcaugcugggaguguuaguuuuguuauguccaggagaguggggaagagagucaaguuuugguuuucuuuuagagugaaacacuugguaaaguaacacuauucacugcaccgggcucucacgugcugugcgacauugcuggagaccgugagagaagagaagcuggagucucccaaaugcaucuugguuuauuuucaacuuuguuaagaaaugaaauauagaagaugaaugcuaacacagaggggacaggaggcauaaaccaggcuugucuugggcaacccaggaugagguggucacucuagugaggaccaaagcucagcaguaguuggaccauauugggaagagcuaucaaauuugacuucaguaguuacuuagagcauagagugguuggggagagggacagcgaugucaccccugacaguguguucuaaucuguaaacucuuccacacacuuaccugaggcuguuuauggguagugagcagaggaagcucuucuuugaauuuugugcuuugugaaucuuacagaugcuucugaaucuuugacuuuucacucuccaggugagaauaacagcaccagagauugaguagcucuuauuuguuugaagacaaauuuuaaacgcagaguagaaaagcaauagucaguugauugaugagauuuugacccccuccacuguauuccuuuuagugauuugguacaggccaccaccugcucuugcuugagcuuccuacuugacuuucgcaccacagccagagggguuauuuaaaaauguaaaucagaucauuucagcccuugcugaaaauucucuaaaagacuucccaucucacaugggaaaaccuuucugugcugaaaaaaguucuccuuaaggaccuuuuaaacccuguuggccauggcucaccauaugcauuguauuuuauauugccacacaguacaugccacacaguacacacggguuugaaacagaacuuccacgaaugauccuaccuguauaacaugugcuguaucuugacauuuucuauuuucuguuucuucuuuuuuauuuuuuaauuuuuauuuauuuauuuauuuauuuauuuauuuauuuuauuauacuuuaaguucuaggauacauaugcacaaugugcagguuuguuacauguguauacaugugccauguuggugugcuguagccauuaacucgucauuuacauuacguauuucuccuaaugcuaucccuccccccuccccccaccccacgacagacccuggugugugauguuccccuuccuguguccaaguguucucauuguucaauucccaccuaugagugagaacaugcgguguuugguuuuuuguccuugugauaguuugcugagaaugaugguuuccagcuucauccaugucccuacaaaggacaugaacucauccuucuuuauggcugcuuaguauuccaugguguauaugugccacauuuccuuaauccaggguaucauugauggacauuuggguugguuccaagucuuugcuuuugugaauagugccgcaaugaacauacaugugcaugugucuuuauagcagcaugauuuauaauccuuuggguauauauccaguaaugggauggcuggauuaaaugguauuucuaguucuagauccuugaggagucgccacacugucuuccacaaugguugaacuaguuuacacucccaacaacaguguaaaaguguuccuauuucuccacauccucuccagcaccuguuguuuccugacuuuuuaaugauugcccuucuaacuggugugagaugguaucucauugugguuuugauuugcauuucucugauggccagugaugaugagcauuuuuucauguguuuuuuggcugcauaaaugucuucuuuugagaagugucuguucauauccuucgcccacuuuuugaugggguuguuugauuuuuucuuguaaguuuguuugaguucuuuguauauucuggauauuagcccuuugucaaauggauagauggcaaaaauuuucucccauucuguagguugccuguucacucuaaugguaguuucuuuugcugugcagaagcucuuuaguuuaauuagaucccauuugucaauuuuggcuuuuguugccauugcuuuugguguuuuagacaugaaguccuugcucaugccuauguccugaaugguauugccuagguuuucuucuaggguuuuuaugguuuuaggucuaacauuuaagucuuuaauccaucuugaauuaauuuuugucuaagguguaaggaagggauccaguuucagcuuucuacauauggcuagccaguuuugccagcaucauuuguuaaauagggaauccuuuccccguuucuuguuuuugucagguuugucaaagauuagaugauuguagacgugugguauuauuucugagggcucaauucuguuccauuggucuauaucucuguuuugguaccaguaccaugcuguuuugguuacuguagccuuguaguauaguuugaagucagguagcgugauaccuccagcuuuguucuuuuggcuuaggauugucuuggcaaugugggcuguuuuuugguuccauaugaacuuucaaguaguuuuuuccaauucugugaagaaagucauuaguagcuugauggggauggcauugaaucuauaaauuaccuugggcaguauggccauuuucacgauauugauucuuccuauccaugagcauggaauguucuuccauuuguuuguguccucuuugauuucguugagcagugguuuguaguucuccuugaagagguccuucacaucccuuguaaguuggauuccuagguauuuuaugcucuuugaagcaauagugaaugggaguucacucaugauuuggcucucugucuguuauugguguauaagaaggcuugugauuuuugcacauugauuuuguauccugagacuuugcugaaguugcuuaucagcuuaaggagauuugggguugagacgaugggguuuucuagauauacaaucgugucaucugcaaacagguacaauuugacuuccucuuuuucuaauugaauacccuuuauuucuuucuccugccugauugcccuggccggaacuuccaacacuauguugaauaggaguggugggugagagagggcaucccugucuucuuucaguuuucaaagggaaugcuuccaguuuuugugcauucaguaugauauuggcugugaguuugucauaaauagcucuuauuauuuugagauaugucccaucaauaccuaauuuauugagaauuuuuagcaagaagggcuguugaauuuugucaaaggccuuuucugcaucuauugagauaaugugguuuuugucuuugcuucuguuuauaugcuggauuacauuuauugauuuguguacguugaaccagccuugcaucccagggaugaagcccacuugaucaugguggauaagcuuuuugaugugcugcuggauucgguuugccaguauuuuauugaggauuuuugcaucgauguucaucagggauauuggucuaaaauucucucuuuuuguugugucucugcuaggcuuugguaucaggaugaugcuggccucauaaaaugagucagggaggauucccucuuuuucuauugauuggaauaguuucagaaggaaugcuaccagcuccuccuuguaccucugguagaauucggcugugaaucugucugguccuggacuuuuuuugguugguaagguauugauuauugccucaauuucagagccuguuauuggucuauucagggauucaacuucuuccugguuuagucuugggaggauguauguguccaggaauuuauccauuucuucuagauuuucuaguuuauuugcauagagguguuuauaguauucucugaugguaguuuguguuucugugggauugguggugauauccccuuuuuuuuuuauugcaucuauuugauucuucucuguuuucuucuuuauuagucuugcuagcagucuaucaauuuuguugaucuuuucaaaaaaccagcuccuggauucauugauuuuucgaaggguuuuuugugucucuaucuccuuuaguucugcucugaucucaguuauuuuuugccuucugcuagcuguuaaauguguucgcucuugcuucucuaguucuuuuaauugugauguuagggugucaauuuuagaucuuuccugcuuuuuccugugggcauuuagugcuauaaauuucacucuacacacugcuuuaaaugugucccagagauucugguauguuauaacuuuguucucauugguuucaaagaacaucuuuauuucugccuucauuucauuauguacccaguaguuauucaggagcagguuguucaguuuccauguaguugagcaguuuugagugaguuucuuaauccugauuucuaguuugauugcacugugguuugagagacaguuuguuauaauuucuggagugcuuuacuuccaacuauguggucaauuuuggaauaagugugauauggugcugagaggaauguauagucuguugauuuaggguggagaguucuguagaugucuauuaggucugcuuggugcagagauuaguucaauuccuggauauccuuguuaacuuucugucucguugaucugucuaauguugacaaugggguguuaaagucucccaugauuauugugugggagucugagucucuuuguaggucucuaaggacuugcuuuaugaaucugggugcuccuguguugggugcauauauauuuaggguaguuagcucuucuuguugaauugaucucuuuaccauuaucuaauggccuucuuugucucuuuucauauuuguugguuuaaggucuguuuugucagcgaauaggauugcaaccccugccuuuuuauuguuuuccauuugcuugguagaucuuccuccaucccuuuauuuucauccuaugugugucucugcaugugagaugggucuccugaauacagcacauugaugggucuugacucuuuauccaauuugccagucugugucuuuuaauuggaccauuuagcccauuuacauuuaagguuaauauuguucugugugaauuugaucccgucauuaugauguuagcugguuauuuugcuuguuaguugaugcaguuucuuccuagcauugacggucuuuacaauuuggcauguuuuuucaguggcugguaccgguuguuccuuuccacauuuagugcuuccuucaggagcucuuuuagggcaggccugguggugagaaaaucucucagcauuugcuugucaagaauuuuauuucuccuucacuggaagcuuaguuuggcugguuaugaaauucuggguugaaaauucuuuucuuuaagaauguugaauauuggcccccauucucuucaggcuuguagaguuucugcugagagaucaacuguuugucugaugggcuucccuuuauggguaacccaaccuuucucucuggcugccuuuaacauuuuuuccuucauuucaacuuuggugaaucugacaguuaggugucuuggaguugcucuucucgaggaguaucuuuguggcguucucuguauuuccugaauuugaauguuggccugccuugcuagguuggggaaguucuccuggauaauauccugcagaguguuuuccaacuugguuccauucuccccaucacuuucagguacaccaaucagguguagauuuggucuuuucacauagucccauauuucuuggaggcuuuguuuguuucuuuuuacucuuuuuucucuaaacuucucacuucauuucauacauuugaucuugaaucauugauacccuuucuuccaguugaucgaaucagcuacugaagcuuguguauucaucauguagcucucgugccaugguuuucagcuccaucaggucauuuaaggacuucucuacacugguuauucuaguuagcaauucgucuaaucuuuuuuuugaagguuuuuaucuucuuugcgacuggucgaacuuccucuuuuagcucggaguaguuugaucaucugaagcuaucuucucucaacucgucaaagucauucucuguccagcuuuguucuguugcuggcgagaagcugcguuccuuuggacggggagaggcacucugauuuuuagaauuuucagcuuuucugcucuguuuuucccccaucuuugugguuucaucuaccuuuggucuuugaugauggugacguacagaugggguuuugguguggauguccuuucuguuuguuaguuuuccuucuaacagucaggacccucagcugcaggucuguuggaguuugcuggagguccacuccagacccuguuugccuuggugucagcagcagaggcugcagaacggcgaauauugcugaacagcaaauguugcugucugaucguuccucugggagcuucgucucagagggguaaccggccguguggggugucagucugcuccuacuggggggugccucccaguuaggcuacucaggggucagagacccacuugaggaggcagucuguccauucucagaucucaaacuccaugcugggagaaccacuacucucuucaaagcugucagauagggacguuuaagucugcagagguuucugcugccuuuuguuuggcuaugcccugccccuggaaguggagucuacagaggcaggcaggccuccuggagcgguggugggcuacacccaguucgagcuucccagcagcucuguuuaccuauucaggccucagcaauggcaggcaccccucccccagccucacugccaccuuguaguuugaucucagacugcugugcuagcaaugagcaaggcuccgugggcgugggacccucugagccgggcgugggauauaaucuccuggugugccguuugcuaagacgauucgaaaagcacaguguuagggugggagugacccgauuuuccaggugccaucugucacagcuucccuuggcuagggaggggaauucccugaccccuugugcuuccugggugaggugaugccucgcccugcuucggcucacgcucagugggcugcacccacuguccugcacccacuguccgacaagccccagugagaugaacccgguaccucaguuggaaaugcagaaaucacccgucuucugcguugcucaugcugggagcuguagacuggagcuguuccuauucuaccaucuuggaaccaccuaccuguuucuucuuuuuuaaaaaugccgguugccacugacaaaacugauuucaugacuuaucugugaguuauuacccucauuuuggaaaauauguuacuauaugaucugggccuugucacccucucuuccauuucccguaccuggccuugccuacuuuccccugauuacacugugucccugcuuugccuuagauaugacuguucacucuugccuucuccucuuucuguuaccagaaagggguccugauacagaccccaagagaggguucuuggaucuugcacaagaaagaauuuagggcgaguccagaguaaagugaaagcaaguuuauuaaaaaaguaagggaauaaaagaaugguugcuccauagacagagcagcccugagggcuucugguugccuauuuuuaaugguuauuuccugauuauaugcuaaacaaaggguggauuauuugugccuccccuuuuuagaccauauaggguaacuuccugauguugccauggcauuuguaaacugucauggcacuugugggaguguggcagugaggaggaccagaggucacucucauagccauuuugguuuugguggguuuuagcuggcuucuuuacugcaaccuguuuuaucagcaaggucuuuaugaccuguauuuuguguugaccuccagucucauccugugacuuagaaugccuuaaccaucugggaaugcagcccaguaaguuucagccucauuuuacccagccccugugcaagauggaauugcucugguucaaaugccucugacauuucugccuagaacacuguuucccuauaugauggccucauugcuuauuucacgugggguccugcucaaauguuuuauuaucagauuuuccuggcucaugcccauccuacauucuccauuuucuuacccuauauaacuuuucauuguagcucagauguauaauauaguuaauagauauuuauguguuuaucucuuauuaggaaaggccuaugagaauaaggauuuuguuuuuucagcacugcucacucucuagagccuccaguggugucuggcaccauuuuggauagcccuuugauauuaguugaaugaaugaaugguauucauagacagacuugcauuuaucaaacucuccaggagguuuucugucccuugucugucuuguaucuuguguaagucuugacuuuggguagagaucccugcagauucuguaaacaaggcuggagccauuugaucuaggaauucuggguccuguguaccuugagcauggacuagaggggaauguuggcccagggacagucugugcccuuggccccacagaccccugcccauggguaggagcacagcuaugggugggccagagcaggcucuaaguagagugugggcccaucucaucccuuuguaauguuggcaucauguaggagcaauauaauuaucaguuucuaccugggggccuguggugaagauuuuggugaucuuuucuaugggaacagaaacagggcauucugacaucaucauuucugccugacauuguguagcuguaucaggcuggcuuucuggaauagcucaguggccaaagauugaucacgaaggguuuagagcugugaaaaugccccagguagguguuguauaaugcuggugccuggaccacagacagcugccuuacugguuuaccuacuguagucugccuuucauucuaccuguccuucacacugcugccuggcaguuccucuuaauucaagagucaaguauuauuauguguuauauuuccugcucaauaagauaaugcaugcucuuuguaagaauguuuaaauauuaggggaauauauaacgugagaaaguaggaauauaaucuuaccucugaagaaaaacacuucuaucaauuuggcauauaguuuauuuucuuugcacauacaccaacagauacauguuuuguguucuuuuuguuuuuauuaacaguuuuauuuuaaaaagcacacugcugugcauauuucuuauuuuuacugaguaauguaucauaaucaguuuucuacaacaguacuuacugauguaccucguucuuuuuuuuuuucuuuuuuuugagacggagucuugcucuguugcccaggcuagaguacaguggcgcaaucucagcucacugcaaccuccgccucccagguucaagcgauucuucugccucaguccccugacuacugagacuacaggcuugcaccaccaugcccagcuaauuuuugugcuuuuaguggagacaggguuucaccauauugaccaggcuggucucgaacuccugaccucgugauccgccugccucggccucccaaagugcugggauuacaggcgugagccacugcaccuggccuguacuucauucuuuuuaauggcugaauuguauucuguuuuuuggauuugcuauauauuauugaacuggacauggaucuuggugucauuuccaacagugcugccacacauacguuuucauguuugcauuugcaaacuuauguacguauuuccaugggacauauucuguguacugauuacuuuuuuaaaauacuccuuuaauucuguuacagcccuguuuggagaucuucucugacuucuggucaccuguaucauaaagucuagacuagagccuagagccaauagaaacauaaugugagacauggagucauuuuaaauuuucaaguguacacauuauaaaaaaaauaaaaaggaacaggugaaaauauuuuaauagcauuuuacuuagccaaguguaccccaaauauuauaauuucauugugaaaucaauguuaaaacguaauuagauauuuuacacccuucuuuuuguacugaaucuuugaaaucuauguauuuuacacuuaaagcacauuucgauuuggacuauccacauuucaagggcucagguaggcacaaguguguggcuccugauuggacagcgcaugucuacacucagccuggugcuuacagcacuuuacaaguaagccauagucagucaaacaagccacauucagucacauuuagccaaccugcuuuugcuucugacagccccacaaacuugcagugcuuccgguuuauuuuuccugcauccugcccaguuuuuugggcaggguuucucagcuuuggcacuguugaaguuugggaccacauaauucuaaguugugggugccuuguaggauacugagcaguauccuuggccucuacccacuagauacaaguggcaccuucuccucuagaaucccccuaccccaucuguggugaccaaaaaugucucuagacugagaaacaaugcuuuacggugaaucagaaaucuccacuuauccauuaggguuguuuuagccaacuggauaagccuacugugaccuacccuuccucugaacuugacuuuuuauccagccagugugguaaguuuuuauuuuuguguaugaggaacaaaguuaaaaucaaaauagaaaaagcgccuccuuuuguaggguuaucauuugguguuacaugcuuuaggaauacugugaaaaauacaggaacuucugcagaaacacaaaugaaaaugauggaaagucuagaaaguaaaguugcagggaaaaugaccuccaucuccacuacgacuugaaccagaaauaauaauaauaauaaauugugagaagaguauuugaggacaaauuuauaaccaacacaagggccuaaaaaccaccaaaaugacauauuaagguaaauagugggacuuuuuucauuggagaauuuuaagagaagauaucauugccuuccaauuaugguuucauaucuguucuccccaaaggcauguguacuuaaaaccccucuuggccccauaagaagauucuuugguccugaugagauuaugugcauuagaaucacuucuccuggaaaggagacgcuaaaggguacuugaauaaaauauuaaaaauuauggaggacauaacaaaggccaaucaguccuuucuuuuccccagaccccauaauaggagaacauggguuauuugaugaaauuaaagaguagcaaauuaagugcuaauaaaacgagauagucacuuacauaauucauugccaugggaggucacagaggcaaauuuuguggcuacauuaaauauggggcuggauaauuuuaugaccgcuaaugauauuuuuagcagucaaggcugauacugugagagaagaaauccuauuacauucuccaguagaugguuugcagggaccucuggcaagagguuucugagaagugcaagagcagaccuugugaguucuaaccuuugguguacucaaaauugguuuuuaaggggaaaguucccaggcaucccauucauaccucagucccauauuuucuuguagagauccaaaagcccuuucuagucugaagcaguggagaaagacauugcccagaauuaaauccuuucuggucuuugggaaccacucgacuuauuuaucguaugccacccgugcgucagguccuucgcuuggaguuuuaaaaaaucuuuuggggacauaaacauuuggacacaucaguggcauucugagugaaggggauguacuaaagguggaaugcagaguuucauggaagcacgaagaagcaaagggaugucucaaccugugagguucagggaaggcucccagagaaggugacauuugaaucgacucuuaaaggaugagcagcaguucacuguucgcaaagcagggagggcauucuugguagaaggagcuugcagcaugcacagauccagagacagccuggcauaaugugucagggaacugccaguaguuuaggaaggcugcaccacagaggcagaggagcagugagggaggagcuggggcuugagaaugaggaaggagccagauggugaaggaagaggcuuguguuugccugagaccccucuccaacaguggugccaguguuuccaguggcgacaguagugguaguggugcguugggaguagagaaugggaaggacuucagggguguccugugaccgauaaaggacagccugucaaagccuugccccacugaguaauaggccuaccucuuuuugaucacggucaacaauuaguuggcagugagucuuggaguucacauacucuucacucauuuuucuauaucugcuugaaacagucuuuaccaugaaccaaaucagcauuaucaaucaucugaggagaaaaaaaaaaagccucuuagggcugggugcaguggcucaugccuguaaucccagcacuuuaggagggcgaggcagguagaucacuugaggucgggaguucgauaccagccuggccaacauggugaaacccugucucuauuaaaaauacaaaaauuagccuggcgugguggcgcacgccuguagcccuggcuccuugggaggcugaggcaugaguucguuugaacccgggagguggagguugcagugagccaagaucguaccacugcauuccagccugggcgacagagagacugugucugaaaaaaaaaaaaaagaggcuccccugcguuugaguaggggguguuucuuacaggucuuagauaaauugggacgaagucuagagugucuggucugauuuucucgggcucugcuagaacaaaaacagcccuugagugggaaagcagaggcagauuucaucggccugaccccagacucccauuuucucugugaaguuggcucagcaaacaagcaagaaaacauacaauaucuuugaggagcaggagcagauggauugaaauguuaaaaaucugguuuguuaaaugauuucagcuaacaaaauaauuagagagaaaaagaagcacccaaacucucuuccuucuucagugaaauuuaaauaagaucauuauuaaucacucagaguccaccuugcaaucucuauaccuuuaauacugauacuuuuaagaagaaugaaaugaaaaugagugagagaaagaaugucaucuguaaacauuaguuuagaugcaaauacuucaauuuguauuguuacaugauacaguaugugauuagcaguuuuccucauugcauuauaaagaguuuuguaauuagugcauuuuuucuaauggauaacuuuuuuuccacaguacucuuuuaaggcucuuuuaaaaacauggaauugcuggagagauauagaagugagguuaguuauagaagguaaauaauguucauguccgauuuaccgugaggccaccuauguuuauaggauauugguggaugaaguugaaauauguguaccaaacacuguuggauguuagacacccaaagaugaguaacaucauggcugacaauguacuaaguacaacgaaugguuucaccaggaauccuugaugaauugauuacaaguucugugguagagaucuauccaaauguuagcucugucuggggagcugacaguguuuucacaacagcuaauauuuagacuaggucugaagguagaaauuacaguuaacuggaagagaagagagaguagaucaagguaggagagagcauuucagaacaaaagcaacagagauagcuccugaaacuuuaaauaauuuguuuuuucuuuuuuucuaacuucuguuauaucagucaauguuguuauuucuaauacauuuugaaaaauuuuucuuugaagaaagaaugggcuguauccugucagcaugcaguagguauuaaucuugccaguaagcggguagugagcacagauucuguaagccccaccauuaguucacuuaagauuuguuaaucauuugcucuccugggcuggacacucaccaguaagucuuugcucucagaggugagguacguggcauggguaacacacauuucccacgucguuagacaugucugugugaugaaucaauacagguucuuccaguuccaaauguauaggcugguacagaagcaauugugguuuuugccuuugaaaguaauggagugauuuugcaugaaguaugccuuuuguugacuggucuuccaucaauaagguuguuuauuuauaguuguacaaaaaagaaauauaagcuuuaaaaaaagguugaugucaaaugauaaauguauccuuucaaggaccauguaaaaauaggugacuauauuuaaugaaacuuuagguuucagaaaguguuuuucugucuguuuuagaccuuagcuggaucuccaaaauacaagugaaucacccggcaguucugaggcgugcggaacaaauccaggcucgcagaaccgugaaaaaggaguggcagguaaggguucuucuugagcauucugugccuguauuuuacaaugcauggucucuucccucaaggccacaauauugaauuucacucaagaugcaucuaaacuuaaaagauugcagcuguccaugacuuauuuuaauaauucauauaugaugaugauggguuggagaaagauaacacauuuauccaaacaaguuaaaaucuuaucacucuugaguggcaaaaccgcaaaugaauuugaggcaucuuuauucaugagugaauuaaauggcauauuuucucaacacauuuauucaguuuuuuagacaugccuucuuugguugucuucuguuuuaauuuuaaagcccuaacaucuaaacuugauguguccacuguugaggcccuuagguauaagaguugaccuuucuugaccaucauauuuaccuuacuauuacuuucuauaaaucauuuuucaaaauuccaaaaaugauguuucguagaguacuugcggucagcauuuucuucaguguaucccaaccaaagacgugcuguguaggauuaaagggaauucagaguucauuucacaagugagacagaauacugugauugaauccuugagagugauaguucacguuuugcucauccuuagaaauauucugguugaaaagguaaaauaaaauucaucagacugaguugugaaauaugaauauuguuuuaaaaauggaauuggauuaaauugaaaaaacaccaaaaaacuuggaaacuuuuaaaaaugauaaucucaucccagaucccagagcgggagguaaaauguaagguagaaaccuucuuucggaguucuucuuugucaggguggcucugaugggcucucccuuuggcugagauggaguagucagaaguggggagacaugggcuaauagggguuucaauuugggauaucugugggagaaaaaaaauguuuaagccuacucuuccucccuuuuauuuugggcaguguucaccuuguuaguggcucuugagcuguguuuauaucauguaucaggauauuccauugaacaguguaggcauaagauauuaacacccauacuugucuaaugauucucuacuaaccaccuggguuggagguugguugguuuguuuauuuauuaaauuuacuuuguuuucacuuuuguuuaaaccaggcugcuuggcuccugaaagcuguuaccuuuauagaucuuacuacacuuucaggugaugauacaucuuccaacauucaaaggcucuguuauaaagccaaauacccaauccgggaagaucucuuaaaagcuuuaaauaugcaugauaaagguaauguuguugugugugaucuaugugguguuuagugcuuacaauacugauuacuaaaucaaagacgacuuaagauacagcugcuaaugauagcggugauagaauccaugauagaaacucuugcuguguauacauagacagauucuucucugaaaaacagcaggaagagaaucugagucuuuuuuuuuuuuuuuuuuugaggucaguucuuuccaucaauggauuaaaaugcuugguagagagugacuuuauuucuuuucaguucuucaguuuuggaaaauuucuguuuagugacacugaaauacucuuucugauucccuagccauacgugaaaaagccagucucauuacuuaauaaucacaucucauacauaaaguauuuucugugaguauaugaaauacuuuugaaaauaaagugcaaaugagaaauauagccugcuuauauauuagguuagaucuuucaaaaaaagucauauucacugccuuaguauacaugaaaagaaggacuuuucuagaguugccauaaguuuagaaccuuagcauuuuggagauguuggacaccuguaagaauugauucccuuguuuucuaaauaaagaaacaaagaccuggaaggcuaagcggcauucccaaggcuacacgucuuguuacuugcugggcugguuuugggagccaggucuccuucccauggaguaugcuucauggcccccgagugccuaucugcugugagugcaacuggagacguugaauuggcccaaugcaggucuuuuaucccaaauaaacacguuuagguuuguagguaacauacaaaccuaaacaacucuacggcuuuugaaaaguauuuauuauguuuauuucguguuggccauaaaaauaucaccuuauuuauugcacuuaaagguaacaacuugauguaaggucuuaugauauugcuuuguuuuauagugacuauuugaauucuaaauuuuuuaaaauuuaugaacuuauuucuuaaaaucagggcuuccguuucagauuuuauuauuucuugcaaaagagggaauaggauuaguuaaaugucauuuuugugguaccacccucuaaauuguacuuauauuugucuucaucuguccuucuucaaacuguccuuucuucagguauguccuaugugaaugcucuguaaauauggauuuuguuaucuacaugaaauauuugcauuuaguaaugaucaccaaauuuacuauuuagacauuuuuaaaaaacaguacuauguuaaucucaaagaugaguauaucaaacuuguuuuuaugacuuuaacgauaagaaaauaauccauauugucaagaacuagaagggaauguggaaaauaaaaaucuuuuaauuuauugcaguauugugggggaauuauuuuuuucucauuugauuuuugccaguguugcgauauaaauaauaauuaaaagcauguuguaugaguugaacuucauugaaaguuggcuauuccuauuuuuucuugauaggcauuacuacagccgccguuuguguuuaucccgcccgggugugugaugcuguaaaagcacucaaggcugcaggcuguaauaucccuguggcaucagguaaaauguguuguggcuuuuguuguuauuuuuuaaacauguuuccaguucuucauacaaugggguauuauauguagguuuguacuaugauuuaaauuaguuuauguauuuaauuaguuguauuuauucaugauuuuaguauguacuaauugcuuaguaaguggaagacauuuauucccaacaauauagaacuguauuccuauccuuaaagaaacucaguuuaggaggaauagucagguaaagaaaaaagucauaaggcaugacauauaguauauauauauauacacacacacacacacacauauacauacuauauauguauauguauauauacauauuaacuauauauauaacuauauacauacuaacacacacauguaugcauguucuguuauacauauauauguaaaauauaauaauaaugauaugcgggcuggggacgguggcucacaacuauaaucccagcacuuugggaggccgaagcagguggaucacuugaggucaggaguacgagaccagccuggccaacauggcaaaaccccaucucuacuaaaaauacaaaaauuagccaggcaugguggcaggugccuguaaucccagcugcugggaggcugaggcuggagaaucguuugaaccugggaggcagagguugcagugagcugagaucaugccccugcacuccagcuugggugauagaccaagacuccgucucaaaaaaaaaaaaaaaaaaaaaaaaaaacaacgauaugugcaaaauguguaguugcgguucugagcagggaaugauauauucugcagagguuggugacaccaaaguaagagaaagcaucgucguggagauaauugcauuggaucuuaaaggaugaggaggaguucacaguguuaauaagguagggaaccacauguuagacagaggcacuagcacgugugaaggcacaaagcauguucagggaacuggaaaagguuugcuguuguugacuacaaaggcagggcucugaagacagggcaaagggggagauacaggaguugaagcuagagagggagaucagggcagaauugcagaggggauccaugccaugugggggcauuuggccuguauucugaugauagggaagacacugaaagguuagaggcgugacgugaucagcuucauggcauaguaaguuaccugaugguacuggauaaauuagaaaaggagugaaauggaguuaggggagacuugucacaguacaugcaggaccugauaaaagccacacaaaaccuagaagauaaaggagagagugcauucagaagucacugacuucagauagacacgguaggacuugguaugacagaaaagucuuuaaaacauuaguuugguaaauguguaucuguguguauauggauggaugaauagacagauauaaaauuagauucuaguuuuaagagauguuagaggaauauccugaugcuuuaaaaagggagucuaggccaggcaugguggcucacaucugugaucccaacacuuugggggggcucaggcgagaggauugauuaaagccagaaguuugagaccagugugggcaacaaagaucucuacaaaaaaauaaaauaaguaaaaauuuaaaaggaguuuauaaaggucauuagcuuauuaggaauauauuaaaagaaacauggugcacaguauuuauauagaauugauuuaugaggauuccugaaguauuuggcagcuacacuuguauagaccuuaauuuuucaucagccucagucaguucaguuuuugcuuuaaacaacagagaaacaugcuuuccucuaagguaacagaccuaaggaauuuuuuuaauuuuuauuuuuugagacagagucucgcucuaucacccaggcuggagugcaguggcgcgaucucggcucacugcagccuccgccuccugaguucaagcaguucuccugccucagccucccaaguagcuagggcuacaggugugcaccaccacaccaggcuaauuuuuauacuuuuaguagagaugggguuucaccauguugaccaggcuagucucaaccucuucaccucggaugauccgcuagccuugaccucccaaaauguugggauuacaggcaagagccacugugcccagccccaaggaauuuaauaucaagguaacaugacagguuuuuuuagaaacagggauggagaguuaaugaugugcauguaaaagauguuacuauuuuucaagaguguaguuguguuuuguguuuucauuuuccucuuauuuacacuuggcucugcucuucccaacccugccccugccucaauuugguggacuaauuagguguguuuuccuccugcauucucuuuucuuuaugcucaucugccaggcugguuguuuuuaacauaggcagugggaggaacacauaggacaguuuguuuaccacagcuaaagagguucaugagagaauuaaucaagauaaaucaaggguaaaugaguaaaucaagauagcuaacuugaucaagauuuggacccagaacuagugugcuagauaacuaguguucauuaagauagggcuaccacuacuauuuuauggcuaucacugugaagauaaaacaucuuugcugguuacuuaauccaccuucaugagcaucucugcagcaucuuaauuucaggucuuccagaaaaugauauuuguccuaacacuaauaugagagaacauucaauuucuucacacuuaugcauaagugauguucuuaagugucagugcauuggucuuuaaaugcugauguuuggggguuuggaauucuuugaugaacuacuacugaccaauugaaauuuguuuuccccucccccccuugcuuacuuucuuucuucccuccuucccucuuucuucauuuccuuucuuaacucuauuaguggccgcuggauuuccagcuggacagacucauuugaagacacgauuagaagagaucagauuggcuguggaagauggagcuacagaaaucgacgugguaauuaacagaagcuuggugcugacaggccagugggaagguaggugcaugcuuuuaccuaagagaguuucaccauucuucccuggugaaucagaugaugagguaagaugugguauguuuuagaggucacuguucuaggugacaaguuaguagaucaaauggugaguuuaggagaaagcaggcuaagauuacccauccuugugccccucauaaaucuaggcaguugccuaccuacaugaacuuuucagauccuuuugagugcuuaggugaauaguuacuuccaugcaauagauucauaacuuuuaaaacaauuuuauuuuaccaacaugcuuuuucuucagaagggaaaaguuacuacuauucuauacuguuuuguuacucaauacauacuucacuccaggcaagucuuuuaugcaaaguuuauuugaauauauuggaggaaacuucccuuuuuuauguuaauuuuugcagucuuuaaagguaugggauuauuaaguugacuaaguuuauuuuuacuucuagcauucuuagacacagcucugaugacuaucaugaaauuaaugauucacuaucacgucagcauacacuaagacauugcccuuuccagcaacaagcuuuuguuuuuuuaaacagauauuaaagaaucaaauagauuuuaccucugucuuaaauauauuuuguguacuaaagaugaggucauugguagcuagaaaaguaaaauucucuuucaaaaaagucauuauaauaaauaguuuaaccaaaaauuuuuaaugaaaucacaaguuaaagccaggauaguauauugucucuuuauauaucaaauaaauggcauauuuuauacuaauuauggaggcuauucccacacuccuuuaaaguuuaaauaagagauaggauuuuaucucuuauuuaaccugcuuauuggacuugccuauuucucauggguauuuuccugugacuguuucuauccaucuguaucuguaaagccuaugucuauuugugaagccuaauuccauugauugucaauuaugaauugcuuuugguuaugaaguagcaaauguucagucagugguuuaaacccucaguauuuauucucuuauauaaaguccagggguagguauuucagggguguguggcagcuccacaaaguucuuggagacccgggcuacguuuauauuccaguuccaaagcauguggcuucugcuguuaaugucaagggcacuucauugucugagauggcuucugaagcuccagcaccuuacacucaucuccaagaccauaggaaagaaaggcuuuucucaucaagucucacacaacaccuuuguuuauuacaccuuugcccguuggccugagcugagugacguggccauucuuggcugcaaguaagcuggaaaauagaguuuuuagcuuggaauauuaacuacuuuccuguacauucccauuuccauugcguucaccccacugccccccaaguuccccauuaauacucaucaacauuuauaauucuugccagguuuaaacucuugacaguucacaaauaucuuuuuguauuuuguguuccuuuuuugugauuguucauguguguguuuuagccaauuacagucauucugaaaaggcguauuuuaaauagauaucucuguuccuauauauuaauuuugcuuaucugcuuuuagucacggauuucacuaagauuuaaggcuagaguaaaaugaaaaagugaguaagcguaguauuuaaaacaaaucuggcaauaaacuuuaugugauuuaguuguauacaaaccuauauguccuuuauaucuuaagcaauuguagauguagaaauuggguuuauauuauaacuuacaccuuuuauuaagcaguuguggauauagaaauaugguuuauauuaugcuacuaauuggaaaauaaaauacaauaggagauggguuuugauguagcugacugccccuuaaugaacuaggaaugguuguuuuuaagaacugauaauuucccaauaacaggcguuuaugcaaaauguaaugacagaucuuuguccuggaccauacuuuuauauuaacucuuuuucuaguguuaauaaccucuugacccaaacaaauugaaaaggaacauuuaauacuagaaauuuaauucuaaauagaaaccugaaaugacuuaggacuuuuugcugcaauauuuugucuuaauuuugauucucaauuugauuacauauuguauuuuucagugucauguuuuaauauuagcuguuuauuaaaauaugagcauaaaauaauuucuuggaauuuguggauggaaaugucuaucaagcaauugcaguuuuaaauccagggcccucucccuugugcagugagguuuguaggauauuugguaaagcacaauagaaagaaccccauuuuauuuuuuaaguucugggguacaugugcagaaugugcagguuuguugcauagguaaacgugugccauggugguuugcugcaccuaucaacccaucaccuagguagguauuaagugccucaugcauuagcuauuuucccuaaugcacuaccugccuccacccucccccaacaggccccacuguguguuguuccccucccuguguccauguguucucauuaagagccccauuuuuuaaaccuggcccuucagaguggucuuaaccauuucucauggaugugagaguccacaguuuaggguaugaauucgaggagacuggaguuugggggugggggagguuugauauuccucucuggguucuccuuagugaccauuuaaaauguccacuuuccugaaauuucuaacuuuuccacccuccuugaagcuccuucacuguuagcauaugaacugccuccuacuucucagagaaaauaaaaucaucagacaggagcucccuccagguccuugcaucagggcugcuuuucuuugcuucuuccuuugcuccuuccuccuaaauuccuucccucgacugugcuguggcucucaucucccccugcauuuucagaagcccugcucuaucuauugggcauucuuucuuccgugucaucagccuuucugccagcucauucccauuaagcauuuagacauacucaagcuuuucuuagccauuuaugaaagaaccuacaugcuggcuuuccuuuuccuucauccccagcaacguccuccuuucuucucuucccuucaugacuaaaauucugaaaagaaggcccgaugcgguggcucacaccuguaaucccagcacuuugggaggcugaaacaggcacuuugggaggccucaucaccucuugcucugcugccgcccuaagcucugguuccgcagcaacgcucuggagugaggcguccuccucacuugagguugggaguuugagaccagccuggccaacauggcaaaacccuaucucuacuaaauauacaaagauucguugggcaugguggcacaugccuguaaucccagcuacucuggaggcugaggugagcgaauugcuugaaccugggaggcagagguugcagggagccaagauugcgccacugcacugcaaccugagggacagagugagauucccucucaaaaaaaaaaaaaagaauucugcaaagaguuauauuuauuuguuugucuugagaaguucaaacuaauauacuaaugaccugucaucucauuauguccagggcauacuccccaguuguuuauucagcauuaccaugcaacauaugacacagcagacuguuccuuccuucugguaaugcuuuguuguuguggcuuuggugccuacauuccugaggucuuccuuucuguuucugauuaccccugcgucucauuugcaagcuccuucaccuccucugucaucccugaaguguccauguuucucagaaucugagaacugugguucucagauucugucccagugugacuuuuccacaaccuuggugugcuuuccuuuggaaacgucauguccuugcugauuucaguuacauuccuuauggcaaagacaaccaaaccuccugagcaccaggaccaccuggacccggggccaccugcuccagaacucguauuccguuguaucacuacaccauguugcauuuuacccaucauuuacauauaaguagacauucaaauaucacugacccuugacaaaaucagagaaauauagcuauuuuggaaauaaaucuauuaggccgggcacaguggcuuaugccuguaaucccagcacucugggaggcugaggcaggcagaucacuugagcccaggaguucaagaccagucugggcaacauggcaaaaccccaucucugcauaaaaaaaaaaaaaugcaaaaauuagccugguguugugguaugcgccuguagucccagcuacucaagguugggccugagaugggaggauuccuugaaugugggaggauuccuugagccugggaggcagagguugcagugagccaugauugugccacugcacucauaagccacugcgccuggccuaauagauuuauuucugaaauggccugagcaagagagugagacccugucucaaacaaacaaacaaacaaacaaaaacuauuaaaaaguguuuucauuucccugacuuucuuaacaauuuuuauuaaauacaauuuaauuuuuucuugauuauuccaaacuguuucauuacugauuauauuaucccagaauacagugaugcuuucaggggccaguggaaucucugagaugauuggccucauagcucacaguccagacucuugugcuuuuugauuuauguaucuucuuauuuguuacuguuuuuuugccuacuccuuagugguuaagcuuuuuacugucagaucauguugagcucgugacggcacacuguccuucccugccaauccuucugucacuccugucuagcuggacauggaaacguggauaacuacauuucucacuuaccaccauaguuuuaacccuauaggguguggcauguauuguaggcucucaaaauuacaauaccugacaaacauuuucaaaugauuugccccagcugcuuuccugacaggauuagcauaucccccugggcauuugugauaaaagaauugagguguguaugugagggaggaauaggcuucuaaauggggaaaaucccuccaggugauuuuguucuccuuccccaccagucccauguccuuauuaagaaguacuaacucaggacucuuucuucuucuucuuuuuuuuuuuuuugacauaauuccaguucuuaguugcauauacuuuaggugccagauaauggaaacauuguugaauuuacauacaacaauguacguaaauucauacauugaauacauuuauauauuguauguuuuauuguauuacuaauacuaaucaguugauuaauuaguacaucuuguauuuccuguauguuucuaugccguuagccuggaucuguaguuaguuguaaacaggagaguuugaugaauaaaguguuauucuggugaauuuagcuaagaagugcaucugcuuccugugcucuugagaaaagaagacuuuccucucccugggauggcugugcucucugauaaagauagcauccaaguggggacaucacccggccaggcagccaggccacccagucauugcuggugucacagucagacccagaacaaaugcaccaugggguaagaagggaggacaguacugggaaagcaggaauaguugaaagcugcaucuuugcauuagacagaucuuggcuggaaucuuggcucuaccguuuacucuuggacagguucuucucugugcuuucuguuccuucuauguaaaguggagauaaugacaucuacuucacaggguuacaauagggaagaaauuagauaauguauguaaaauaucauccuguugcuuggcccagaugcagcccuccuugccagcugcaguguugccuucucuuucucccuccuccugccccgaugauggucuguugucaagggaagugacacauagcacauguguuaagugaauaaaguggaacucuaaagauuuggguuuuagucuuuaugauuuugauaauuuauaccuagaccuuggguaaacacuucacuucucucugcuuccauguaaauguuacaaaugaggggcuaggacauaaugauuuuuacaacccuuuagagcuauaaugaucuuuaauuuuauguuuaguguuuucauuuucagugaauauuauucccaugauuaguacauguaauacaguauuucuuaauggugguguugaaguugacaucuaagaugcacuccuuaaacaguucuuugaagaaagcauucaccagaaguuguucaucauuucauaaaucuuauugagcagguuuuaaaaauugaauaguuuccaugcucuguaaauauacagagguguucauuuuacuuuuuuuaugaccucuuucuguugcaucuauuuaccuaauauauuuaccagugacagggaaaugcuaucagauugcaccuuguucaggaaucuagcuccaugagcugaggaccuggagcuggcuuuacuagcuuugggagacucauuccacacuggagcaccagcagacguaguuccaaagguggcuaggauugucugacauucugcagcaucuuauguucaaugggcaauuggaaguaccauucgucuccuguauccagagccucauguacuuuucaucuccuucaauuguuuaccccugaauugcucucuuaaaucuggccugugaaguacauacaucauggcuaucaaacauuuuaggauaagagaaugaaauaucagcaccaaagucacauuauuuuucauuuucuuacaugaagagaauccuaaagaccuugaaucagggcaauaaucuauuuuucuuauuugcugauuuuuacacaagaaggaugguagaaagaacaucucaaaaauaaauugguauauuucuuuuauagaguguuaaucauauuuuauuagaaaagcagucucuaaaucgauagcuacuuuuuggggaggaauuacauaaucuauaauuugugauuucucuguuuuggaaguuguauauaacagaaauucuggaaauacgacaacuguaugcuuuuaugauuuucauuuuuaugcuacaauucuucaaaacuucagauacuauugauaaaaaugugcaucuuaucucuuguagguuauuauaauaucugguguguuagcucaucucugccuuagucuuacaagauuaauuaguugcuuugguggaugaaacuguguucuugaacauuuugugacuuuuuuaguuuaaaagguugcuguacaauuuuauauuaaguguuuuacuguacauauaauuaucuuaagaguuauuuucaggccauucuugugcaguguugaacaucuuucugauacucaaaaaauaauugcuuagauauguucguuaacaauuauuuuuaagugccuuugaauagcaggaaauauagaaggaaauauacuuuaugacuuuuagauaggaaacagucuuuaaacgcuuggauucuuacuuaaaucauaauuuuauacauauaaguuuuauuaacagaguuuuugaugucuagagcagugcuuuuccagaauacuuagcagauugccagccgcuucaaaauugagaagauaccguccuuucagguggauccuagagagaagaaaguuaauuuuauuuauuuauuuauaaguguuuuuagcuuuuugaggguuuuuaaauuuucauuucuuuuuuuaaaauacaccauucuauuuuugaaaauaauguuaagaaugagcucauuaaaaaagaaaacugaaaaaaaacagguacacccacauuuccaacuccaucucucuuuucagacuguucaagauguacacauguacuugguauaucuguagaccugauucuuuccauguuguuuucagagguugacaccaaacuaccaaguagauauuuauccuuugguuuaaauucagauuccauuccaccaaagcaacaugaaaaaaccuaaugucuaguuuuagcuucuggggauuacauucuucagguaagaagugaaaauagagaauaaaugguguuaccaucuuuauucagaaagucauuauuuuuagcaaaauggggccaaggcagaaaauccagguuguaagauuuggaaaaaggaguguccacaccaugggacauguacagauugaucacuaugacagcagcccuuuauagagguaauaauguugucauuagguugugacaauucuccagagacuucaacagccccggauuaauaacaucuggaaauuguucagaugacauaaauuucuguuuucuguuuuaaggcuuccauugugccuuucuguggcaucugccguuguuuuucuuuuucaaaccuuucaaaucaggaaauauacauaaaauacaagauuauuuuccucacaugugcuccuaggcucuugucuugauagccagcguuaccaaaucuaucagguaaacugcuggccaacugguaugucugcuggaauuucuggagguggaauagcaaaugaguucaucuggcaaagagagcaucugaagguccaugcagucuuggcaagaaaacacuaagucccacacauaagacagggauggggaguuuuucgucacugaagaggccaucuuuauaucucaacucuuuuuuuuuuuuuuuuuuuuuuuuugagauggaguuucauucuuguugcccaggcuggagugcaauggugcgaucuuggcucacugcagucucugccucccagguucaagagauucuccugccucagcgucccgaguagcuggaauuacugguguccaccaccaugcccagcuaauuuuuuguauuuuuaauagagaugggguuucaccauguuggccaggcuggucucgaacuccugaccucaggugacccaccugccucggccucccagagugcugggauuacaggcgugagccacuguacccagccggaucucaacucuuaaagauaauucaggaaccauugcuaaagugaacaaggccagcagauuuuggagcacagucaaucuucagugagggcagauguuuccuaauuaaauuccugaauuucuuuuuggcuucuguccuuucuucauuaucaaaguaccaaacaguauagcacaucuggucucauaggaagacagcaccucguguagcuuccugcgaucugaccaggagagcaggacuuuuucacaauuggccuccacaucugccacgaaugauuucuccucugaaaauagccauaggaucccaccguguagccugguaucccaguucuuguucagauaguagaugcagguggugcagcagccaucguuguugagguguccacaugaugaauguaaccuauuccauuuuuaagauagcaagccaccauugccuuggaccucuccuugacauaguauuuucccaguggcuccugcacuagaggacuagccugucagugagggacaggaggaagccaauggccucgcggcccuucuuguugcucccagaacuguggggugaacugaucaccccacaguucacccuuuagagacacugcacacaucccagccagcuggcugucccgcagggcccccuugcaaugcagcuguuuaaugugcuccuggaugcaguuguccaccaccuccuugcccaggaaguuuugcggguagcagaagcugacuucccgcagacagcgcaugauguacucuagggaaauuuucuccaauuccugccucaugaugugucccaggggcauuucacgcauagugcagaagucggggaccuccagcgugcacccagagagggaacgauguaugugaugugaagccaagguguggggaguguggccauggucccgagccaccgcagucaguacuggggacaggggaaaguugcucacaacucucaggagaagggaucugcguucagggaucagugggaguggugcgggacuccacgaucuagugcuggacuuggaaguuaaucuuaaauaaagaaaacuaaaaugcuaucgaugcaaguuccugcuggcgugcggggacagcauugcagaagguagggccaguugucaaccugauuuggaugcuguuucaaacaugcagucugaccccuuucccuccuuuccacuccuuggauccacacucugaugcacacaggccuuucucauuguggccgagugcucugauuccugucagugagcacuccacugacacagccucacuuguuuuucagcugggaacgacaggcagaggucagguuaugaccucuacuucuucucaguguggcaguaguaggagggaugcggggagacaaacgggagacaacucuucugcuaguugugccacuauauugauuaagcaucugcaauguaauauauccugggcuucuagcacacccacuuucacuaccccugaaaaccucauuauaagucaaaacauuuauuaauagguuuuuaaugugacaucacuaugccagccacuucucugguguauguguuuuguuaaauuuugcauuauucugacuaauuugcagucgugguauuggaauuccauuuucauuugucaggcaucuuugauaauauauggcaagaauugcuuuuuuuauaauagagaauuuccaguuuucauaauguuugaauuuuuaacaacagacauauauuacaugugaauauguaagcagaaaaaauaguaagggcucuggagaauaaggucaugauguuugcaaauauuuaacuauaaggacauuuacugaaguauuacuuauaauagcaaaaaaucuggaaccuuaaguauccaauaacaggaaaaugauugaauacauuuuuuauguccaugugauggaauauugugcagccauuaauaauugcuccauagaccuauauuuauuaauauagaaauauaucaaggauauauugaaggaaaaaagcauguuacagaauaauauguaccauauguaaucacuuuuuuuuaaguuauagaagccauagagugauugauagucuaaaaagcccuccuguaagaaaaauaucuggaugcuaaauuacaacaaacauaucaaauuauuuuuuaacuuuuauuuuugaauaauuuuaaacuuacagaaaaguuguaaaauugguacgcaaaacuacaguuuuaucacugagauucuccaauuauaaagugcuaucccauuuccuuuuuuugacuuauuuccucugugaaguguguacauacauauauaaauuauguauuauauacauauuuuucuggaccauuugggaauaaguugcagaccuguucaccuguuacccuuaaauacuucaguguguauuuccuaagaacaaggacaaggacagggacacucuuguaccaagccacaguacugcaucaaaaucaggaaauuaacauugaugaccauacggccauuaaauguacagauuguucagauuuugcagauugucccaauaguguucuuuauuagguguaguaucaguuguuucauaucucuuuaauauucuuuaaccuaagaauacuaagaacaguccucagucuucccuugucuuugacgauuacgggccuguuguuuuguaaaauauaccucaguuuggguuuguuugguauuuucucacaguuagauucagguugcacauuuuuggcagguauaccacagaacuuuugcuccguucuucucaaugcauuauuucaggagucacaagauguuaauuugucccauuauugaugauguuccuuuuuuuacuuggcaaagaugguuucugccaaguuucuccauuguaaaauuaauaaguauuuugcauuuuaauaaguaauuaauauagauuaugaauggagauauuuugagacuauguuaauauccuuuuccucaucuaacuuuuauucacucuuuuagcauccauugaugauuuuuucagcuauuacucugauuuucuaauucugucauuucuucuauacuuaagaguuggcauuaccaaaucugggcaugauguggaacccuacaaagccagaugugguauugagguccuucccucgcucccuuccucuguccuucccucucucucuccuucccucccuuccuuccuuccuguuuguaagaacucauugauucuuauuuuacucaauugguuauaauccuuuaccaucauuauuuauuuugauacucaaguagucccagauuuggccauugggaguguaaccgcucaguggguucaccuugccugcugccuacacagagcuaguuucucaagacggaaauuacaguagagaaagaguaauucacacagagccagcuguguggcagaccagaguuuuguuuuauuacuacucaagucagucucccugagcauuugggcauccgaguuuuuaaggacaacuugguggguggaggaagucagugagccaggagugcugagugguuggcuaggagauggaauccuagggaauuauuugaaccuguccucuugugcugaauuaguuuuugggugggggccacaagaucggaugagccaguuuaucgaucuggguggugccagcugauccaucaagugcagggucugcaaauuaucucaagcauugaucuuaggagcaguuuagggagggugagaaucuugcagccccuagcugcaugacucuuaagccguaauuucuaaucuuggagcuaacuuguuaguucuacaaaggcagucuaguccccaggcaagaaggagguuuguuuugggaaagggcuguuauuaucuauguuuuaaacuaugaacuauaaacuaaguuccucccaaaauuaguucagccugugcacaggaaggaacaaggacagcuuaaagguuagaaacaagguggagucaguuaaguuagaucucuuuuacugucucagucauaauuuugcaaaggcaguuucgggaccugcuucacacuggcuccucuauccuuuuuauguucccaucauucuuugagagcuuccuugcuuucuuguaauagauguuucaggcguaucuuugacuuugucugcuccagcuuuggaaucagucauuucuccaaggagcucuugcuccuuuuauugauuaacuguauuuagaaaccaagaucugggugcuagguauaacucacugcuauugggauguuauuguuucuaggcccucuugucagacagaucuaguaaauacaugaacguacacauauacacagcacacacauagaaacacacauucauuuuuauuuauuuauauaucagucuauaaaucugucuuagaacuuacaacuucacacuauaaccucuauuacacuccagcauugcaugguuuauucuuacuuuccccuuccauauuuauaccccuucuucccgucagugagauaucuugcucccauuauccauuaucuucaguauauucaucuuuuuuaucaauauuugccuuuuuaucaauugcuuuguguuugacaaucucuagaaccugcggguugucuuccuggcucuacuugccaaguccuccccaaccccuagaauuuucaguccucgcugguaagggugaccuucacuuuccccagagcugacugcacgucccccucaccucgccuccaucauguugccaugauguagcaacaugcaggccaagaauuucucuaggccccagugacaugggggcuagguuucucuccaccuucuuggcaguguguggcugagaaaaucccugcucucccuugucugugguugagagcucccaaagauagaguucagaaucaucuuucuaaaucaacaagaggcucuuucaucuuaauuauaacagcuuaaacuuuuagaguaagucaacguuuaccaucauuuuacgugugcuuauuaucaaagguggaucugaaggaaaaaugauugauuaccuuccuaaccguuuuaauacuuuuauauuuauuggcagaauuugagaaggguuugagcuguaaaaauaaagcucuccuaucuaaucuugaggagaaaaaugaagcuuggagagguucaguaacuuucccaaguaacaccacuaaucagcggccaagcaagggcugagaaguccugauucaaauauaugaacucuacuguagcaccauacccugguuuucuucccauccagggggcuaaaagagcaauuuagagaucauuuuuaguguauuauacaaaauuuaguaucuuauauuucugaauuaccuuggaacaaagagcaauuuagagaucauuuuuaguguauuauacaaaauuuaguaucuuauguuucugcauuaccuuggaacuuuucauuuuaugcagcuuuuuuccccuagaagaaugaaaaccagguccuaggauucuaaugcccaucugucaagugaguaguuugaacuagaagggaguugacauccuucuacguucugaguuuugacgaaucuguugcucgaagcacugcaauguauuucccugggaauauguuguaacugcagugaguguacacgugcaugcaugugugugugugcugggauagaggcagaaaauuuugaggaaauacaguuuuauuccacguaugaagacaugacuccuccucucuguucuauaacugacccacaguaagauuuggagcaagucauuuaucucuccacaucucacuuuucuuucuuucuuuuuugagauggaauuuugcucuuauugccuaggcuggagugcaauggcgcaaucucagcucacugcaaccuucgccucccagguucaagugauucuccugccucagccuccagagaguagcugggauuacaggcauuugccaccaugccugguuaauuuuuugcauuuuuuuaguagagacgggguuucaccauguuggccagacuugucucgaacuccugaccucaggugauccaccugccuuagccucccaaagugcugggauuauaggcgugagccacugcacccagccuacaucucaugcuucacaugggaaguguggagguaacugcaaauugucucacgauggaugguuaaauagcguguggagaacacugagcauuuuugagggaagaggcuuugaaaacguaggggauuucucauccuuuagaguaauuauuccucaugaaaaauuuuuuggaaagggcaucuguugaacuuauugcuucacuuguaauuuccucuguguauguggucuagcagcaguuauaauaacuccauaccccaccauuguccuuuccuaccaacauaggggaaaaccugcucauucguuuuuccauuguuuggcuuauuuguauugaaaggaaagugucagcugaguuuguuaaaggacauaauuugagauugacuggguuacauuucagccaucaagccacuuugauuagcauaugucauucaucuaguuucugaggugucuaucaugguacugucaaaguccucaaaacgaccuaaacacuaauaaugcuucuuugugguuucuauggcuuguguuggagugaaguggucuauuuuuucuuauauguaagacuggcaaauucuaguugugcuuucauaaguauuaggacagugcuugcuauuuuuuguucguuaaaguuauuuuuggguuucuggaaguguauaagggaaaauaugggaagcuaguauugaaugauuaacugccuacuaaaugccugguucuauucuagcaacauauauuauuuaaucaucacaaaaauaugugagcaaacugagccucccuaaguaauuaggcuuagagaaaucgaauaauuccuaaauguuuacacaacuagcaaguagcaaaaaugucuuaucucaagagucugugcuauucaaaguagcauggguucuuagcuuaaaaacaaacuuguuugugauauauaguaagccguuucccccagacuguuuuuuuaggggcccaaagagguuuuauuuuauguucuucaaggaacauagaucaugguguccucugcuuuuguaagucccucuguaaucugagccugauaagcacugaauaauaacaggaacaccaucacugcugccaccaacaacuuugaaaacaggaacugacauuccuugagcaugaacaaugugcuggauauuguccuuaucuauucguguguguuaaccuguuugaaaauaacuccgugaggugugcauacuucuaucauucccauuuuguaaaugaggaacaugggacagguuuagaguuaaguaacuuacccaaaucaaacaauaaacuaguaguaaaguuggggugugaauccauauacucaggagaauccacauuuuugucuacaauacuauacuucuucaguaaauauucaugaguugaagaaaaccaauucugauuaagugaagcugaaagggaauuuauuauauuaggaagacauaaagaagcucacugaauaaguaggaagccuugcuuggaaaaaaagcaggaccaugagggaauaaggagcagagaacacagucagauugugccacaggaagagcuugggcccagggccacugcuggugcugcuccuacuggccagcacagguaccacacuguuggcugguggcuggccccugggacacuggacuuuuggaucuccugcuauugcugaugccacaauaauaaagaaaauaucuaacuauucuuucaucuuugccucacucuuuaagauucaaaggccugaguagaagcaaucacuugauagagcccaggucacauuuuaaaaagaccagauuugguauaacuuuugauuuaauuguucugauauauuuugggcagaaugguaacagaaagaaaugacaacuuuccaccuguugaaccuuaaagauuaagauauuuucucagaaaaacuugauccuguuaugugguaaaauaggccaguaaaaugauuuuagaaauuggcaguuaaagaaugagaagacauugguugcauauuuguaaauccaguuaugcucuaagugaccacuugcaguucauucuguuuggaucauggauuaaagaguauaacuuccaaaugacugaaucauaaaauaccucugguuuucgugguuaauuuuaacuauacuucaagaaauucacuuggcaucagaagguaguacucuagaaaaaggaugguguuuuuuuguucacaaauauggucgugaucaguguuuuaagaauuuguuuuacaggccaaaguucacuuuaacaacugcuguaauaaaauacuuuccagccuugucugauggcucacugauuguaagcaguaauccaacagaacuuugguuacuggaacugggucaggccaugaaauaagauuugacuuuuauaacacaacacuuaguggaaauucauuuuacuagaauucugaacuuaauaauuaaacuuuuugagugcuuauaacaugucaggcaguaugcaaaguacuuuguauaucucucucucauuccugguaacccuguaaaguaaauauuauugacacuuuaaggauggagcugaugcugacagaaauaacuugccuaaggucccacaggaaaugauggaguuggguuuuaaaucugcauuuguccuacucuaaagccugcuuuuaaugacaacacuauuuuguggaagaaaaucauuaauuaaaucacaaguuaacuuggauuagcguucuuggauuuuuagaucagaagauuuuccuugucacuuguucuuagaaaacaaguuucuuuuuuuagauucaauaacuuaagaaaugucauuccauccaauucauucucugaauuaaaagaauauaauuuuuuuuuucgcuccauagucuauuacuauuuuuaacauucuuacacagguugucauauuggaggcauaaguaggaugauuuucucccagguuagguagaugggcaggguaagguaggugguguggcaucucagaucaucccuaguacucagaacugcacguuauuaaggaucugugaaaauagucuguucuuuauugaaccuucuguggguaccaucucucagugguaacaaacuuucuaaacuuacugagcaucuuggaauagaauauuugcuuucauuucucuucauuuuucacuucugagcuucaaguucauguuuucugugauugagaaggcaagcuuuauuuggcuguuauaacuugugguuuuaacugagacuaauuuuucauuuuucuaaauguacuuuacuaagccugugaauuauagaacucucauuuuagcuuuaagaaaugcuuaccccaacccuuauuaugaauguuucccuccugcuugguuuacucuguauguuuauaaaacuacuuccuaugggccgggcaccguggcucacaccuguaaucccagcacuuugggacgcugaggcaggcggauuaccagaucaggagaucgagaccauccugguuaacacggugaaaccccgucucuacuaaaacuacaaaaaguuacccaggcgugguggcaggcgccuguagucccagcuacucgggaggcugaggcaggagaauggcgugaaccccagaggcggagguugcagugagcugagaucacgccacugcacuccagccugggugacagagcaagacuccaucucaaaaaccaaaaaacaaaaaacaaaaaaaccuacuuccuaugaaagauacucaaauacaaaggaaagaaaaagccuuggucuuguuaccauggcaguagccugaguucaagaaaugauaguggccggccugaaaaagccaaaauucacuaguaucauugacaaaagacuuaaauaauuuuuuaaagauuuaauacacaugauuuuggucuaauuugcuuacuaaaauccugcuaccuuucauguaaaauguuaccuugaauaugaaauaugaaauaaaucugggcccaauguggaacccuccaaagccagaugugguacuggggucaugggcucagggguuaacagauuuaaggcagcaucucugagccucccugcagagauggcuuuguacacaugcguccagcacuaccuggccaggccuaacacuuuuuagucagauauauaaacauacucuggcaggcaguggggcaagcugcugugucuuuauugucaugaacauaacucucaagaaaggugugcuuuauauccaaccaaagaaccuauuacuugugaauggaagaauuaauaagaaccuaagauuuuuuuuuauuacuuugcaaagggguacaccacuguauguaugguagcuacauuuguuuuuuguuggaagcaaccaucauauggacaagacagaaauuauuuauaauuugcaugucauuaugauauuuaaaaagcucuaugucucuggaccucaggccagggcuuagaaacgguuucaugguagcaaacuaagcauuccuuguaacaggaugugaacugcaacagaaugcuccaggcaauguuaaauuggggugauuuuuagaaagugacaaauguuuuauguuuccuaaaugugaaauggguuccaccagcucuaaacggcugccaaguuauguuaucacuugccugcuuuguaacugccucaauuauuuucuuccccagcccuguaugaugagauucgucaguuucgcaaggccuguggggaggcucaucuuaaaacuauauuagcgacaggagaacuuggaacucuuacuaaugucuauaaagccaguaugauagcaaugauggcagguaaguguuuuauguucaaauaauguuuucuauugaauugauguuuuuaggagaaauuaaguaagugaaagcauuuagcuauuauuaaacgugcuaaccacuuggaauuuuuuugcgggaggaaucggauauuuuguaaaaacauguucaaugugaaguggucaaaaacuccuggcuuucuuccacauuuuuuuuuguguguguguggcauuucauugcugcacuaugcuuauaaggcaguagauggcucucuuguuagugaauugccuucuguuuuauucuuugauuauucacucaucaacauauguuagacaggaauuucuuugacuuacuccucucugaauuuaagcuuuucauuuaucucagagauauauauccauacuaucugagacagccucugcuuuuguuuguguuaauguuuuaaaauuuagugcaguaucauugauuuuuauacuuucaaauauaaguugacuuauucuuuaucucugugaacagcaggucuauccauuuagacauccaagcuugcagccuaggagucaugcuugguucuuucuuuuucucaccucacauaaaucagugaagaagccuugagaguucucucuagaccucuuugcugugucugacacaucuucccuccauucuaagugcugcugucuuaggccaccauccuccuccacagggauuacuucagcuguuccccugucuuccugacuuuuguuccccuccaaucuguucuccacacugucaccacaauuuuuuuuuaaugcuaauuuuauuaugguacugcuugcuuaaaauuccuucagugguuucccuucaucuuuaugguaaaguguacauuccuugauucuuauuuuaaaaagguccuuccuaagacccuggcugugccucugcugugucauuuucccuucacaccauguucuccagccagguagaguuacuugcacuucucugcagauggugccauccaaccuuuugagucuuuguacguucugugccuccugcccggaaugccuuuugcccaaauaacuccacaucuugggguucagcacagguaccaccuuuuucaggaauuauuuccccugacacugcuucucccccugcuguuuggcccauuaucuccucuguguguccccacggcauucaaguaaaagcccuaucauauaacuuaucacaugacauugugauugaguguugaauuucuagguguccuucuaggggcccuauauuuggaugaagauaccugguuucucuggucuugaaucugggccagccauauucuuguguacuucuugagugcucugucaggccuaguagaucauuccuuggaacucuacugaaaaucagccuacuagucagcaauggugcuguugcucugggcacaacugcuguaucuagaaaauaucugcaguuguuaucugagagcaaaaucucagaaaaaccuaaggaugagaagggauggaacacuuugaacaguuguucaucagugauguuggcauuucaaagauucacaguagaagacucacugugccucuuaggaaccugggaaaagccccuuggaggcuacuugguguacagguagccccccuuuaugcugcuugccagcacaagugauuguuagcccagguaacaaaguaaaaguuuggaaacgaauaacagcagccacuuauaggacauacuuugugguagccacgcuguugguugugcacauggagcugagauacuccucagggucacaucggagccaaucuugugauaccuguuaccccagcuguuauccuggucacaaugaaaguguauucauucugggaggucagccaacccuguccuacgcacagcaccuacuacucaugauacaaaugugguauuaggucaucacgcuuuggaagcugugucccacccuccacccauccuguccacagaaaaaaaugugauuauaaacaugucccuuuauuucuuccugucugcuuguuucucuguucauguuguuuauccacuucauuucuucauuuaagcaguguuuguugagcacuuaguaugaguaauaaaaccguauucauggugugcuuuaccagguacauugaaacaauauuccuucguccucacaucaguccuggaguggaagaaaucuaggauugugugacuuguuuaaggucacaaagcuaauaaauaaccuguaucacuauuugaacacucuggucuucuggcuccagauuuauugcuuuuucacuuguaacauggcuauuucccaaggcacacacuagauuuuaucaugaaugaaagacacaaucuuugugaggcauaauauaugaaagcauguagcauacuuccuggccuauaguuuauacuuccuacucuguuaagaagguauauaauagaauugaaguauucuuugaugaacuugaaauauuuugaaauauuuuuuauauucuugucccaauuuuauauguaacuugcacaaacuaaucuccccaaaaguaauuuacaaauuucugacuaaauucuguauucuacuucuguggugguauaaaaaauuuuuucuuaaaucaauuucauugaggcagauuugcauucaguaaaauucagguguuagauagacagugugaugaguuuggcaguuugcaaacaccuguaaccacuacucccuucaagacacagaucauuuccauccuccuagaaauaucuuugugucccuuuauagucgccuccacucagcucaccugcuguccccgcugcaaccacuuuucuacuuuuaucaccaugcuuagcuuugccaguauuagaacauuaucuaaucacauagugugaacucuugggugcuuuguuuuugguuuguuuugcccucacuaaaaauaagagauaagagaucuuaaggaguuugccuagaaguauuucacuguguaaguauacugaguugcuaaaauuguuggcauaauguuguuuauaauauguucuuccauucugauaucugugggaucuguaguuauaucucuuucuuuauucuugauauuggucauuuuuguuuccuuuccuguuguuguuuuugcuuuucuuuccuccucugcuuguucaugcuagggcuuugccaauuuuauuaaucuuuucagagagccaaguuuuuauuuuguuguuuuuuuuucauuacuuuucagugaaaguuauuuucuaauuucccuugugaucucuuuuguuauuuagagugcuauuuacaaugagauauuuacuuuccaaauauuuugugcuuuuauggauauccuauuguugcuuuauaauuuaagauuuuguuauccucagagaguauccauuguaagaaucuuuugucuuuuggaauuaacaguuauuuuguagcucauuuuaugguuguauuuaguuauaugcuucaagugcacuuaaaagaauguguauuucagauguuagagcaaaugucagaucgaauugguugauaauguuuuucagaucuaguuuuguuuucuuuuuggucuacugguucuguuuauuacuaagagaguguuaaagucuccaaacaugauuguggauuugucugguuaucccuuucgucugucaguuuuuucaucauguauuuuggagcucucuuauguauauauaccuuuaggauuguuauguuuaccuguugaaguagcacauuugucauuaugaaacgucccuuuuuaucucugauacuaguccuugucugaaugucuacuaaugauguucaucuggccacaccagcuuucuuguguuuaauacuugcaugguauauauuuuuuuccaucuuuuuauuuucaacccaucuguggcuauauauuuaaaauguaucucuuguaggcauuucuuuucuaaucuauuaugacaguuucuacuuuuuagaguguuuuauucauuuacauuucauguaauugauauaguaggaguuaagucugucaucuugcaaacuuuuuccuguuuguuugaaucuauuuuugguuccucuuuucuugcaaccuuuuggguucauuagcuaucuuguaacauuuuguaucuucuguuggcuuuuuaucuacagacucuuugcacaaaauuuuuaagugguugcucuaacaaugugcauccuuaauuuuucacagucuacuuggaauuaauguuguuucacuauacaugucacaaauggaagaaccuuacaacaguuuaauuuacauccucauugguucuuugaguuauuuuaauguucuuuucuauauauauuacaaaccucuuacuacaaugauacgaauuuuuaacagucacuugucuuuugaggacauuaacaaagaaaaaacuaagauaagcuaguauuuuauguuuucccuaaauguaucacuuuagucuuuauuucuuccuauaaauaugaguuuccaucuuguauaauucagucugggaaacuucccuggguauuuuuugcaguacaggucugcugaugaugaguucuuucugguuuuauucgucugaaaaugucuuuauuucacccccauguucuaaggauaguuugcugaauauagaguucuggguugagcauuuucuuguuucagccuuuaaauaagucauuccauuucuuggaaucccauuucuucuuguuuccuuguauguaauaucuuaucuuacucuagcuauggucaaucaauauuuuccuuuugucuuuuuuguuuucccaguaauuugaccacaaccgaccuaaguaugguuuucuuuguauuuauccugaacuuuucugagcugcuuggauuuggagguugauguuuucuaacaguuuaggacguuuucaaaaccauauauauguacuuuuuuuuuuuuuuuuuuuuuuuugagacauagucuggcucugucacccaggcuggagugcaauggcgugaucucagcucacugcaaccuccaccucccagguucaagugauucuccugccucagccuccugaguagcugggguuacagguguacacuaccacgccuggcuaauuuuuguauuuuuaguagagacaggguuucaccauauuggccggguuggucugaaacuccugaccucaggugauccgccuaccuugaccucccaaagugcugggauuacagauguaacccacugugcccagccuaaaaccauauuuuuaaaugcaucuucuaccccauucuauuggucuuuccuucucggaccccaaguacaugaguguuagacuauuugauauuauccuauagguuacugagguccuguuuguuuuauuuuuaaucuucuuuucuccucuguucuccugauugguuacauggaucuuuauucaaguucuuuugucacaggaucuuuagggugucgcuuugccagucagaaaccuccgugcacuucugcuugaguuuugcuccugguugcuggacuuguuccacccacuuggcccggcaggcugcacuuggcucacacugcuggccugggucgcacagcugccaagggcaagccaggcgcggaguggcaagggaugugugagugagugcacgcgggguccagccacugugcacagccaggcacaucagcugcggcagggugggcagcuccaggugcagacuccaugcgaggcuguggcuggaccagacguaccacaagcagcuucugcugugggcaccagcaucuggacaaggggaacacauggugcccaaaaacuuggagacaccaggaaccacagagccccaaagaggguguuacagcaugucacaggccuagcugggggagcccugaguucugggcucccagaagggccgcagcuccuucuuccuucucguuaccugcaauguggugagucgggggcauguuuuagcccuguuuguguuacagcucuuucagucccgccauuugguggguccugaguucuuguccuguguccaggaagaaagaaguacuuggacaacuggagggugagcaaggcacagaggagcuucauuaagcaacagaacagcugucaggagacccaaagcaaguagcuccuuucugcaggcaggucaucccaacaaguguccagcucucaguagagaggagaccuguaguggguagcuccuuuuugcaggcaggucgucccugugagugugugagucugacugagucugagguuuuuauaugcucagaaugaaggaagugcaugcugauugguccaugggcggccauggaugggccuggaaaaagcaccaucggacugccugaauggucaucaaugaaguucucacuccaggcuguggccuucacucagaccuggcagccugguucccaggcuucaggccaucccuggcaugaagguggggcuucaccagggacccaucccuuccugccuaggaaccugucugccucccaccaccaucaucauguuguccacggcacccaggcuauucacacugaggggcgccugcagacccacaccaagcugcccucagccccuuggccuuucuccuaugcuuguugucgcccaaaguccagagggggccaaggcggugggaggcuggcgugucagcgcugcccugaaugugugcacacucagccagauugcggcagcauccaggcucagccacagcuuugcuccgcaguggagaaggcuccaggaguagggagaggccagggagugggaccagguacuucugagccugcagggguagagggcuucccaggcuucuaagagcacaggaaugccugggucuggagauguggcuuguuggaugcagcugccccugggagcacagggcuccugcccuaccaacaugguagaggguggagcucccaccuguucccagaccucaccagcuccacggagugugcagcccuagccacgccucccccgcugcaacuggcauccccacgguggcugcuccagacaggccacugcugccaucacuuugauccuuauuuucuauuucaaauuggcuuuuaagccuauccagugaaauguaugcugcuguacauuuuuaguuuagaauuuccauuugauucuuuuuuauaauuuuuauuucucuacugacauguccccacuuuuucacugguugagaucauauuuuccuuuaaguacuugaguauauuuguaauagcugauuuaaagccuuaugugcuaauuuguacagcuggguuauuucaagggucuguauuuugagcuuuuaauuuuuuagugccugaguuuuauuguuauuuauagcaggagggcgagucuggugacauucuguuaugucuguuauucuucucuguuuuuguuuucccauuaauuuagaaucagaaucucaaagggaaaccauuugucauuacauucauaacaauuuauuuuauaauuuuuguagccauuuagauuauggucaaaaagaaauucuuuggagaccagguagagauaucuaacuauguuagucuggucuuacacaucauuguaaguaaaauuguguuaaacaacuuuggucaacuaaauguuaguagucuaaacuguaaggauuauugguuuaaucuuguuuagaaaucuuucaaaauguuuuagagcaaggaacacagucagaagaccagaacucuuguucugucuugcauauuuugugaccuugaacaaauaaauuaaucugguuaucaauucaaaugcagcaagguaugugagugcaucauaaacuguaaauaaaguacuuugcaaguuauugaaaaauauuaguauaccuuccuucuccauccuacgucaauaagaaaggaaacauaaugaaaucuuuuuuuuucuauacucuuucaaggcauuauuuagagcauaacccuucaaaaccauuugguguagcuguaggggagacaaaugacauugagcuggauuucuuucuguacugauuccaaagcuuacuauauuagcagaauuguucaaugaaucuuauauuugaacuuacuuugcuaacacuugccucuguauucaaaaagaaagguacaaaagaaugauuaauugagaaucacaauuagauguggucuaguuaaugauauguuugugguacgcuacuuuccauguucuuuuuuguuuuguuuuguuuuuaguuuuauuuuuaacuuuuaaguucagggguacaaguacagguuuguuacauaggugaacuugugucaugggguuuuguuguacagauuauuuccuuacccagauguuaaucugaguauccauuugucguuuuuucugauccucuuccuccuuccacccuccaaacuccaaaagaccccagugucuguuauucuccuugaugugucuauguguugucaucauuuagcucccacuuauaagugagagcauuugguauuugguuuucuguucccguguuaguuugcuaaggauaauggccuccagcuccauccaugucccugcaaaggauaugaucucauucuuuuuuuauggcuggauaguaguccauggugcauauauauacaccacauuuuauuuauccagucuaucauugauggacauuuacauugauuccaugucuuugcuguugugaguauugcugcgaugaacauaugcauacaugugucuuuacaauagaaugauuuauaucccuuuggguguauacacaguaaugggauuccugggucgaaagguauuucugucuuuagaucuuugaggaaucgccauauuguuuuccaugauggcugaacuaauuuacacucccaccaacaguguaaaauagguccuuuuucuccacaaccucgccagcauuuguuauuuuuugacuucuuaauuuuauccauucugauuggugugagaugguaucucauugugguuuugauuugcguuucucuaauaaucagugauguugaacuuuuucucaugauuguuggccacauguaugucuucuuuugaaaagugccuguucauauccuuugcccacuuuuuaaugggguuguuugcuuuuucuuguaaauuuguuuaaguuccuuagagaugcuggaaguuagaccuuuuuuggaugcauaguuugcaaaaauguucucccauucuguagguugucuguuuauucuguugauaguuucuuuuuuagccauguuuauguaacaguucuuuuaaauuuuuuauuuuggaugccauagcagcaacaucagcucuucagacauguauccaaauaaaaaucuuuuaacugacagucacuuaaucagcagcuguaauuauccagaaccaaggcaggaaccagaaacaaauaaaagcauuuuaaauagaugaaaaauauauaaucgaaucuaucauacaacaacaaugucauaauagcucaaguuuuuugagcauuuacuaugaguuggacaguguuucgaugaucuaugcacauuuacauuuaaucuucacagcaacccuaugaaguagguacucuuacaugauacaauuagaauauuagucagaaagaucuuuuugcuuuuguucuauauggucauuauugauguuuggaaacauuccagguacuucugucuuuguuuuaccaguuccucucucuguuauagcuuuguccccacuccuuggccauuuuaaaagauuuaaauaaaauuucuguacucugucaaaccuccuauugauuaugcaaaggcagaauuaauugaucaugcuguuauacucuuaggacaguugcaaauaccaguagcauuuguaacauaguaucagcaucaacuguuuuaccuguuagauuuuuuuuuuuuuucaaaacugugcucuucccugggcuaaggaccacaccuuccuuaacuuuauuccucugcgauuacuaucaaaccuggcauauaguagagccuaagaauauauuuccauauacaccaaugaaugagugaaagagagaaaaaagauagagauaaggaaaagugaaaagaagcaaaaagaaauuugaaaauuuagaugccucuuuccagaugugccaaaaucuuguagaauuugaacauguuauuuuagagggcaacucuuauuuuaguugaacaaaaagagagacaauuuauauuuuaacaaggauauuguauuucuaaagcaauguaagguaugacaaggauauuaaugaucuguaagaauguggagauggaucuggaggcaaggaagaaccagggagaacuuuuugcuuugguuuugggguugaagaaaaauugaucuuccauguacauuaguggaaaugugguaagggaaguacaaauacaggaggaacuaaaguaggagcaaacaauuugaagggaguauaaucagagaagaaaaaagagagcuauacuuuuuuccuugaacaauccaagaacaagaugauaggacauaagauagggaaacauacuuacagaaaagagaaguguaaagcaggucaaucuacugcuaagggauuucagcccagcaaaugcacacauuaagaauaaugccagaauguagaaaaguggcuuuaucuuucaguagcgguggacuguucgcacacacucaacaguuaacaagcuccgcucugaaguuauucuagaccuuaucuuuggaaauaaugcaggcaugauaaauaagguuggaguagaaaagcacuaaagaugcaaucauaaugucaucagguuugaauugccgaugaagaucugugggaagaguacuaacacaaaaauauggggcuugagaaaagcagaccuugaaggaauacaaaaugaguuuugaacuuggcuggaauuuugcaacguguagaaaaugaaacaugaaaaagguagaauccaggggagggaacauucaaaauucaacccaauaagaucaaaguaauacagaaacaaugagaggaagcggagaaauaagagaauauaggggaagccaucaaaaaauaaaauaaaggggaaaaguagugggaaacgcuaugacugaaugaaaccaaaacacuaaaaaaauguggugauuaauaggaaauuaguaucuaagauuuuaaaaaauauauuuuugaaaauuuaaauaugcaucaaauaguaaaguaaaugacaaugucgauuuauuuuucuaaagauugucacaaguuacauggaaucccuccucuuaggcugcaagucuuuguauacucaaggaguauugauccagauggcacaucuagacuccugugguguuguggccuuuuuuuuuuuuuuuaaaaaaaauaagaucuugccuuucauaggaaaaagcauuuaauuuaugaaaagguaugcuacaacugaaacuucaucacuggggaaagcauaagaccauaguuuguauuggguuaagagauaaaagauuuaaaguguacauuuauuuacaguuccuuaaacuagcccuggaaauuagacuacuuauagggugaaaacuaauuaacuugcugucucauccauggaauagauuuaaauucagguccccaagcaaaaauuuuauaaaguuuacccccaccuggccccucgcuauccuuuguugaguggaaaacacagagcucuguagaggaaagaaguuaucguauuuucuggcuucccagcaaugcaggaacuacugaugguguauuuugguacaugcauauccuuuuaaagaaaagguugaguauaugacagacauuuaaacauaaaauguuuucuuuguuucuucaugguugggcuucugugaagaaagaaaaagagagaaaagaaaaagcuuaguuuuuuauguggcauauuuucuggucuguguaaaauuuuauugucugaaauugugaaaaauguagcccaacauauuccaaaaucacagaacugcuucuugcagaccuaacuugccuagaaaaauucacaggugcaaagacugguacauaguaaaugccuaguacaugcuugcugauagauucagguaucacacauaugaguacaguggcaucaaugauauaucuguaaucaacuuguauagaaaccaauuuuuaaauaaagcuguauuuccccuuuaaacauuaagggauuuuauuuucuaagugaaauucuggcacaugacauagaggcuagaccuguguucaugugucugagauucuguuauuccuuuaucuguaauuccuagcauauuaacucuugguuauuuauuccuuaauaucugugccacgugguuacugaucuauuagaaaauucuuuuuuuugagacggagucucguucugucgcccaggcuggagugcaguggcgcgaucucugcucacugcaagcucugccucccggguucacgccauucuccugccucagccuccugaauagcugggacuacaggcgccugcaaccacgccuggcuaauuuuuuguauuuuuaguagagacgggguuucaccauguuagccagcauggucucgaucuccugaccucgcgauccacccaccucggccucccaaagugcugggauuacaggcgugagccaccgcgccuggccagaaaauucuuaaaauggugggaaauuggaauccuugaauggaucccucaguauauuguaccagguagaugcuugauuaugcauauuuauugaaugaauaaaugaaaaaagaguaauaaaucaugugaaguugguaguuuauaaauucuuucugcaguaaucccaagagggagggagggaggagagguaucuuauuaucaucuuuuaguagaugaaaaccugaagcucagaaguuaagugaauagaccaaggccacacacugaguaaguggcagaauuuucugaaggacuuuugacucuaaacuccaugcuuuuauuaaugcacaacccugcucucuauccugcaauugaucuguauaucagauaauauuuauaagcuguguuuaacuuuuggaggcacagauguuucuagaggcccugaaugagauuguauguugcacuuuacuuuucuguugagggcaagaaaaggaagacauaauggcaagguguuucuauagagaggcaagguguuugcagaaauuuauaggaguuggugaacaugaaaucaauauaaaagagaaaaaugacagcaagcccggggccaccugccuaugauuggcccacaguaacuccuuguugaaaagaaaagguagggugcccagagcuaaaagaucucuucucaggcugcuuccacuguuauuuguguuuagcuacucuguugaugucccuguagugaugcacuuagaaaauuaaccaggguugugauacaacugccacuugaguucuguacuuuucuuccagacucucuuaccuagggugcccagagaacagcuagggagugacaagaaaagcagaucuuucuguuuuccaccugauggaggaguaggagagauguuaaagcugaaggcagucugaaaaugaaggaauagaguagggaggauggagggguaugggagaauggaagugguaucagaauauuuagagggaagucacagcacaggaugagauaaauugaacccuucucaugaagagugguuggaaagaaaguggacaucuaauuaggaggaggaaaauccuugggguuguaauauuauguucaaauacuuggaagauuuuccugauaaaggaagauuuuucucucuuaacucaaaguaguaggacuaggaccaacuuuuagacauugugggaagauggcuuuugagcuaguuauuauaggaagaauuucgucagugucugaaucaccuggaaauugggugcgccacaucaggagguaggagacguucgaggcacaggcugagugagccugauggagcuacacuaagacagacucagcaaacauuagagaugccuucucuuucagaguuaaugugauucuaugcagaagagaaaauuauuucauaugcagacacagacacacacacagagcauguguguguguguguguguguguguguguguguguaauuuaagaguagauuacaauccaguauacacagggccccaaaauauagaaaacaugggaaaagaggaguguauuaguuucuugggcucgcuguaacagaguaccgcaaauuagauggccuuaagcaacagaaauguguucuuaagguucuggaggccagaagcccgcagucagggugucagcaggcuuaugcucccucugaaaccuguaggcaagcccuucuugcuuauucuggcuucugguguuugccagcaaugcuugacauaccuuggcuucacuccagucucugccucugucacuagauggcugucuucccucugugugucucugucugugucucuucuccucuucuuauaaggaaaccaguaauguaauggcccaccuuacucaguaugaccuuaucuuaacuaaugacaucuucaguggcccucuuuccaaauaaggucucuuccugagguauugaggggugagauuuugacaucucuuuuuugggggaaacaauucaaagcaaagagaaauaggauucuugcuuuauggucuuauuauuuucugucaagaagaccugaagaaguuagagaaaaauauuuugacucaaacccagcaaacuugaauucagguacaaaagauugauuuuucccucucagcaauguugaaugguuuuguggauaggggaaaucuaguagauauuaaauauuuuuaucugcaaaaagcauuugguaagguucucaaugggagauuaaugacuaaaauaaagaaugaggcauuaggagauaaauuugcuuaugagcaagagacagauacuaacaguagaaggaaauacuuuuuagauuggaaaggagugacauauagcacaagccaggaaucaguuuugggaccuauggguuuuucacuuuauuuuuauuggacuuuguaauaaaaauacagaucuucaaacaguccaagacagagugaguaauacuacaagcaucaguaaucaaaaguuauucucuaucauaaacuaaaugacugauaauaaauacugacacaagacuacacaauguaccauaauauuauaaaauggagcaggcaauucucuuguguucucuuuuccuccgcaugggugaauauuucuuuauuugcuguuuaaaaaaaauauuugcaggcuucuaggauuacuuuauaagccaaaugaaugaaaaaaaugauuuuuuuuuuaauuuggaaagauauguuaacagggaaaaauugguugaagcaagacaaagguuacauugccaucacuagaauaaagaaaugaagggcccugcguguuacauugcucagcaagguguucgguaaaaauacuugaguuagggggcguucuugaaaucaucagcuuauucugcagucaugacuuuaacggaaucguaugcaaaagagucauuguuagaaugaggaaacuacauaucuaaagacagggaaauauagcauggaacuuuuuucucuuuuuaaauuuuaacguggcucuaaaaaaauccauaaaauccauugauuguauauguaacguuuagucugcccagcagcuaguaaauuauguagagaacauacuuuucaaauugaacuuuugccugucaccccuuuugucaaaaaucacuaaaagguguuuacaaauucauugccuuuuccccauuauuuguacauugucagauauaagccaagagaaacagagcaaauaaacauucgaaagugaacucagagaaauuguaaaugcuuagaaaacuauaaagauuauaaaguguaaagaagcuccauuaaccucaaaccucucauuuuaaaggugagaaaaccaagauccagaaaggucaaauucauaagaaauuugcccgaggacaaauaacuaaagucaaaacacagagucuagaacaagguucucaaccugggcugcacauuagaguuuccuggcaagcuucuuuaaugaacuguugcaaugaucuuccuaccagagauugugauuucaggggucaugaacggagccaaggaaauucauacuuugagaaacaugcauuuuaaaacuucuccaguugcuucugcugugugggcaggaaugagaaccucugaucuaggaucuagcuuuccuaauguuaacacaggaagucuuuccuuuauuuauuuauuuauuuauuuagagacggagucuagcugugucgcccaggcuagagugcaauggccggaucuuggcucacggcaaccuccgccuuccggguucaagcaguucucccgccucagccucccgaguagcugagauuacaggcauccaccaccaugcccggcuaauuuucuauuuuuaguagagaugggguuucuucauauuggccaggcuggucucgaacuccugaccucaggugauccgccugccucagccucccaaugugcuggaauuacaggugugagccaccacgccuggccuaacacaggaagucuuucaacucacauuuguaguucagagauggcuuaaagagcuucagauucugagguaggaagcaccuuuagcauaggcaguccacaguuaacaaaccaauuguucuaguaguuauuuucauugcaaugugcuuauuuggaccgcugaacuuacauccccaaagaaacaagauuguacauuguuguuuggugucuaggccagccccgagauuagcuuacagaauaacugaaauguagccugugucaguugcacuauagguccuaaccaacgcauauacaguguuuuucuaagagcaagaauuuauauuuuaaauuuaggucucucaggacauuuguaauucuucuacuguucugauagcacuaucaagauuucaccuccuuucaucuucaacauauuagauuuaggauuugaauagggaguuccccaauuccaaacugugucggggaaugggaggaaaugagggauggaggguuggugagggcuggagggaagacugaggcacugugggagcgaggaggaggccaaucaagaacagaagggccaggguucucugccaucaguaccuggggauauuucuuucccucgaauggguucauccaaauauuugaugaaggcauaauguuuaucagacacuauucuaggcauuggaggaggauuagaagagagaauggagagaguaaaguaagcaugacauaguuccuggccuuaaaaaagugacauuaucucuuaguguggugaagaagugaaaaauaggguuuaugauuugucauuuugggaaagcaggugauguggggacacguuuuccaagcacuucaggaacacagcugaccuucucuggaggagucauagaagaauucacaaagcaaguggcauuuguauagaaguuguuaggugcagauacagagaaaggcauuuugggcugagagucacuggcucucauagagagaugugaaagaacaugucauggugagaaagcuggucugguugggcuggagaguaaauggaaaguggcagaagagguggggaugaagcuaguaaauagcuuggaguuuaaggccaugcuaaggaauugaaguuucguguuuggggguacaggaaauuuuuagccugaggaaugaaugauugacugaguaacucauucauucauucauuuauucagucguuaggauuuauuggaaguuugcuguaugucagacacuggaugacaaagauuauuaugacacccucaauccagaugcuuuguagaagcagagcagugaucagauuuucauuuuagggacauaaccuuugggcaauguguuuaggcuggagacaggaaggccauuaggaagcugugauaacacuucagcugaccaucacgagcuccugaacugagaugcaaugcaggcaaugcaguggguauggagcagaguagaugccugugggacauaucggggggcaaauuugauugugcuuggugagugauugcaugcugagcagggaagggaagggcagauccaacuccuaauggugccauuugucaggauagggaauuuaagaggacgaagucuuuuucccagcccaggaaccagcgccucuguuuccauuuauaagaccugcacccguucauucuauuauugguuuauugcagaacauagcgcagucuaaccgcuuuuccucuacuuuucuguucuugcaacaaggaaaaacauaguaacguuuuuaaggaaaucugaugaaggcuaugaaggugaaagaaaggcuauuuuuugguuuagaaaacauuagcaagauaacacauguaaaucaaaaugcagaacuaauacauuuguuuuagugauucaggaggaaaaggaaauucaugcuuuuacuugaauuaucaggaugaugcuuugcuuuaccagugacccaagaaugaguguuauaguaugcuuuuuguaaaaaauuuaucaccaacuggggcauugaaaguaaguuuccuauguuacgcggcugcuaaauuggccagggacaacggaggaggaacugaauagucaaugaaauuggaaagaauuuagaucauccaugucacacaaagccagcaaaggcuguuuguagaacguuagcugcuaucacacuggcuugauauuaacauucuagugaauaauuaaaauauuccuguuuauuuuuuaauaaaaagaaaaagcauauauguuaccucagagucuguaaugauaccuauaguugcauccaucagauguugaguuuuuuuuuacuaggauuguagaguagauaacuuagacaauuaaaaagcagguuuuguucugccuuuuucugcauucuuguuuuacaguauucaguauuacaaugccauucaaaaauauaaaauaaaaauccuuaaaagugcucugagacauuuucauuauugucaguauuuucuaaauugagugguuauuaaauacauuuuucugcuggaguuauuuuugaaguacaucuaucauuuucauuuucuguccauaaacgcauacccaggcagagcugauacucuauuucuuccugcuaaaauucgggcucccauuagaggaugggucaguaggugcagcaaaccaccacggcacacguacaccuauguaacaaaccugcacauucugcacauguuuauccuauuuuuuuguuuguuuguuuguuuuuagaagaaauaaaaaaaaccauucaggcucccaugaggugaucagguacuucuuuauaauugaauauacuuuucagcuaaacccaccccuuuccacuggcuguuuucuuugguuguuccuucagggcuagaguggaaaaguucaguguuuuauucgagacaauugacucagagaaaagaacaacucacacagagaccagaaagagauucgugcucaguaacaaagagagaguaauacagacuuguggagucauggucuuaggucugugugacguguuugaugcucugcaagguggucaguuucuggggugacuagacaccaccaauuucuggaggaucugccugaguuuauauccuuuagauaguaguaacaggcuuaguagaguaguuggaauaaaauuacaacugaggaaggacaagaauaaaugguaucagaggagaaauuuucccaggagggcgaggucaugaguuaggagaacacuaagaccgaaugcucugucuccugcuucccugagucagaaguggcaggcacacuagacgaagcagcauuuugcuggagacuuuguugagaauucaggugcuuugggagcuuagagaggaaacaaaccccgguauggacuuuucagacaaaauacugcuuucuuugccuaaucaaguaaaguuaggauaaugauuaccaggcacuuuguaacagcaagguuauucuuuuuuuuuauuauuauuaugcuuuaaguuuuaggguacaugugcacaaugugcagguuaguuacauauguauacaugugccauguuggugugcugcacccauuaacucgucauuuaacauuagguauaucuucuaaugcuaucccuccccccucccccuuccccacaacagcccuggugugugauguuccccuuccuauguccauguguucucauuguucaauucccaccuaugagugagaacaugugaacagcaagguuauucuuaacgcuaaaguuaagguuauucuaaacucuaaauuguuugcuagagaaauuacaaacauagaaagaaauaccacauaggagccaacguauauaaccuuuaguuaaauguggcucuuaugugugaccaggaacuagcaagaacuguggcagagaaauuaagaauacccucgcuccucacagcugcccuacaggauuuuuccuuuuucucuccuuucuuuuuuuaaauuuaaauuuuuauuuauuaaaauuguauauauuuguaacauacaaugugacauuuugauagacauugugaaauaauuuuauagucacguacucaucuccucaugugguuaccauuuuuuuguguaugugugguaagaaccacacaaauccucucagcaaauucuaaguguauaauacaacauuacuaauuagagucccaugcuguacauccucuucucuuauuuccuuagcuaguugccaccuaggacucuuuaccucuccugaaccuccacuuugucuuagacagggcaguagugcuguucucuucucuuccccuaaaaauguugaucucuuagacccagugccaguuucuuggcuauguccuccuuccucaugucaugucauuuuuaaaaucuccuccccugccccagcuuugugcugaaauacccuggagaguugauuuuggauucauucugaaauauaaaugaccuaacuguagucuuugaaauauuugagacccacuccuuaugcuccuaaccccuuaucaccacaaacugggugccuuacacaacagaaauuuaucugagaguucugaggguuagaagucugagauaaggugugagcaggguuaguuccuucugagggcuaugagaaagaaucuguuuuguggcucuccccuuacuugcaggggauuguugccuaucuuugguguuucuuggcuuguagaagccucacccuggucucugccuuugugaugauaugguguucuucauguuguaugucugucucuucaccugguguucuuuuuauaaggacacuaaucauauugcaguaggagccuaccguacuccauugcgaccucauauugacuaauuauaucugcaagcacccagguuccaaauaaggucacauucuuacaugcuagggguuaggacuuccaccuaugaauuuuggggggcuccaguucaauccacaacaaaugaguucaaaaugaggaaagcaaaacuggaguucagagagaaucuuuuuggcucauuuugcuugugugccuaagggcugaguguucguuuuagguaagagagaaacugugagggguuaggguuuggguuagagaagccuacuacuguaggcuagaugccaacuaaaaacaacugcugggggcaguggagagggaaguagacugcaggguugauguaagaaaaacaggugaguuugcauuuguugggggagcgccaggaaacaagagugucaauuucuggcucaugagugagaaguauuccuccuuaguugugccugagaagcucccagcuuccauaacuccucacugccccuuccccgcaaaacccucuuuguaucaccaucuugagauuccuuauccaaauuuaaacuccauuaguaauuuaaagcucugaggaaguucaucccaaccuggaagaggagagagguguucuggguuguagagcuagccacucagaggcauccgggccuuccucuguuuccuaaaacaucauugugcagaaugcuuagaagggguugguagggcuauucauuaagugcaguaagaguaaaacaugcuuuucugggcuggcugggacuuacuaccacaugaaaucuggaaaaguacauucugauuuccagccggcugugaauuuacaaacuuuuggaaugcaaucuauuucuagguuggagaauggcauuacuaaacugcucaauuuaauaauuagagguagaaaauauaauugguuuaucuuuguagucaaauagcaauuucauauaugcagauaauuugaaucugaauguacagccaaguauucaaaauauaaauagaugcagagaaaaaaucaaaagcacauauaauucccccagacccuacauaaagcaaaaggaaccacugcagaaaagaaaagaaaaacccaacuccuccuuaacaauuuguucucccaccaaucuuugauuuauaaaucuagaagccucauguuuucuggaauccuuaauaaaaaaugacuuuuuaaaugucacaauucuuaauuuuucuuaguacauugaaaaaaauuaaagcuaguaaggaaaagaggcaucccaguacuuucugacagaggaagaaagaaaaggacuaaccaccuuucuaaauguuuaauaguagucauauuaacuuauuaaauuguaugcucucaagaaacaaguggguguuuaugcauguauccuuuguacgaugacaacaaugacaacaaaugacuuaguggggcuuugguucuuuguuacauucuuuuuucaaaaaccaagguggauuauguuuauuaaauguuuuuaaaaauuuaaaaaaauccuacuaaaaacuaggagauaccuugggaguuuccaaaaucaagguuaggaaccauugauuuauaaagaucgucugcauauguguguuuccuaguucaaggaguuagaaaacuuuugauaauuuaaugggauuuaugaaccuauuuuaagaguuagagucugugaauaacuagauaaagaagaaacagagcaacugaggauuugguuuuaugcccuguagaguucaaauuaaauuuuacuaaaaggcaguuuaaaaguuuaaaagauuaacuucucuuucauuucacgcagucuacuucagaacuagucaccauaaugaacucaacagacgugcccuggaaugauuuggaauacuagaagaguuaccgucagaguugaaaaggggccaagcacaguggcucaugccugcaaucccagugcuuuggggaggcugaggugggaggaucgcuugaggccaggaguuugagaccagccugggcaauguaggaagacccugucucuacaaaaaauauuuaaaaauuagcagggcacgguaaggcgcaccuacaguccuagcuacuuaggagacugagaugggaggauuacuugaguccaggacaggaguucgaggcugcagugagcuaugauugcaccacuggucucuagccuggguaacagagagaaaaaaaauuaaaaagcuuauucugaagaccagcucgcuucaaccgagugaaugaagaaagcuuuuauguuuggaacuauuuucugcuaaaacugauuucugaguuguguucuguuagacaauaucucaaucaaaacuucuuugacaaaaacaucucauggucaugcaaguuuggggaaugcugcaugaauauaccccugcaagccauucacagugcacaggcauuuagaaaagacccugcaaguuuacaaaaagaaaaaacuucuauauuuuuggauaaauucaucauaccaaacuuauuuuaaguauggcuaaguucuucucguguaucauuuuuaauauugaaccaaagaauagagcaagugaauaguuauuagguuaaguccuguagacauagaagauuaugcucugugggaauauaaauuuuuaagcagacaagauuacuaugaacacauaacuguaagagcauaagcaugcagguauaaguggucaauuuuagaaaaccuuccuuacaaucucuuuaaacaucacccccuccccauuccuguggccauugucugaaauucugcuguucgguccuuacacuuucauuuaagccuauuaaaaguuaagucuauuuaaaggauguaacacguucagcaaauguguggccuuacuuguggaaaaccagcuaauagaugaugagaacuagauguggacuuugugaaaauauucaauaaaaacaaaauccauugagcugagacuguaggugacaaucccuuccuuacccucuccccucuugcucccaaugaaaagaagucaggacauuuguccaacccaaaucagaaacccaaaaccagaaaccaagaaaagaggaaguuuuucuuuaggcugaaaauugcguugccagugagauuuuuuuguauuaaugcucugacuaaagaaauagcuggaaaaaaauagcagaaaaauguaauacaaauuuaugcaguuaaaugacugucugggacgaaaaucaagaaaacaaagcccaaacguuaccuauuaguuagugagcggcccucauuuauagugugcugaaacucaacuacccucucuccacacuuggccccuccagcccugccaucuggagacagaaaccucauucauuuccacacgucguacccgacaugaauuccuaaccugucaccgcuccugaucccaccuccuagcuaucccucucuucuccagcauuuuggacaugucucucagcauaugugucugccuaucucucagaauggaguaugaguguccacucagagacagagacuuauuuaucagugcugagcacauagccuagaacaugguagucauucacagauauuucugaugggacacaauaguuaaggaaaguuccuaagagcuaggaaauguaagccuguauugcuaucaagaaauucuggaaauuccuucuuugguuacuuuaggcuugaaaauaugucuucuccguguguacuuccacagccuucucagccagauggccucagugggagccugaagugucauguaacugcuuuaguuuuuaaauauuugucacguuauguaucaagcucuuagaacaguaccucgccgauaguaagugcuagauaaguguauuagagaaaaucuuuaaauaaaaacccauuuguuuauacaaauaggcaauugcagccauagagucauuguaaaacuuaguuauguucauuauagacauuuuuuacucuuuuugggguuuuuuuguuuuuuuuuuuuuguuuuuuuuuuuugagacaaggucucacccuguugcgcaggcugaagcgcaguggcgcgaucuuggcucacugcaaccuccgccuccgggguucaagugauucuugugccucagccuccugaguagcugggauuaaaagcaugcaucaccaugcccggcuagcuuuuguauuuuuaguugaaaugguguuucaccauguuggccaggcuggucuugaacuccuggcuccuagcaguccaccugccucagccucccaaaguguugggauugcaggcgugagccacugugccccgccaauagacauuauucuucauuaaagcuggucuaauacagaauucauuuagauuuuguaaguauuuauuaaguuucuaguauccacuuaguagaaaguggauaguagauugugcuagcuguauggucaauauaaugaugguuagugaggcaggcauggcucucaaagaguauguaguucauuaggauggggguugucuccccaugaagggcaggcacauagaaaaauuucucguugauucaggcccagugucuucuucaguuagcuuuuuaagacuuguaccuuagucucuuccuucauuuucuacuauugcugaagcuccuuauauuuucuguauauugauaaugcaguuuuuuguuuuguguuuuguuuuguuuuguuuuguuuugugacagagucucauucugucacccaggcuggagugcaguggcauagucuuggcucacugcaaccucagccugcuguguucaagcgauucucaugccucagccucccuaguagcugagauuacaggugugugccacugugugcccggcuaauuuuuguauuuuuaguagagacagaguuuugcccuguuggccuggcuggucuugaacucguggccucaggugaucugccugccuuggccucccaaagugcugggauuacaggagugagccacugcaacaggccagauaacacaguuucuuuuucucuguuucuucagcaacgugcagacacauugguguacagaugcuucauucgcuaaugccucagaugguuguuucucaaacaggaauccuacuacuccguggcuucucacuuuuagcuuuuccuaauauuuccuaauagcuuucucaaaucucuccugccuugguccuuuccuuccacauuuuauucaguuggacucugacuccugucugauuugccaguguagaugggguggggaauuaccugcauaggcauagcugguggugucuuaggggugucagcugcacagagcagagugugugagggaaggauaacucgugucccugguugcagagucugagugauccccccaguaaacuaauguaggauauauuuggauguccaggucagcagagugaaaguaaacaguccagggucugugcuaggauugaguguggccacagauagcacggaacaugauaacgguggcuuaaauuguuuuuucuuguguaagaaggaacucugagguguagccagucaccgcuguuggcucaucauuagugucaggauuggggccgcucuuggcauuucucucgugguuacaagauggcugccacagcuccagucauguuuauauucagaauaggaagaaaagcaaugaaggugccauuucguauugaaggaaauaguuuaacagggcuagguaggauuuugacugggaaagaaaggacguagagaacuacaaacuugauaagguagaaacugcaaaacaauagcuggucugauguagaggcagaagugcauagcaguuaaaagccuggacuuugaguuagaaaaacauggauucaugacacuuacaagcuguugucuuaauguguuccuuagucucuauaaagucuucuuuucuuaauugguaacaggaguaucugcuuuuuaagguauugugaagaucaaauuagggaaguuuuaaggugaagccaagcacuuaguaauuuucagaaagggagacuuauucuguuccuccuccuucucuuacuguuguaugguugucaaucagaaugaacuagaaucuaagaugcuuuugggugaguagcagaagagaacaauggaauauuggauuaaauucagccccuggagaguggaaauccuaggguuuuauucuuuuagcagguuuugugaugaaaaugucaccaucaaaccagucuuaacuguucauccuauauacaauacuuuuuagaucuuuauacuuuaaauuuuucaucaucuuuaguuuccauguauuaaauacaaaaaauugggccaagucaacccagaaaaccucuucucaagaguaaauuuaugauauuugugacaaacaaccaaauaaacagaucuccagcauauguugacacuguucacugucucuaacccaguuucccaaaugccuuuuuacuuuguagguuaucauugugaaucucauuuuccauuuugguaauaaauuuaacagcugaauuuuuuucucacuaagguuuuauauuuuuaaguuauccauguauucauuuuggauuuugacauuuaauaaccuuccugaaauacaugggagaaauuauaucuacaauguagaagacucuaacauguacucuaaggggaggaaauaaaugccacacucaaagcaauuauacaggaaguauuaaagauauuaaauauguaucaaaaauuuaaaaugcagguuuaaaagaaaguagguaaaaacccuaacuuuggcaguauacauguuaagaaacuauuuauauuguuuucugcugagcagaaaucuaaaaacaaauggccuuuaaaucagaccuauuaguuuuguaauaggaaguucugugagagacagauaaaaccucuguauuaagugugcaguauaaccuauucaucugaaauauacaugauuacuguaugguuguguguuauuuccauuuaagaguuuuaguaaaggaagccaagcccuucugcugugagggaaauauagcaugugagcauauauauucgugggcaaggcagugccuugaaaacaaguguguggcauccagggagauccuagaugaguucuaguucauaugcagaguggauccagguugcgugcaugcuuaguauuaaugcaugacuucugcagagucuaggucaggaccauucuuccugcccccuucacaaccuucuccuugcuuucuccuugccucaugugucuucaggaauuugugaaugauucugauaucccagugauauaaaacaugaucuggcaaaauuugauggugaccuuuucugcuuguaccuuuacccauagaugagguuuuccgaguucugcugcuuuccccuuugccagcauauacugcuuuuguugaggaaucaaggucuccgguggucgccaagugaaaaggaauaaagauaaaaaugaaggcgugacuaguugaaaaauagagacagaauuuuaaugugaaaauuguuuaugaacagaaggagagaggcugcauugucucuauaagugguuaguaaguggagacugcagucaccuagauggccaaccccaggguuccauauaguaaaugcuuuccauucagggcuguuugaaaguucaccugucuauggaucugcuaaugggaagcacauacgucuccagguacagugaaauaaucacuuggagauaagacuccccacagaaaaauuaacacaacuucuuuuaugaaagacaggucacuguaaaaagaaacucuacccacuuaucaucaauuguugaaaaaaaagauuuaugaugacauugagguaugauaaucucaaauacguucugcauuguuuuuaaaagcuuuguguuuaaaauucauagcacuuucuaauccugauaaaguagccuaauuuucuagcuugcuuuguucaguaaaauguauuucuaaauccauuuuaagcagcuauuucuucaauuugaguaauuuucucucaaguuaauagauuccacacaagcauaccugacuuuuaauguuaauauauacuauauauuccaaacuugcuagugacaguagaaagcacaaucaaaaggaaauucaguuguuuaaagcauaucuggcuuauuuuguuaaaauguuucuucauuuuacucaucuuugccaaagcauagugauaccaaaucauauuuuacagguugaauaucccuuaucuuaaaugcuuggaaccagaaguguuuuggauuuuggauuuuuucagauuucggaauauuugcauaugcuuacccuaaccugguugagcaucccaaauccaaaaaucugaaaugugaaaugcuccagugaucauuucuuuugaguauuguaucaacggaguuucgauuuuggagcauuucagacguucagauuugggaugcucuacuuguaccuugcuuguauugagguuccauuucccccuucccucucagcaaaaguaaaagaaaagagaauguguuagauacgauuuugucauuuuaacaugagaugacuuuaaaacuaaucaaugaaaggcauuugccuaacauagcaaaucccuucaucaauaaggucagcuauaggaacuggccaagaaggaaaaauauuuugauuuugaggcauuuggcauggguaauuguauuuacggauagauguuuucauuuuauacugagucuaaaauaccuuaauauuuuguucaaacuauuauaccuauauaauaauaaugccuguggauauuucuggcauuuucuuuuguuuacaggguacuggccuaauugccaugagucucauuuuuuuucuucucagcaaugccacuggcucucuaaaaaacagaggauaaugugauagagacagauaaagaauuuuucuaaauuaggcaaucaaaccaagaaaaaacacauaaaacaugcauaacuaagucaguguuuccucaaaaggggcagaguuugguaaagaaaagccuugucuuguacacugcuguguaugcacuuuauagaaaaguacuagcauagagugggugcucaguaaguguuaguuaaauggauguugaaggguugggaaagagaggaguugaguugagcacagagaugugauacaaguccuacacagucaugaguuuauaaguguaguuuuagaguuacuccuguguauuugaaaacugaaagcaaagccaguuccagaacaggauuaaggggccagccagcugggcaguuucccagugugcuaaucucuaagagacauugaaaccacugaaaauacucaugacagaggaaacuguauuuccuagaauuucucuacugucugucauugggauuagacauaaggcauuccagggcugugcuccccugucccuuaaagagauauucuguuuuuuucuaaggagggcagguugaguuacuuacagaucuuuugcauugcugagugaaauauucaaauuugggagcagagccgaguuguuuagacaagagagaauagucaagugcugucacaggggaucuucuuauucuauucuaccucuaggcagaauuaagccuuuuuucucaauaaauuuuaaaccaacauuuuaaagauauugguguaaaauggugucaaauuguuaaccuacagagugauuacauguuuuggugucucauugaagcucuguaaaaaugcuguugaacagauauauuuaauuuaaaaauuuuuaauaaccacauuaauuaaaugaagagaaacaggugaaacaguaauuauauuuuauuuaauaaaucugcaauauaucauuuuaauguguagugaauauaaaaauuauugagauuuauuacauuguauuuuuuuguauuaguuccucaaauccccguacuucaguuuaaacuagccacauuucaagugcucaguagcuacauaugguguguaacuaucauauuggacuaugacgugcagcccuagacaaaucaguagagucagugacucccaguuggcaucauugagcugguccuaaaagguccuuuaaccagaauucucucuuuggccagugugaaauuuccaguguugauaccagucuuuaaaaaucauuuuaaagaaccauaauuaugaauguguugaaguauuuuucuucaguaguaaugcuuaguuuaaugugugacugcacaugcuguucauuugugauaugguuaugcuuuguauccccacccaaaugucaucuugaauuguaauccccauaauccccacauguuaaaggugagaccagguggagguaauugaaucaugagggcaguuucccccauguuguucuuaccauaaugagugaguucuuaggagaucugaugguuuuauaaggaguucuccuaccuuugcucggcacuucuugcugcugccuugugaagaaggugccucacuaccccuucaccuucugccaugauuguaaguuuccugaggccuccccagccaugcugaacugugagucaguuaaacuucuuuccuuuauaaauuaccuagucucaggcaguucuucauagcauuaugaacauggauuaauacaguaaauugguaccgagguagugggacacugcuauaaggauacccgaaaaugcggaagcaacuuuggaacugguuaacaggaagagguuggaacaguuuggagggcucagaagaagacaggaagaugugggaaaauuuggaacuuccuagagacuuguugaaugguuuugaccagaaugcugauagugauuuggacaaugaaguccaggcugaaguggucucagguggagaucaggaacuuguagaggacuggagcaaaggucacucuugcugugcuuuagcaaagagacugguggcacuuugccccugcccuaaagaucugcggaacuuugaacuugagagaggugauuuaggguauuuggcagaauaaauuucuaagcagaaaaguguucaagaggugacuggguguucuuaaaagcauucagauguaugccuucacaaggagaucauuuggaauuggaacuuaguuuaaaagggaagcagagcauaaaaguuuagaaaauuugcagccugaugaugugauagaaaaaaacccacuuucugaggagaaauucaagccagaugcagaaauuugcauaaguaacgaggagccaaauguuaaucaccaagacagugggggaaaugucuccagggcaugucagagaucuucauggcagucucucccaucacaggccagaggucuagaaggaaaacaugguuuugugggccaggccuagggccuugcuacuuuguauagucucaggacuuggugcccugcaucccggccguggcuaaaagaagccaauguacagcucaggccauugcuucagagaguguaagcuccaagccuugguggcuuccacaugguguugguccugcaggugcacagaagucaagaauugagguuuggaaaccaccaccuagguuucagaggauguauggaaucgccuggauguccuggcagaaguuuacugcagaggggagcccucguggagaaccucugcuagggcaguguggaagggaaaugugggguuggagucuccacacagaguccccacuggggcacugccuaguggagcugugagaagagggcaaccguccuccagaccccagaaugguagauccaccaacagcuugcaccgugggcuuggaaaagccacagacacucaaugcuagcccgugaaagcagccaggagggguacuguacccugcaaagccacagggguggagcugcccaagaccauuggaacccaccucugcaucagcgugaccuugauaugagacauggagucaaaggagaucuuuuuguagcuuuaagauuugacugcccuccuggauuucagacuugcauggggccuguagccacuucauuuuggccaauuucucccauuuagaacaauuguauuuacaaugccuguaccccaguuguuucuaggaaguaacuaacuugcuuuugguuuuacuggcuuauagguggaugggacuugccuugucucagaugagacuuuggacuuggacuuuuggguuaaaacuggaaugaauuaaaacuucgggggacugucgagaaggcaugauugguuuugaaaugugagagggacaugagacuugggaagggccaggggcagaaugauaggguuaggcuuuguauccccacccaaaucucaucuugaauuguaauccccauaauucccacaugucaaggaagagaccagguggagguaauugaauaaugggggugguuucaccuaugcuguucuugugacaggaaguucucacgagaucugaugguuuuauaaguggcucguuaccccuucacuuggcacaucuccuucuugucccuuugugaagaaggugccuagcuuccuuuucaucuucugucaugauugcaaguuuccagaggccuccccagccaugcugaacugugagucaauuaacacccuuuccuuuauaaauuacccagucuugggcaguucuuuauagagguaugaaaacggacuaauacaauuuggucaaccuuaucuauggagugaaguaucaucaauagauaacuaucuauuuaaaccaaugacggguuacaucuuguugauuagagaggaggccuggauuauggaugucauauuuggcagcuaaugggaaaccauguccagagaagaugaggaacaacuuuaaaauauaaauucagggaaaagaguaaagguacaaauugauuauauguguuugccauuugucagcuaaugauacuuuuccuuguaguuacuuuuacuaggcaauuuuuuuuccuccuuucucccucaugaacucacuugcuguguuccuuuuuuuaaauugagauauaauuuauguacaauaaaguuuacccuuuaaacugaaguuauggugaacccucuucaggcgguuuuaguauucucacaaaguugugcagccaucucuuugcucccuuucucacauggguagcuaauuauccuuggaucauguaagcaugacuuuguggaaucauagucugcagauuuaguauuaguaucaaauugauaucucuaaaggggcuuucugcuuccauauuuacucuggccagugcuucaaccauaacacuggaucuuuauuauauugcuccaaaucagagccuuuguuuuaauuacaaaucuucuagggcucccuucacauaacucuccuuccuugacagacauacucagaaaaggggaggggaaggggagaagugcagcauuauuuuggagaacccauauuugaauuguucucuauguagauauuuaaaaacacccucaggagaacuaauacaauauuaaaaauuagagaaguggucuuguaaacacuugaauuaaauaacccuuucuuuuuuccaaaugcguuaaaacccaaaaccuuacaguuguuugaaagauuaaacaaguugggugugguggcucaugccuguaauucuagcacuuugagaggccgaggugggcagauuacuugagcucaggaguucgagaccagcccagacaacaugguaaaaccccaucucuacaaaaaaauuagcugguguggugcugugcaccuguacucccagcuacguggagggcugaggcaagaggaucucuugaacccaggaggucaaggcugcagugagccaugauugcaccacugcacuccagccugggcgacagagugagacccugucucaaaaaaaaaaaaaaaaaaaaaaaaaaagaaagaaagauuaacuuaaacccacucuaaaaauagaaguuauguacuuugauuaguaacuuauuucuggcauuacuacaguucauuuugaacaccuuaaguuuuaaaaggaaagggaacaucugacuuacuggacauacucaaggacuuuuguuucaaucaggugcuuguuucgaucaggugcgucuaccaguauuuugaaggguuugcauaauuaugcagaaucuucuccuagucaguaaccaaggauuauacagucagaguccccacuuuguauuccacuuaaaucauacuguuuugcauuauuuuaaaugguugcaacuuuauuuuuauugaggggaaggcauccggaagaaaugugguuaucauaagaucaucuuuccuuuggggcauuggagauauuuuccaacccuaaaauugugauuucuuucugacugccauuaugcuuaaacaagcaucauugcuuaguuaucguguucuauugcauugcuaacgugauggacuggaccgacagagaauuacucuguagcucacuauucagauuggaagaaagcacuggaaagagcagguguuugaauuuuucauuuuucuucuuaugcuuuucuuucucucuuucucuuuacccccuuucucacauggguagcuaauuauccuuggaucauguaagcaugucuuuguggaaucacagucuccagauuuaguauuaguaucacauugauaccuccagaggggcuuucugcuuccauauguacucuggccagugcuucaaccguaacacugcaucuuuauuauauugcccuaagugauuuccaaaccuauguugaacaaaagaauacaauauugaagacuuuuaauuugagggcuuauaucuuugcauacccugcuuaauuuuuuuccaagugucccauugcagauugcaaguauaaguuagugucggaauuaccauacgaaacucucuuucuaacuuuaaucgguaauuucucagcaauagaaaacaugaugcuaaugaauaauguacccaaaagcucuuauuauaggguugguaugaauuccacuuaaugacaagcuuucucaagcagcaguugauuugaaauccuacuuuucauuagugaaguauaaaauguuaauaauaccuuccacugugcuguucuuuuguagcauagcagcauauaucuucccuguucaccauggacucuuuuuaagaucuuacuaguaacuuccuauaacauaaauaagauuuguucaagaaauaaaaauguguguuuucccauuguuagcuauauguuuuucuaauaaucacauccgaagcuuauuauacaguaguagccuuaagauauuauuuuuuuaaauauacuacuuuggucuuaauacuaguuuuuaaucucuucuuguuucuaugaagucugaaugagauuuucaaaauugaauaauaauuugauccguuaaucuuuugaagcuaguaauuuuauuuuccucucuuugcagucucugagguucgcaaaugaauagagcuucauuauugcagucugcauuuaauaacaauuauccauuaucuuguaauuaagacucccuguaacgaaucaugaggacaaugcaaaaauacauaguacauuucuuuaaugaacuggaaaauguucaucuuguucuauuuaguaaugaguugcugaauagucauuaaauccacuggagaauagagcuagauggauuuugaagacugucuugaguuugugguuaaucuauuagaauuaaaauuucaucuucuauuuuuaucaacagcugauuagaagucauucuguuugaccaaauugauuagaagaccauauacaagggcagcuguuguuuaaugaaaguuuuuaaugaaacuguaccauggagacuuguaauuauaguccuuagaaaagcuuugaguugccuuagaccacaaaaauaguauugugcuaaagauuucaaauuaggaaaauaaaaaauacaauuuaauauaauacuauaaauuuauuauuaauuuuaauuucaacuaaucacaguugaauauuagucuacuuaguguguuccuuuugacuuuuucagcccuuucaucucuuaguuuagucauuuaguugaaauugugggcacugaugaaagaacauuuauagggauagcuauuguaauuugagauauuuucucauaagauuuuuguccccaagcugagcagagguaagcuuggcuaauguuagauuuaugugagcucugaagagagucuguagugcugugugguguugguaauucaaaauguagcauuuauuucucuaaaguaauuucguuuuagcagaagggcaaaggaagcaauguuaaaaugagaaguaaaacaaaaguguguccuacuuagucccauuggaaaauccauuuuucuuuugacagcaguaaaguaaugauguacuuucuaaaauauuuuguguaauuaaagcuaggucuuauuccucacuuaaaaaauagccagugucugcaugccugaacuauuuuuaauaucuuguggucucugacucucaauuguccuuucucaacacauccaauacagacacuaaauuuagcaucuuaaaacacugauuucaugugaucagaccucacauuaccuaaagaacagagcccaaugucuguggguucaaagcucucuauaauauuuuccuaagggauauuuacagucacaucuucuaaaacauacauucauauaucuguguauaugucccuccucccaccucaccuccaacacagacuucuuagauguauucuuucauuauuugguaugccauauacuuucuuugcuuuugguguuucuuuuuauggugguguucuuccaugugugcccucucaucuuuaaauuuugucucuccuugaaggucuguaacacauuccaucuguuccaugaagccuucccguauuauucuagcuaaaguuauuucucugauccuuuguaauucuuauugaucauaauacuuacugggcauaugauauaguuuggauuuuugucccuuccaacucacauguugaaaugugauucccaguguuagagauggggccuggugggaggggauuggaucauggagguagauccuucaugaauggcuuuagcaccaucccuuuuggugaugagugauuucuugcucugagcucacaugagaucugguuuuuuaaaagagcauggcaccuccccgcaucucacucccacucucgccaucugacaugccugcucucuuugcuuucugcugugauuguaagccucccaggagccucucuaggagcagauccaagcaccacacuuacuguacagucugcagaauugugagccaauuaaaccucuuuucuuuauaaauuacccaauguauuaguccacaggcugugcaggaagcauggcuggggaggccuuaggaaacuuuuagucaugguggaagaggaagcaggcaugucuuaaauggcuggagcaggaagaagagagaggaggggaggugcuacacacuuuuaaaccaccagaucucauauuaacucacuauugcgagaacagcacgaaaggggaaaucuacccccaugauccaaucucuuccuaccagagacaccugaacauugggguggggguuacaauuugacaugagauuugggcagagacacagaccuaaaccauaucacucagccucagauauuccuuuguagcaaugcaagaauggacuaacacagaaaacugauaccaggagugguguguugcuauaaagauagcugaaaaugugggagcagcuuuggaacuggguaauggagagguuggaagaguuuggagggcccagaaaaagacaggaagaugagagaaaguuugaaacuuaugagagacugguuaaaugguugugagaaaaugcugacagaaauauagacaaugaagucaaggcugaggaggucucagauggaaaugaggaaguuauugagaacuggagugaaggucaccccuguuauguccuaguaaagaacuuggcugcauuauguucaugcccuagggaucugaggaaauuugaauuuaagggugaugaacuaggguaucuggaggaagaaauuucuaagcagcaaagcauucaugauguggcccggcuacuucuaacagccuacagucacaugcuggagcaaaggaauuacuuaaugugagaacuuauauuuaaaugggaagcagaguauaaaaguugggaaaauuugcagccuuucccugugguagagaaggaauucaagcaggcuguggagcaacugcuugcuagagagauuagcuugucuaaaagggagccaagugcucauauauaagacuguggggaaaagacuugaaggcauuucagaggucuucgaagcagccccugccaucaaaggcccagaggccuaggaggaaagaaugguuuuaggggacaggcccagagcccuacugccuugcacagccucaguaugcugccaccagaauccuagaagccucagcugaaaggacaacugauacagcucaggcugcugcuguggagaguacaaguuguaagccuugcugguuucuaugugauguuaagccuugagguucauggaaugcaagagugaagggggucuggcagcuuccauguagauuucagaggaugugucagaaagacuggguacccaggcagggauucucuacuaaggcagugcugaagggaaauguaggguggagcccacacagagucuccacugcagcgcugucuuaguggaauugugggaauggggcugccacucuccagaccccagaaugguagagccaccagcaguuugcaacuaccacauggaaaagccacagggcagagcuuuccaaggacuuaggagcccaccucuuucaccagugugcccuggaugcaggacauggagucaaaggagauuauuuuggagcuuuaagacuuaaugacugcccugcugaguuuggggcuuguaugaggccuauagcgcaccccucccccuuuuuuggcugauuucucccuuugggaaugguaauguuuacccagcaccuuugccacaauuguaucuuggaaguauaacuuguuuuugaucucaggcugacagguggaaggaacucaucuccagauaagacuuuggacuuuagacuuuggcauuuuugagcuaaggcuggaacaaguuaagacuuugcagaacuguugacaggguauuacuguguuuugcaaugugaaaaggacaugagauuugagagaccagacgcagaaugauauaguuuggauguuuguccccucccaaucucauguuaaaauguaauccccaaugauggaggcagggccugguggaagguguuuggaucaugguaguagaucccucaugaaugucuuagcaccauccccuuggugaugaaugaguucucacaagaucugguuguuuaaaaagaauguggcaccuucccucucucucucuugcuccugcucuugccaugugacaugugugcucccucuuugccuucugccaugaucguaggcuucccaaggcccuuaccaggagccaauccugauacaacacuucuuguacagccugaagaacugugagcuaauuaaacuucuuuucuuuauaaauuacccagccucagguauuccuuuauagcaaugcaauaauggacuaacacagcauauguucagaaacaccauaacuaccagauacauucuuauuuccccccacaccuaaucucuagacaauaaaggcuuggcuugauauuuaaggacuuccaguuucagcuuuaacauauaaagagcuuggaaguugucacuccuguccuuagagcaagaaaaagcagaauuaacugaaaaugagugacuuuucucagacccaucaaagaccugaggucgcaagguaaacugucagcuugaaauccagagagacagauaaauccugagcgucucagcugaaauuugcuuaccuggagcagaagcuacuagaaccaaaaccuaguaggaacacuuaaaugguaauuuugacaaauuacuggaggcugaguguggcccccacucuuuuuuggguuuuaccuccaagaaccccaccagguucucacagugaagagccaaagaaggucccuucuuggcucuggcaggagaaggagaagauaaucauugugcaauaugcccagcauauucccuauaguaaagccuacucuaggacaaaauacuaagucuuuucccgcuugagagaagggcauuuccucucuagucuuucugucucaucaaaaugggcggagaaaagcuaagaaacauuugugacaguuacagcccagggacacaggaccacugaaagacugagauuuaauacuaaggcuauagaauacuccucccucaucuguuaccaccacagcaacaugguuucaguauaagauuacagcugacagagcuaaaauacauaggcucucugaagaggaauuuuagggaagcccagaauaaagaggggagauaaaaacaagaauacuauagaaauuugaagacuauggcagcuacagcaaaccuuaaacacagcccaacuccuugcccgauuaacauaaaaccuuacaccaaaggcccauuuguuuuuguucauguuacccaauauaucaugcauagcuuucaacaaaaaauacauuggaugcuagaggcaagaaaaaaaacucaaagucuuuuuuuuuuuuuuuuuuuuuugagacggagucucgcucugucacccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccucaaacagucuuuauagagaaaacaaguaucagaaucagauucagauauggcauagauuugggaauuaucugacagagaauuuaaaauaacuaugacuaguauguuaauagcuuuaaugaaaaaacagacaacaugaaaaaagaugcauaauagaaucagagagauggaaacuaaguaagaauugaaaggaaaugcuagaaaucagaaacacugggacaaaaugaagaaugcuuuugauggguacaucaguaagcuggaaacugcugaggaaaaaaaucagugaccuuaaagauaggucaauagaaacuucuuaaacugaaaugugaagagaaaaaacugggaagaaaaacccccacagaacagaacauccaaaaacuuugggacaguuucaaaaggcauaacauaugguguauaauuggaauacuagaagacgaaagaaaauagagcagacaacauauuugaaguaauggccaggaacuuuccaaaauugaugugagacaccaaaccacagauccaggaagcucagagaacaccaaguaggacaaguauuuaaaaacugugcaccuagacauauuauagucaaauugaagaaaaccaaagacaaauagaaaaucuugcaaaaagccagagaaagaaaacacuuuucauugagaagaaaaaauuacuacaauggacuucucauuggaaaacaugucagcguggagugaaauacuuagaaggguuuaaagaaaaaagcaaaaacaaaaacccaacaacauggaauucuguguucaaugaagcuauuuuucuaaauugaaggagcucagacaaacaaaaacugaaguaauuaauugccagcaaagcuucccaaggcuucagagagccuguguauuuuagcucugucagcuguaauccacucuuauuacgcuguaauccacucuuauuacacugaaauguuaaaacaaguuucucagggagaagaaaacuuauauagaucagaagcuuugaucugcauuuaaaaaggaagcgcauuagagaaggaguaaaugaaaaauaaaaauaaauuuuuaacugauuuaaaagauaacaauuuaaaguaauaauauaacaauuuauugaauuguuauauuaccagauagguaagcugaaaugaaugacagcaguguuauaagacacaggagaaaagaauugggaauacuuuguuaaaauguaccugcaguaccuauguagugguauaguguuauuugaagguggacuuaguuaaaaauguauauugaaaacucuagggcagucacuaaaauauguacaaaaguaugauugauaugagaagagauaaaauggaauaauauaaaaugcucaauuaagccaggaaaggcagaaaaauaggugucaaaauuaaccaaaaaaaugcaacaaauggaaaaguaauaaacaugguauauauuaauuugacuacaucaguaauuaguuuaaauguuaguagucuaaauaugccaauuagaagauagagaugauaaaaaaucaagauccuacuauauguugucuguaagaaagccacuuuaaaugugaagacucagaagguuaaaaauaaacaaauaggaaagaugcaccaugcuaacacucaucaaaguaaagugggaguagcuauaugaauuucacacaaagcggacuucagaaaaaggaacacuaucagcgauaaaaaaggauauuuuauaaugaugagggggucauuucucaaggaagacauaacaauccuauguauguaugcaccuagccacagagcaucaaaauaugaggcaaaaauuuuauagaacugaaaaaaagaaauaaacaaaucuacuauuguagcuggaaacuucaaagcuccucuuuuagucacugauggcugaagcaggcagaauaacagcaaggauauaguugaccugaacagcacugucauucaauaugaucaaauuaacauuuauagaaaacuucauccaacaacagcagaauacauauucaauguucacauggaacauuaaccaagauagaccacauucugguccauaaaacacaccuugacagauuuaaaagacugaaaaucacacaaaauauguucucagaccacaaugguacuaagcuagaauucaauagcagaaaguuagcugaaagauccccaaauguuuggaaauuaaacaacacacuccuaaauaacauaugggucaaauaagucucaagagaaauuuuaaaauacuuugaacuaaaugaaaauaaaaauacaccaccaaaauuuguaggauguuccaaaagcagugcuuagaaagaaauguauggcauuagaugcauauauuagaaaagaauaaagucaauaugcaagcuuucaucuuaggaaaguagaaaaagaagagcaauuuaagccuaaagcaaacaggaggaauagaaaugagaacagaaaugaugaaauugaaaacaaaaacaacagagaaauuuuuuuuuuuaaauauccuaaaagcuacuuuuuuuuuucuccccccguaagauugguaaacagcuagcuaggcuaaucaagaauaaaagagaaaagacauaaauuacccauaucggaaaugaaagaagggucaucuccucuucccauggauauuaaaaggauuauaaaggaaugugugaacagcucuauuuucacaaauuugauaacuuaggugaaauggaucaauccucaaaagacauaaacaaccaaaacucacaaggagaaauagucugaauaggucuauaucuauuaaagaaauuauuuaaauuuaauuuaauuucuuuuauaaaauauuuaaugugacuuuuacauaaauuguaaauauauuuacacauuuauguaaauauauaacauauuuuaauuauauaaaauuauuuauuuaaaaauuuaacaaauuacuaaaaacuauuuauaaccuuccaaaagaaagcaccagcucuagauggcuucauuggugaauucugccaaacauuuaaggaagauauaauaccagucuucuacaaucucuuccggaaaauagaagagagaacacucauucugugagacaauuacuccaaaaccauuacuccaaaaccagauaaagacacugccagaaagaaaaccuauagaugaacaucuuuaaugaacauacauauaaaaauccuuaacaaaauauuagcaaaaugaguccaacaauguauaaaacuaauuauaugccacaaccaagugugauuuauuccagguaugcaagucugguucaacauaauguaauccauaucaguaagccaaagaagaaaaaucauaugauuauaucaauugauacugacaaggcaucugacaaauuccaacacccauuuauaagaaagccucggcaaacuagaaauagagggaaauaucuucaacuuaauaaagaacaucugcaaacaaaccucagccaacauacuuaauauugagaaauugcgugcuuuccuccuaagauccucuuaaggauaaggcaaggauauucucucuuaccacugcuauucaacauuguacuggaaguccuagcuagacaaggaaaggaaauaaaauguguacaggucaagaaguuugguaggcuaaagaugacuccugaagauagguucacauccuaaucccuggaaccugugaauguuacccucuuugggaaaaagagcuguugcaggugugauugauuuaaaggucuugcagugaggugaucauucuggauuauccagaugggcuguagaaggcaucaugacaaguguguaagaaagacucagagggagauuagacucauaaacaaaagacuguaugaagacaaaagcaggaauuggagugaugcagcugagaaaugcugaaagccauuagaagaggcaaggaacagauuaucccuagagucuccacagagaguauggcucugcugacacuuuuauuuuggauuucuggccuccagaauggugagagaauacacuucuguuguuuugagccaccaaguuugugaucccuuguuacaacaacaauaagaaacagguaugagaagaaagauauaaaacugucuuuguuuacaaacaugaucguagaaaauccccccaaaucaacaaacuccugaaauugcuaaaugaguuuaccaagguugcacgaugcaugguuaauauacaaaauucaguugcuuuccugucuagcagcaguguacaauuggaauuugaaauuuagaaaacuauuugcaaaagcauccaguauccauggauuccauauauuuacagauauguguauauaaaugcauuaauauacacagauauauuucccugcucagucagcuaggagagcuaaaagcaagaacacuagagcagcagugagcauaccuagcacccauauagugguuuccaauaccauucuccaguaaaaggagccagggcucauuggagaaauggcuuauaccaggacuggugcagaaaacacacaagauaagcccugagcaucuucuagucucagaaaguaagugcuuaaaaaacagaaaaauccacaugaugcaaaggcauacaggaagcaacugaaagagcucccaguggccaaagcuggaaccgugugaacaauaaaauaaauaagguagugaggaauuauaaacccaaguguaaaauaaauaucuucaaguguauacugauauuaaguaaauuauuuuaaauuuuaaaauggagaggacacaaaccuucccauauaaaauuccaaguaauuauguagccaagccccugcucgaggagguggauuauaacuucccacuccuuaaaugugggauacccauaaugacuucuuuucaaagaguacaguaugaaaaaugggggaaaaagauuagcuuuacaguggagaaaccgagccaacacuaacuaccucagccaagugcucauggucaacaucaacagugguaaaucauggugcuaguaugugcccuugacauaaugugauuaacauagcaguuucccucuauggucuuaccaaaccuauaaccucaguccagugaugagaaaaacauuuaacaaaucccaauugagggagggagaguauuuugagaauacugaccaguacuuucaaaacugucaagaucaucaaaauaaaauaagaagaaucuaagaaacuaucacagccaagagcaaucuauggaggccugacaaauguaguaugcuagaugggauugguuauugagucauacuaaaaaaaaucuauaaaguguggacuuugguuaauaguauaucagcauugguuccuuaauuguuacaaauguaccauaauuauauaagauaguaauaauagggaaaacugggugugggguauauggaaacucuguauuaucgcuguaauuuuucuguauauugaauuuuguucuaaaacuaaaagauuauuuaaaaauaaacaaacuggccgggcgcgguggcucacgccuguaaucccagcacuuugggaggcugaggugggcggaucacgaggucgggagauagagaccacggugaaacccggucucuacuaaaaaauacaaaaaguuagccgggcguaguggcgggcgccuguagucccagcuacucgggaggcugaggcaggagaauggcgugaacccgggaggcggagcuugcuugcagugagccgagaucgcgccacugcacuccagccugggugacagagcgagacuccgucucaaaauaaauaaauaaauaaauaaauaaauaaacaaacuauuuuguucugagccaccagcccaguuuuguuacugggacuggaaugaaacacaagauuauuuucccuucuucauuagucaguuaaagguggaaaauacuguaguuuuuuuuuucuugguagcuguguccauccaucuagaaauuauuuauugagcuucuccugugugucgugcucugaggauacagaagaguauaagaaagaugcagcaccugccccuaaacguccagaaaggggcauagacaugcaaauaauguguaggccacuguagcuacugcugggcuacuguugcugccauaguagaucuucugcuuugcucucccaaauauauuagaaagagaguguccaccccgcccuucugaaggaguuugguucuuuugauuaacuuuagauggugugguuuuuaagagaucaugccuuguuuucagaccuccaaauguagccuuggucuuuuuuuuuuuuuuuuuuuuuuuuuuugagauggagucucacucuguugcccaggcuggagugcaguggcacaaucucggcucacugcaaccuccaccucccagguucaagcaguucucuugccucagccucccgaguagcugggacuacaggcacccaccaccaugcccggcuaauuuuuuuuuuuuuuuuguauuuuuaguagagauggaguuucgcuauguuggccaggcuggucuugaacuucugaccuugugaucugccagccucggccucccaaagugcugggauuacaguugugagccaccacguccagccaguagccuuggucuucugucuuaaucuucucuuccaagaugcuuaagauaauuuaggugauauccauuauuauacccaaaagccuucuagugaaucaaaagaugccacauauuagaaaaacacaucuugauaucauuauggauucuuugggggauguuucccucaccuucuuacaucuauguggaggcuuuaaucucuucuuuuugauugucucauuuuugauguuguaggcaucaggcaccuguucuauagucuguucaucuaugcauuuauuaaugaacuuaguauaugccuagcucaaggccuuuacacuuuguuuuccugcuuguaaugcuauaucugcacauuuccuucauucaaucucuauuuggauuugauuaauuagagaugcucuuaugauaacucuuuaaauauagcugccccucaccaacuccaucacucucuaucucauuacauuguauuauauuucuccauagaacuuaucuccacuugacauuuguuucuuuauugucuuucucuucuagaacaccugcucacaaaggcaggaacuuuuuguucauugguugcucuauucccagcagcuuuagagcagagucuggcacaugguaguacucaguaaauauuuguugaacaaaugcaugcaugguagucaugucuccacuuucucccaggcagccuuacagacccaaagaaaugaaggcuuccagugaccugcucugaugcaucaguguccauggaauuuguacagauugcaguccuacuuaaguccuugcuucauuucucuuuguauaauaauugacaguuuucaaagugcuugcuaugcgauugucccuuuugaugcuuuguguaauacuaugaagcaagugggaauuucuuagaccugucguacaaaugaggaauguaaggggauggaauuucaaagguaacuaucagagccagagcuagaaaccagaucuccugacuucuagcucauuuggugauuaugcgggguuuacguuucaucuccacccgugucuacauuguaugguuuugagggcaaggucuugaauuuuuuguauuuauauuuuuccauaugccuuauacacagugugcuuaauaaagguguguugcuuugggccuuuaggccacuucaacuuuuaucuuugacuucguuaauggacuuugggaggaucucagagacuuguuuuagguauggugccacagauuccauagguuagggccaugaauuugcacacaaaucaccuaggaacuuugguuauguuagauucugauuuaguuggucugguguagugccugagauuaugcauuuuuaacaaccucugguagugcccgugcugcugguacaucuuccacacugacuauuucagggccuuguaacacgugaaagagguauucuuuguuuggguaucugacugugugaaccuagguaaguuuauuggagacgcugugauguauuguuuaggcuagauuacuuugguuaaaauccuaccuuuccauuuacugugugaucucagguaacuuacuuaacuuuucugugccucaauuuccucuuuaaaaguagagaucguauuacuaugaucucuauuuguagcucaugcagguauugacugaauuaauacuuguaaagcaucuagauucauaaugcauggcacucaaugaaucuuaacuacugugaucauuucuuugucuccuuguguuauuuuguuaaacuacauuaauagguuuaagauacauuugaaggaaggaaguuguuuaagauauuugcaagguaugaaauagcguggucucuuucauggaaaugcuaaucugguuggaagacaguucuuucauuaaugaacaaugcaauagaaaucagcuaauggugauucuucuugagcugucacaacuguauacuguguacuuuucauuaagcaugagcaaauuaggagaaaaugaguaggcacuccuguuuuguaguaaaauguuacgauguauaauauuaagcauagggcauaaaauuguuuuuauucaucucaguuauguauuaaaugaaccaacuugauuuuaauuggcauuguggaaauauggaggcaagaguaucagaggucagugagaauauauuuggugccuaauacagugaugguaagggggaaaaaguauggacauaaucauuuuaaagggagauuuugguuuuaguuuuuccaauaauuaaugaaaaauaacauuggguuucuucgggaaaaaauuuacacaacucauuucucccacugacucaaaaguguaaaaaaagaaucuuuaauuaacauggaguuuuuccucuuuuuguuuuaggaucagauuuuauuaagaccucuacuggaaaagaaacaguaaaugccaccuucccgguagcuauaguaaugcugcgggccauuagagauuucuucuggaaaacuggaaacaagguauauuauugccagcaaaucuuucuucagaguaaagauaauguuauuuauaauacuaguuacagccacaauaacugucuuuauauggagaaguugugaaugaauuaccuuuauuaagauaaauguuuaauuuaccuuucauuauaaaagaacacacugauggagaaaaauugugaugaacagaaagugaguugugagugugggagugaguaugugugaucaagauguaaacucacuuuauguccuuuuguuaaccgaagacaauuuugucacugacaagagauuccuaaauggguucuuuaacgaacuaauucugcugcaacacagaggcuuucucacaagguguuggccagugaaaacagguuaaugcagaaauuaaacuuccuugaggaauggaaagaauugcagaguaacauuuauugaaugauaagcugugguggugauaugaaagguaugcaauauaaugggaaacaaucuuuuccugucauuauugaaggacacacauaaauugguuuuucuguugggaaacccccgguccagaaaaacuuauuacuuuuaauaauaugaggugaagagaaaauucucgaggagaugaacuuauuaaacaaaauaaugaaaugcugugaaacagcagggaaaagguagcuagacguuauauagcucuugaauuaaauaucaauuuuugcguuuuauggaaguuggaugugcucuuuggaagacuguuaagcugaggaggguguauacuaguuuuugucagcuuuucgaaaaaugauacauauuuuuugaaacauaugaaguuaaaaggaaaaaugcguaugaguugcuuuuuuaaaaaugaguuuggauuuuccuuuucaucucaaguuacuuguuuagcugcaaauuaucucaaaggauuuuuuuuuuuacaugauuggagagcaagguuguguguguguguguguguguguguguguguguguguguguguuuaaugacacuuucccuuccugagaggcaucuuuuaaauccagucucuugauuugugccaaauagaaacccaaaaaagaccuuuaauccuuuguccauuggaugugaugacuuuauauguaaguguagcuucaguuuauuuuggaauagugaccuuuuuuuuaauauacuguuuuaugagaggaaauaaacuccuuccagaauuuucucacuuaaaauaacuucacaucuuaauuacgaauaggauaaauaucuauugugaacuacaugagaaagcugacccaacucgaauaaccucuaccugguauccuuucugcaacaauccaaauaaguuaaaagaguuuuuguuuagauaagcuguaaaaaugauaaaucuaucuuugguccucaguugaaacuaccaccacucauuugauugugauucucauucuuagccaaagaauaucaaaaccaaaugugaagcuuuucauacuuacagaugccugggcccccaucccuggugguuuugggucuggcauagucuucaggcaucuguuugcauuaaguuccauugccaggguucagaccugccauuggggacccaguccuguuuuguucucaacaaacauuuauuggguaguuaaccaugugccauguuaaccuguguuaaaugcuaggaauggaaaaaugaguauguuccuucucaggagagcucuuagacaacaagcaaagaaugucaaugaaauuuuuaagugcucaguguuccaggccagaguacagagggagggacacuuugcugucuuucaguccuuucuuuuuaauuguauugauucuuuuccucgguaauaaauaaguccauccuaguuuuauuaagaaaaagacagguacaagccaaauuguauucauuuaaucauauucgauuucaaacaaauagguucuguguauguguuugcaaaucaggugcagccuuucggguugcuugacaaguugcuugggcagcccuuagacuauaaaguuucuacgucauugauuuaaggguguuuuaaaaugcgauaggcuagcuuccagaccaugauuagugucacuccugagaagcagagguuuaauauuucauaacugauuucauugcagauuuaugucuuccauauucucuuuaaaaaaaaaaaagauaaacuuauguuagaaccucucuggaaacagacuugcugacacaaacugaacuguauaggaaaucuguaagaagcacugccuaauugacaaaaaugguccuaugauuaacauguaugcuaauaucaacuaauugauuuuuuuggcuuauucucaacaaauaaccucauccuacuuaacccccuacuaccuuacagcuugggcuccagaguaauagcagauaugguuggaauccgugcacugcuacugcuuaguugugugacguuguguaauugaggcagggaaaccaguuaaaagacuuuuacugauauuuccugugagaauugauaagggucuaaacugaaacaagugagagugcaguggaaagagugcaugugaggggguaaggaagguaaggagguagaauugucaggacuuaaauauugauugggugugguguggccagggaaugguggaguuuggauuaaacuauaagguuuccugcuuggguugauaauagaauauauucauuuaaugucucccuucucuagcauucuguuagcagucaucugcuggugcaaccagucauagcccugagugauaaaacgugagagauuuaguacucaggcucugagguguuguuuugaccacuaccaucuacagauucccaacucuacuggauagucagguuccugaaacauguaaauccagauaaucagaguuuuauuguauauggaacauaucuuucauuuccuaauggauccagggacaucauuuacgaauaucagauauuggcugaauucagcuguguuaugaucaaccuuaaagacuacuggacuaugaggagccccucacgguguuuuucuacugcccuuauguaacuggucugccagcuuuuuagaacugugugugccugcaacuuagaaaaaaaaucccacaguuaaauugguuaaaacaacugucaacuuuccuugcuuuuuugcugccaguuugguuaggguaaccuugcagccuugcugauucuguccuuugauuuuaaaugcacgugucuuuugaaccucaagaugaaggcugagaagugacucuacaggcuuacuuguggaaauguagaaugagugggcuuugcuuuugugaucuguuuuccuauuuauugacaccuuccuuguuuauuccagguucacagcuauagucuagaugguggagguuuaugacuuuccaauaagugaaauguuaaugaggguuauuaacccucacuagugucuguuuggaaguagugacauucuuccaaaaaucuuggaaaaguuguuuuguagugugaaugagcaugagucacugaucuaagcccuuucacuggaugaagugaaaagauuuuuuuucaacaaaagagggagagagagaaucaagacucugauaaacauaguacuauuuuuaaaagaaauccaauaacaauaaagauuguucuauucucugccuucccauuuagauaggguuuaaaccagcaggaggcauccgcagugcaaaggauucccuugcuuggcucucucuuguaaaggaggagcuuggagaugaguggcugaagccagaacucuuucgaauaggugccaguacucugcucucggacauugagaggcaggugaguaaucaucucugucuuuggaauaaauuaacaaguguuuuuugagaaaggaauugaaaagucaaauugagaacuggagauaaaaacucaucugauugaccucauccuacccaauccucuaccuuuucuuccaagcaaaccgccaucagaagugaguaggguggagauucugcugaagcacauacuagugaggcuuucuaaugaaauguucauuaaaacuauuuauuauuauuugauaguauaauuauuaacugauguguauaauuauagaaugauuguuaauuaaacucugcuuuuccucacagauuuaccaucaugugacuggaagauaugcagcuuaucaugaucuuccaaugucuuaaaucagucaccaguuccagaaaaguucuuuacgacaauguuuaaaaauuauuuuucuacguaauugcuaaaauuauuuaauuaaaaaauugggcaguagguaacuggcauuccucucuuuaaaauuucuaccgaacuuaauggaauggaaaaagcaaacucauccacaugugguacucauuucaggcacaucugaaaugaucuuaauuacuagaagaucugcacuauuaacuuugugaagaguuucuccuaaaaacuuuaaguaaaauguuaaugguagcuuugauaacaucaaauucuaagggagaaaaaaacaauauuaaaccgcccaagcagugugcccuagcagaggaaaaugcaacaucucgcaagcgcugcuguaacgacuucaggagucacugauucagcacuaauuuccugcugugaaaacucaucuuucauuuuugccguggauaggcgcuuuuauuaauuguuguccuaaugaaauuucugacauugucauauacaacgaugaauaucauuaaaauuuuuaaaauaauaaaguuccuauaguuuauuuuuuuaaaaaacuuaaaaauuguuacaauacauaaugaaaaaauaauccauuaaacauaaaaagagguuugaucaguga

SEQ ID NO: 191704 - RNA, 243977 nt, Homo sapiens
gagacagaguuucguucuuguugcccaggcuggagugcaauggcacgaccucggcucacugcaaccacugccucuggguucaagcgauucuccugccucagccucccaaguagcugggauuacaggcaugugccaccacgcccagcuaauuuuguaauuuuaguagagacuggguuucuccauguuggucacgcuggucaggagccaggugaucugccugccucggccucccaaagugcugggauuacaggugugggccaccacacccagauuuuuuuuuuuuuuuuugagacaaagucuuguucugucacccaggccggagugcgauggugugaucucggcucacugcaaccucugccucccagguucaagcgauucuccugucucagccucccagguagcugggauuacaggcgccugacaccaugcccagcuaauuuuuguauuuuuaaguagagaugggguuuuaccauguuggccaggcugguccugaacucccgaccucaagugauccaccagcccuggccucccaaagugcuggcauuaccgcaccuggccucaacagucauuucuaaacauauuaaauuaaaaguuuaaacauagccaggcgugauggcucaaucuuguaaucucagcacuuugggagauugaggcgggcagagcgcuugagcucaggaguuugagaccagccugggcaacacggugaaaccccuacucuacaaaaaauacaaaaaaaucagccaggcuugguggcacaggcguguggucccagcuacuugggaggcugucgugggaggaucacuuaagcccaggagggcaaggcuccaagaucucaccauugcacuccagugugggugacagggugagaccuggucucaacaaaaaaaaaaaaaagaaaaaagaaaaaagaaaaaaggcuuaaacacaagugacaaaggcagaacacagguaagacuaucacaguuagguuauuuguaacucuccagcaagcacuucaguccugcacagauaccaacugacaaaaacagaagccucuuugagguuccagguagacauaaucucaaauaaaaguuacaaauaugaaaagacaacaaaauacuuugggcugaaaaaaagggcacagauuauaguuccuacaauaaggugugaaaggaaguagauuccagaaaacaggaugggaggaaauauuugcaaacuaugcauccaacaaaggacuaauauccagaaucuggaaggaacucaaaacaaaucagcaagaaaaaaaaaacaaaaacaaauaaucccaucaaaaagugggcaaaugacgcgaauaggcauuucucaaaagaagguacacaacaaugagaugccuccuuauuccugcaagaauggccauaauuggccgggugcagugggucacgccagcacuuugggaggccgaggugggcggaucaugaggucaagagaucgagaccauacuggccaacauggugaaaccccaucucuacuaaaaauucaaaaauuagcugggugugguggcacacgccuguagucccagcuacgggggaggcugaggcaggagaaucacuugaacccuggaggaggagguugcagugagccaagaucacgccacugcacuccagccugcugacagagcgagacuccaucucaaaaacaaaaaaaaagaauggccauaauuuaaaagucaaaaaacaacagauguugguauggauguggugagaagaaaacacuuuuacacugcuggugggaauguaaacuaguacaaccacuacggaaaacaguguggagauuccuuaaagaacuaaaaguagauccagcauuugauccagcaaucccacuacugaguaucgacccaaaagaaaacaagucauuacauaaaaaagauacaugcacaugcauguuuauagcagcacaauuugcaacuccaaggguauggaaccaaccuaagaguccaccaaccaaggaguggauaaagaaaaugugguuuauauacaccauggaauacuacucagcaauaaaaaggaacaaaauaauguauuuugcagcaacuuggauggagcuggaggccauuauucuaaguaaaguaacucaggaaaggaaaaccaaauaucauauguucucacuuauaaguuggagcuacacuauggguaugcaaaggcauacagugugguauaauggacuuuggagacucagaagggagaggguggaaggucggugaaggauuggguacaacauacacuacucggguaaugggugcacuaaaaucucagacuucaccacuauacaauucuuccauguaacccaaaaccacuuguacccaaagcuagugaaauuuaaaaaaugcuugaaaaggaagaaaaaaggcugggugugguggcucacaccuguaaucucagcacuuugggaggcugaggcggacagaucacuugagcucaggagcuugagaucagccugggcaacauggugaaaacuccaucucugcaaaacaauuagccuggcaugguggcauacaccuguagucccagcuacucagggggcugaggugggaggauugcuugagccugggaggucagccuucagugagccauugagccaugaucuugcaccacugcacuccagccugggugacagaguaagaccuugccucgaaaaaaaaaaaaaaaggagagaaaauaaaagaaauauuuugagaaugugaaaaucaaagaggcuaggcacaguggcucaugcagugggaggguagcuugaauucaggaguuugagaccagcguggacaacuuaguaagacugucucuauaagaaaaucgaaauaucagccgagugugguggcgugcacuugugaucccagcuacuugugaggcugaggcaggacgacugcuugagcccaggaggucaaggcugcagugagcugugauuaugccacuacacuccagcaugggggacaucucugaaaaaagaaauaacauaaaaaaaacaagaaaauaaaaaaacaaaaagauguuaguacuaaugcuuauaaugucucuauauguuucugcugcuguucagcagaaaauggugguaauccuaaagcaccaaacuuacuagauaugguagaugcugugagaaagaaaaugcagaaaaaggcauaacauucuuacucuacaccagagcuuuuauaaaaaguuaaaaaacuuuuagaguacgcuauaaguacuaaauucuagguuaaaauuagcaauugucuagaaaguuuaaaaguaagaauucaggaaacuauucucaauuauaaaucugugcucuaaggaacauuguucaagaaaggauuccuucuucucccugauaccauccaugguuuuaguaauuaccucccugacuuaauagaauucaauuacuuagaaauaauaucagauagacauuaaagauuuuaauauuccaucaaguuggcuguaccauaaacauuucauugucauuuacaauaauuagcaaacucccagugggcagacaugucacccuaacuguaaaaagcauuacauagucaacguguaaugacuuaaacaaaauucucaggucgcuauggaaaggaacauuaaguagaagcacagcugcacaacacugcaagucuuggcacaggccauacccuccaaauuuuguuguuuuucuggaugaugaaauaagagacaaagaaaaugcugucacacagcaaaucaucagaggagccaauguuagcaaucuguuaccaacccugguuccaagauaugccuacuuguucugccaacuaucccuauguacaguccagaacuaaucccaguuuugauucacuaaaccaacagauaagucauaaaauucaaguaaaaaacuaaagcacaaaugcaaagggaaaugacguacuucuucuaagacuacacacacaugaaaugugauccuucugugagcugcggcugaguggauggaacuggcgaugccgaggacucaggagauggggacagacuuuucacuaaaacacacaaagaaaaugggagaagauaaaaaucuuuaagacacauuuggagaaguaaauccugaugcuguaaucccacaaaaauuagaacauguuuugagaaggaaguaauagauacauuugguucuauugugauuuuuucuuuuuaaauaauuaaaaacaaauuuuuauuaauugagauggggucucaccauguugaccaggcuggucuugaacuccuggcaucaugcaauccucccaucuuggucucccgaaguguugggauuaugugcccagccuguuauuuucuaauuugcaaucuaauuauucaguauaaaauauuuccugacaacuacuuaaaaauuuuuuuuuuuuuggcugggcgugguggcucaugucuguaaucccaccacuuugggaggccgaggcaggcggaucauuugaggucaggaguucgagaccagccaggccaacauggugaaaccccgacucuacuaaaaauacaaaaauuagucagacaugguagcucgugccuguaguccuagcuacuuaggaggccgggguaggagaaaugcuugaacccaagagccagaggcugcaaugagcugagauuguaccacuguacucuagccugggcaagagagcaagacuuugucucaaacaacaacaacaacaacaaaaaacaaacaaacaaaaaaaauacuuuacauuuuuuuuuucugcuuugagguuaauuuucuguuggaacuuuuuuuaguucuaugcagcuaaauacuauggaugauuuaaauguugugguuuuaauacuaucauaacacuuugauccagaccugcugcauaauaaccaaaacuggccagugacaauuuuuuuuuuaacaagugagaccuccugugcacacuaccuuauucauuuauuuagagacagaauuucgcucuuuguugcccaggcuggagugcaguggcgugaucucggcucaucacaaccucugccucccaaguucaagcgauucuccugccucagccuccugaguagcugggauuacaggcauggccaccaugccuggcuaauuuuguauuuuuaguagagacgggguuucuccauguuggucaggcuggucucgaacuccaaaccucaggugauccaccugccucagucucccaaagugcugggauuauaggcgugagccacugugccuggcuauuuauuuauuuuuugagacagggucuugcucuguugcucaggcuggaaagcaguaaugcagucacacagcucauuguagccucaaccuccugggcucaggugauccuccuaccucagccuccugagaagcugggucuauagugccaucccauccggcuaauuuuuuaaaagcauuauuuuuaguagaaacguugucuuguuacauugccuaggcuggucuugaacuccugagcucaagcaauacuccugccuuggcuuccgaaagugcugagauuauaggcgugagccacugcacccagcucauacugccuuguaagugacagaggcaaaggaaaaggcagugcuuaguauuuguuacaagggaacaugacugguaauauaaauuuauaauuuauuuuaaauaaguaaauuaaauaaaguuuauuuuauuuaaauuuauaacauacacguuauauuuauauaagauacggaagauguucugcccagaaccccaugcuuuuccuaagaagaaugguccugaauacuugaauuucauuguuucuuacucuucugcaaaagggcaggagugguggcgggguuuuguaggaaugguuuuuuacuuauggacuacaagaagcaaagcugggccgggcgcaguggcucaugccuauaaucccagcacuuugggaggccgaggcgggcggaucacgaggccaggagauugagaccaaccuggcuaacagugaaacccuaucucuacuaaaaaaaaaaaaaauacaaaaaauuagccaggcguggugacggacaccuacagucccagcuacucaggaggcugaggcagaagaauggcaugaacccaggaggcggagcuugcagugaguggagaucgcgccacugcacuccagccugggcaacagagcaagacuccaucucaaaaauaaaauaaaauaaaauaaaauaaaaaagaagcaaagcuggcugggcaugguggcucacgccuguaauccuagcacuuugggaagcugagguggguggaucaccugaggucaggaguucaagaccagccuggccaacauggcgagacccugccucuacaaaaauacaaaaauuagcugggcgugguggugggcaccuauaaucccagcuacuugggaggcugaggcaggagaaucgcuugaaccugggagguggagauugcagugagcugagaucacgccacaucacuccagccugggugaaagagcuucaaaaaaaaaaaaaaaaaaaaaaaaagaagaagcaaagcgauaauaugcacuaauucccaucccuguucccaaaaaaucauaaagaaaaagaguaaaagggccgggcaugguggcuuaugccuguaaucccagcacuuugggagguugaggcgcgcugaucacuggaggucaggaguuccagaccagccuggccaacauaguaacccccaucuguacuacaaauacaaaaaauuagccgggugugguggcacacaccuguagucccagcuacuagggaggcagagguugcagugagccaagauagcgccacugcacuccagcgcuggcaacagagggaguacucugccuccaggaaaaaaaaagaaaagauuugugaagaguccaaaaaauaugagagaauagagcacagaacaacuuguuuuuuuuaaaaugccauggauaauaauuuucuacaauugaaggaacagccagguauggauuauagcaaugcuggaguaaacaaacccauucuauuaguuuagauauuaaauccuccacaguucccaauguggcaggcuugugaauacucugagaaucuagcccugagaacagauagauuuuccaaguacugaaagauuuucuuuucuuuucugagaaggagucucgcucugucacccaggcuggagugcaguggcacgaucucggcucacugcaaccuccgccucugggguucaagcaauucucugccucagccuccugaguagcugggauuggagguggcugccaccaugcccggcuaauuuuuuguauuuuuaguagagacgggguuucacuaucuuggccaggcuggucuugaaccccugaccucgugguccaccugccucggccucccaaaaugcuggauuacaggugugagccaccgcacccggccaaaagauuuuauuagaaaaaguuuacucuauguguuaaaauugaaaggaaaaagcaaaaccaaagccaauguguugaucccucugccaggguagacucuggcaggggcugcauccuccugaagguacacuuggggaggcaaacguugacucaucuguagucaagguacuuaagcgauucccuucuuagaaucuccccauggaaaauaaauuuagaaguucagaggaagcaccagguagaaaauuaugaaguguauacuaccuaccugccauuguuugauuuccucuagaaaccucaggaguugauucguaagaaauaacaguuucuuccuguucgucaacacuguucuuuguauuuucuucaggaugcucuucugguuuaugauuugcggucuguguuucaucuugagggcugaugaaaauagauugguauuuaaaaauuugucacuauagaauacaauuaauuuuucuuuuuuuuguuauaaaagaugccaccaccuauguuuaacaacgaacauuuucuuacaauuaaucuuuucuuucuuuugaaaguuucaaacaaaagaauuagagcaaauaauaaaccuguauauucauuucaauaauuacuugguuugccaaucuugcuucaucuaagcccuaaaauccuugcucccuaaaccauuuaaagcagauucuacauaugauauuuaauuuguaaguacuucagaacauauuuuuaauauguuaaugccaucaaauauccagucagugcuuaaauuuuccuggugccucauaaugucauuuuagaauuagaaucaggauccaaacaagguccauauauugccugacaaauuccuuaaagucuacuuuaauccaaaacaaacugccccagaucccuuuuauucuuugccauuuauauguaaaagaacuuggucuaucuguccuauauaguuuaucacauucuggauucugaugauuguaucccucaggauuuucuauaaaguuauaagauuuuuuuuuuuuuuuuugagacggagucucacucugucgcccaggcuggagugcaguggcgcgaucuaggcucacugcaagcucaccucccagguucucaccauucuccugccucagccucccgaguagcagggacuacgggcgccugccaccacguccggcuuuuuguauuuuuaguagagacgggguuucaccguguuagccaggauggucucgaucuccugaccucuugaucugcccaccucagccucccaaaguggugggauuacaggcgugaccuacugcgccuggccaaaguuauaugauuuuaaggcuuauucaaauuuagguuuuggaggggcaaguagcacuucauuaggugggugucaugaacuauugcauuaacagauuguuucuuuuugugauguuaaaaaugaucaguguggcugagcgcgguggcucacgccuguaaucacagcacuuugagaggccaaggcaggaucaugaggucaggaguucaagaccagccuagccaagauggugaaacucuguuucuacuaaaauacaaaaauuagccgggcacaguggcaggcgccuauaaacccagcuacuugggaggcugaggcaggagaacugcuugaaucgggcggcggggcagagguugcagugagccaagauugcgccacugcacgccagccugggcgacagagugagaucccgucucaaaaaaaaaacaaacauuagugaguucagggguuauuggguugacccauucauauaaagauccuugucagauuuucagcugauagcuuuggcagccacugaggaauauuguucaaauccauuauggcauuagggcuagcaaagcaaugacacauauauauuuuuuuuuugaggcagauucucacucugucgcccaggcuggaguacaguggcgggaucucggcucacugagaccuccgccucccuggcucaagcaauucuugugccucagucucacaagcaggugggauuacaggaauguaccacuaugcccggauaauuuuuguauuuuuaguagagacaguguuucaccauauuauuggccaggcuaguuucaaacuccugaccucaauugaucugcccaccucagccucccaaacugcugggauuucaggcacgagccacugcacccugccacaaaacaaugauacucugacucccacuugaaauucuucuaaaaauaaguuuccucaaacuauuugguuacaauuugggaaaaaaacaugauaaauacuugauccuuucccuuaauguaccaaguuuuggaauuaaaaguugauucucuagcauccuccaaaauggccaacaaguaauuuuuuuguuguuguaucauuaugaacucaucaauuuuuaauauacuguguuuuaaucuaugcuucuuaauacaaaaauucagcagagauauuuuucuuagcagacauugccaaauacuuuucaaauucaaucuugcuauucauuuaagaaaucaaggcauuccuaauaacaguaaaccacagcauuucuguuuucuagugccgguaauauguuuaauggagggaaagauugaagauauacucuuaaggccaguuaaggcuggguaugguggcuuaugucuguaaucccagcacuuugggaggcugaggcggguggaucaccugaggucaggaauuugaggccagccuggccaacauggcgaaaccccgucucuacuaaaaauacaaaaauuagcugggcaugguggcacacgcuuguaaucccagcuacuugggaggcugaggcaggagaaucgcuugaacccaggagguggagguugcagugugccuagauugcacuacugcacuccagccugggugacagagugagacucugucucaaaaaaaaaaaaagaaggcuaguuaagaaauauagcuaaaaauggccaggcacgauggcucacgccuguaauaccagcacuuugggaggccaaggcgggcugaucaugagucaggagaucgagaccauccuggcuaacacggugaaaccccgucucuacuaaaaauaaaaaaaaaaauaaaaaaauaaaaauuagccaugcguggugacacgcgccuguagucugagcuacucaggaggcugaggcaggagaauugcuugaacccaggaggcagagguucccuccgggaaccgagugcaguggaccaagauugcgccauugcacuccagccagggcaacagagcgagacucugucucaaaaacaaaaaaacaacaacaaaaaaaaaacaaaaaaagaaauauagcuaaaagaaaaaagaaaaucaccauaauuucuggaacucuuaugagacagcuuagaauuuugaccaaugucaaucauuaccugggaagacugauuucagggcccccccacagauagcaaaaucugcagaugcuccagucccuuauaucaaauggcauaguacaguuggcccuccagauccauggguucggaauccauggauauggagggccgacuguaaaggcauaaauccaugaauauggagggccgacugcauaggcagugaugaauugcuuacucugcuacagcuuauaugccuuuugacuuuuuuuuuuuaagguauuuaucucucuuuuuaaaauuuuuuugagacagggucuugcucuguugccgaggcuggaguguaguaacgugaucauggcucacugcagccuugaccucccauguucaagcaauccucccaccucaguuuccugaguagcuggaacuacaggcaugcaccugggguaagguaucauuuauugaauacuuccuaggugcuaagcacaguguaaagugcuguacauguauuuucuuuuuuuuuccuuuucuuuugagauggagucucacucugacgcccaggcuggaguguaguggugugaucuuggcucacugcaaccucugccuccuggguucaagcauuucuccugccucagccucccaaguagcugggaccacagacaugcaccaccaugucuggcuaauuuuuguacuuuuaguagagacaggguuuuaccauguuggccaggcuggucucaaacuccugacuucuagugaucugcccccguuggccucccaaagugcugggauuacaggcauaagccacugcuccuggccacauguguuuucguauuaaucuuuacaacacaccugucagauagauacuguuauuaugccuuuuuuuuuuuuuuuuuuuuuuuugagacagagucucacucuguugcccaggcuggaguauacuggcacaaucaugggucacugcagccucgagcucuugggcucaagugaucuucucaccucagccuccgaguacagacuaggacuacaggcacaugccaccaugccuggcuaauuuuuuuuuucagagaugaggucucauuauguugcccaggcuggucuugaauuccugggcucaggugauccuccugccuuggccuuucaaagugcuggaauuauagaugugcaccagugcguccagcccuauugccauuuuuacaagugaggaauguguaguuuaagagguuauauaacuugcucaagauucuauagcuccuagguagcuaagcuggggcugaaauccaguacuuuugacucugaaguucaccauuuuuaagcaguuacacaguuuugugaaugauuccuuugcuuuucuuaaauauuaccugaauguaacauccucaggcauuuugucuuuguuucuuucuuuauccaucauuuccacagaauuuacuccauuuggcucagguucaaaaagcauuucauaugaaauguuuucaguuuuuuuuaacuguagaauaaaaagaaaaauuuucuuuucaaagaauucuuaucacauuagauuagcauaucuaaaauaauuccaaaauaaaguuuauugaacaaucacggucgggcgugauggcucacgccuguaaucccagcacuuugggaggccgagaagggcggaucacgaggucaggagauugagaccauccuggcuaacacggugaaacacugucucuacugaaaauacaaaaaaauuaguggggugugguggcgggcgccuguagucccagcuacucgggaggcugaggcaggagaauggcgugaaccuggcagguggagcaugcagugagcggagaucgcggacugcacuccagccugggugacagagcgagacuccgucucaaaacaaacaaacaaacaaaaaaauaaauaaacaaucacacucuaucaaauauuuacugauaauaaauuuagguucaaguauauuaauaauauuaacauucuuuacuacuaggaugcaaaaaguuauuugucuaaagagaugaugcaggccgggcacaguggcucacaccuguaaucccagcacuuugggaggcugaggcgggcagaucacgaggucaggaguucgagaccagccuggucaacauggugaaacuccgucucuacuaauaacacaaaaaauuagcugggcgugguggcacaugccuguaauccuagcuacuugggaggcuaaggcaggagaaucacuugaaccugggaggcagagguugcagugagccaagaucacgccacuguacuccagccugggcgacagggucagauucugucucaaaaaaaagagauggugcauauugcuaagaccuagcuguugggauauaagauuccuuaaccgggauuaaugauaauuuaaucuagcugugacugauuauguuuuaaauuuucaguuaaugcauuuuuuuuuaauuuuucuuuuuuucuuuuucuuuuuucuuuuuuuugagacggaaucucacucuguccuccaggcugcaggguaguguggcgcgaucucagcucauugcaaccucugacucccggguucaagcgauucuccugcuucagccucccaaguagugauuacaggcaugugucacugugccuggcuaacucuuguauuuuuuaguagauaugggguuucacuauguuugcgaggcugaucucgaacuccgggccucaagugauccacucgccuuggccuccaaagugcugggauuacaggcaugagccacugugcccgccacguuuuuuuuguuuuuuuuuuugaaacaggaucucacucuguggcccaucucuacucacugcgacuugggcucaggugauccucccaccucagcuuccccaguagcaguugggacuacaggugcaugccaccacaccuggcuaauuuuuguauucaguauuggcaggguuucaccauguugcccaggcuggucucaaacuucugggcucaagugauccgccugccucagcuucucaaagugcugggauuacacacaccagccaccgugcccagucaauuaaugcauaucuugauguggcugaauacaucaaucaaacuaaagaaagcuuaauuuuuccuuuuucuuuuuuuuuuugagauggagucucccucccucugucgcccaggcuggaguguaguggcgcgaucucggcucacugcaagcuccgccucccagauucacgccauucuccugccucagccuccccaguagcugggacuacaggagccugccaccaagcccggcuaauuuuuuuuugcauuuuuaguagagacgggguuuuaccguguuagccaggauggucucgaucuccugaccucgugauucgccugccucagccucccaaagugcugggauuacagacgugagccaccgcgcccggccagaaagcuuauuuuuucauuuagcucuauggacucugugacugaaagaaacacacuuuauuuucaaccuuaccacuugauuuaaucuucacaaaucuauuccuuuggaauaccuuucauaaaauaaucucgcuaccucuuugcugaaguccacauuuugggguucgguuucuuuuaguugaacaauuucuguugcaggaguuucauggucuggcuuuacaucauuuucucuaauggcaguguccaguuccuuaucaucccuccuucgagucugcucaaaagacauauagcauuuuuauacucauacugugcaugcauguauauuuuauaaauagugccuguuaauucucaaaauagaacaaagcuggaucuccacucaugaagaaguuuuccuaugaaaacuaacaaagaaaauuuauauauauagcacuauuccacacauuuuucucaacucuuuuaaaaaaaaccauucauuuuguaauuugcagaaugugccacaauucaaacuguugcuuuguuuagucuccauuagcaaugccugcacuugauucgguggaaagaggggauauucauuaggacaggaaagcauguucagcugaugcauucaguuuaugccauuauagacaaacuuuuaagauacuauugcuaggugacaagugucuacaaacagggaaagaccagacagaagcuacugaacagguuggcuaggcugcugucucugaauuuauaaagaggggcaaaaaacaaaaagaaacaaaauggcaucacuuuauaagccugaaguugagaggugauggacagcacacuuggaacuuuauuuagaagcucucuccugcuacaauuuaggucauguuaaaucaggacacagagcaauacauauuuuauugagaggggaauuggggacuaucuugguaaccugcauagcauuuuacauuuguugaaaacccuuuuauuuucuuagugucucuaaggagucugggcagcuguaucaucacuguaaaguugaagacauuaaguccacaacuaguccacgggcauccaacauguaguuuagcucuggucucuugaacucaggguuauuuacauuuuacuuagcugucuuagcuuauuauuaggagaauuaaauaauauaaaauaaguauccauacugcagaccuuuuaagaccuaucaaucauguaacucugauuccaaaauucagugauacuagauuuacacaaaauaauaaucaaaugcaauucauauaccugaguaguccuaaauggauuaucccuuaaauuugaagggcuuuguaagggugacuggucugaagcaccgauaacauuuaacccuuuuuucuucucccucaggcacgcuuguugaugucuucuuauucuuuccauuugcucuuccacagucauccuuggucgaguacuuucagccaaacagagcuguuccacugcacuucuuggucuuuccuucaauguaaaaaugaacauaucaauacauaaaugaaaacuucugaaaaguaugauggaauaaaaaauguuguaaagugcauuuauuuauuuuguuuucaaaaucacaagaagagguuuugaaugucauuuagauaucaccagaaaggcacaugaaauugcuauuugauccuuaacuaguaauuggugauguaugcucaauaacagaaagaaaaagagacgauauuauaagggaggagagagaaaagaggaauagaaaauauuuuuuuggcuuaaaaaaaaaauauggaccaggagugguggcucacaccuauaaucccagcacuuugggacccugagguggguggauuacuugagcccaggaguuugagaccagccugggcaacaugguaaaaacccgucucuaccaaaaauacaaaaauuagccaggcagguguggugguauaugccuauagucccagcuacuugggaggcugagguaggaggaugguuugagcccaggagguggagguugcagcgagcugagaucgugcuacugcacuccagcaugcagaugacaugacagagccagaugccaucucaaacaaacaaacaaacaaacaaacaaacccccauaacucaguuccaguaaaucuggguaaaacaaaaaacaccaucaccaccaccauaaaagggcagggcaggcugggugcaguggcucacgccuauaaucccaguacuuugggaggcugaggcagguggaucacuugagaucaggaguucaagaccagccuggccaacauggcgaaacccugucucuauaaaaguacaaaaaauuuagccaggcaugguggcucaugccaguagucccagcuacucgggaggcugaggugggagaauugcuugaacccaggaggcagagguuguagugaacugagauugugccaaccugggcaaugagugagagucugucucaaaaaaaaaaaaaaaaaaagaauauaaagaauauggcagcucuggagcaagccagucccaugacccugaaauagaaaauugcauaaaacuugacccugaaagagaaaacugaauaaaacucaaaugaggagaaaagcaggggcacagugucuaaauauuagagauuucuuuuauuuugaugaaaacguaauguuuuaaguuauacauuuaccgugaaaagacuaauaaaacaaacaccucuauuuucuuucucaucaguaauaaaacuacgaaaacacuuauuuucuauaaaucagucauauuugaaaaugcuuaggccgggcgcgguggcucacaccuguaaucccaacacuuuggaaggccgaggcaggcagaucacgaggucaggaguuagagaccagccuggccaacauggugaaacccugugucuacuaaaaauacagaaauuagcugggcaugauggcgggcgccuguaggcccagcuacucgggaggccgaggcaggagaaucauuugaacccgggaggcagagguugcaaugagcugagaucacgccauugcaccugggcgacagggagagacucugucucaaaaaaaaaaaaaaaaaaaaaagaaaaacaacuuccucuucuuccacccagucaaugugaagaugaugaggaugaagaucuuuaugaugaacuauuuccacuuaauaagugguaaaauauauuuucccuuauaauuuuaauuaauuuuauuuauuuauguauuuauuuuuugagacaggcugucacucugcugccuaggcuggggugcaguggagcaaucauggcucaccucgaccuccugggcucaagugauccacccuaucucagcuucuugaguaggugagaccauaggcacaggccaccaugccuggcuaauuuuuuuugguaauuuuuguagagauggggucuccuuauguugcucaggcuagucuugaauuccugagcucaagcaauccuccagaccuggccucccaaagugcuggaauuauagguaugagcuacuaugccuggccuaaaccugcuaguaucuuucugcuugauuuuauauuuguguguguguuguuuuuuuuuguuuuuuuuugagacagagucucacucuguugcccaggcuggagugcagugguacaaucucgacucacugcgaccuccgccuccuggguucaaguaauucuuaugccucagccucccgaguagcugagacuacaggugccugccaccauucccggcuaauuuuuggauuuuuaguugagacagcguuucaccauguuggccaggcuggucucgaacuccugacuucaaaugaucugccugccagccuuggccucucaaagugcugggaugacagguguaagcuacagcaccuggccucugcuugauuuuaacaugcacuuuuuguaguccuuuuucuguagacuuguuauuuuagcuuuaccauuuccaaugaaaucuuccaaucuguaaaaaaugccuaacucugaacaaacaauaguauuacagaaucaugaccauuaauguuaaugcugauauauuaucuuuauuccaugauaauuauuucuauagaucuuuauacuuuuguacuaauugaaaacauuacauuuccuauguauaaaugcagcugaguuuuuuuuggcauguacuuuguaguuguacuuuaauaucuuugaagaacagcuagccugggcaacagagagagaccccgucacuacuaauaaaaaagaaaaaaaaauuuagccgaguauggugguacgugcuuauugucccagcuagccaggaggcuggggugagaggaucccuugaguccacgaguuggaggcugcagugagcuaugaucaugccacugcacuucagcccaggcaauagagugaaacccuauccauugaaaaaaaaaaaaaaaaaaaaaagacuagccauauaucuuauauguaguaccuuucuugucuuauagccuaaaauuaucucauaccaaauagguagaguauugauaaagauaagaaguagaagcauuuuugcagcccaaauuucuagagaauacuugaagaaagggaguuaaguguucucagcauuuuccaaagaacaaaacucgacugguuuggaguuugaauuaaaugaaucucagaugaaaauguaaaauauaggauuuauuuucuaguuccaacucacauuucucagaguaaccagaggacuggcaaacucuaaagcuauuaauaccauagcuaaaaggcccugcaaccucaugauagcuagaaaauccacuaacuuuugggaggccacaggacacaucuauaccucucaucgagaaaauucuuaagaggcaucaaggaguguaguacagugauuagagaauagauucuacaaauuguggacuacgacuaugaccccaugucuaggcugaucaaaagaaacuuaaauuagguguugacuaggucuguccucugacgugcuaauucuuuaaacaaaauuuuaaggccgggcgcgguggcucacgccuguaaucccagcaguuugggaggccgaggcgggcggaucacaaggucaggagauugagaccauccuggcuaacauggugaaacccugucucuaauaaaaauacaaaaaaauuuagccaggcgugguggugggcgccuguagucccagcuacuugggaggcugaggcaggaggauggugugaacccgggaggcagaguuugcagugagcugaaaucacgccacugcacuccagcccaggcgagagagcgagacuccaucucaaaaaaaaaaaaacaauuuuuuuuuuuuaagaauaacuaagaucgggcuggggggcgguggcucacaccuguaaucccagcacuuugggaggccgaggugggcagaucacgaggucaggagaucgagaccauccuggcuaacacggugaaaccccgucucuacuaaaaauacaaaaaaaauuagccgggcgugguggcgggcgccuguagucccagcuacuccggaggcuaaggcaggagaauggcgugaacccgggaggcggagcuugcagugagccgagaucgcgccacagcacuccagccugggcgacagagcgagacuccgucucaaaaaaaaaaaaaaaaaaaaaaaaaagaauaaagaauaacuaagauuacuaaguuuuucuuugaguaugcaaaaauaauuuugauaagacacugaaaaugaaaacauguaagaaagcaauaaauagaugugagaaucuuccuagaagauuaauuuccaguuaaauaccguucuuagauccaucaucuucuuaguuuuccucaagguuacauaggaagcuauugucgaagauucggguguuggugauuuugcucuuggagggacuacuccaacaggaaagugggaaccuaaaaauuaaaacagcaguaaguuuuacaaaacaucuuuuauacagcauugcuuucuuuuagcuuacuuaauuucugacacuuuuuaaaaucagaaagcaaauuuauuuaaaaagagucaggcuggccuggcgcgguggcucacgccuguaaucccagcacuuugggaggccaaggcaggcggaugaccugaggucaggaguuugagaccagccugaccaacauggagaaaccccgucuccacuaaaaauacaaaauuagaugggcgugguggcgcaugccuguaaucccaacuacucgggaggcugaggcaggagaaucacuugaacccagcagucagagguugcaguaaaccgagaucgcaccauugcaccagcgugggcaacaaagaacgaaacucugucuaaaaauaaaaaaaaaagagucaggcugggcguggugacucacgccuguaaucccagcacuuugggaggcugaggcgggugaaucaccugaacucaggaguucaagaccagcuuagccaacauggugaaacccuaucucuacuauaaaaaauacaaaaauuagccaggcauggugucaggugucuauaauuccagcaacucaggaagcugaggcaggagaaucgcuugaacucaggaggugcagguugcagugagcugagauagcgccacggcacuccagccugggugacagagaagacucugucucaaaaauaaauaaaaaaauaaauaaauaaaaauaaaagagucaaagucagucaaugauaccaccagauaaauuuaggguuauauuuaaaaacaaaauucuguucaugccuguaauccuagcacuuugggaggcugaggcgggaugaucacuugagcucaggauuuucagaccagccuggguaauauagugagacccugucuccaaaaaaauugaaaaaaaaaaaaaagcuggguguggugguguacaccuauagucccagcuacucaggaggcugaggugagaggaucacugcagagguuacagugaguugagaucgcaccacugcacuccagccugggcaacagagcaaguaagaacuugucuccuuaaaacaaaaaaaaagaaaaaagagaagaaaaaauuguacagauuaacugaugacauuuuuaagaacauuaauuauaaaaugcccucuuuuggccaggugcuguggcucauugccuauaauccuagcacuuugggaggcugagaugggaggaucacuugaggccaggaguuugagaccagccugcucaacacagacccaucucuauuuaaaaaaaaaaaaaaaaaaaaagccuucuuugucauacugauacaucucuaucaucaucguuaacaaguuaguucaaccuaaauguucuuaauuucugcuuggcuuuaaaaaaaucauacaauauugccucaaaguguccacuaacaauguuaacaauagcuaacuauagguacucauuuucacuuuaucuucuguauuuuucuuuuuuuuuuuugagauggagucuugcugugucacccaggcugaaguacaauggcacgaucucggcucacugcaaccucugccuccugggcucaagcgauccucccaccucagccuccugaguaggugggacuacaggcaugugcuaccacgccuggcuaauuuauuuuuuuguagagacagacaggaucuugccacguuguccaggcuggucuugaacucuugggcucaaaccauccuccugccucagcuucccaaagugcugggauuacaagcgcgugccacuaggcccagccagucuuuuuuuuuuuuuuuuuuuuugagauggaguuucgcucuuguugcccaggcuggaguacaauggcgugaucucggcucacuguaaucucugcuuccugcauucaagcgauucuccugccucagccuccugaguaacugggauuacaggcaaacuaugccaccaugccuagcuaauuuuguauuuuuaguagagacaggguuucgccauguuggucaggcuggucuggaacuccugaccucaggugaucugccugucucggccucccaaaaugcugagauuacaggugugagccacugcgcccugccuuggccagucuuuuuaagugaagcauucaguccaauuauauuuguuguaauugccaauguauuuagauuuauuucuaacaauguauuuuuuugcuuugcauuuucuccagcuucuuuucuuuuuuggauuaucuuucucuccuuccagaguccugcuguguuguucaggcugaaguguaaguggcacgaucacagcucucugcagucucaacaauuucuuuuaucuuaaacccuagcaugcauacuuaaacuuaugaaagucugaaguuagucaaaaucauuaccaugauucagaacaaaacaaagauguuaaagcguauuaauaucaauaaacuuccuccucauuuauaugcuauuuuugucaaauaguuguuguauaugcuuaaaaaaaagcuaaauacauuuuuuacuuuauaaaauagagaugaggucugguuauguugcccaggcuggucuugaacuccuggacucaagcaauccaucugcuucggccucccaaagugcugagauuacaggaaugagccaucauucccagcccauuuaaagucuuuguuguggccaggugugguggcucacgccuguaaucccaacacucugggaggcugaggcaggcagauugcuugagccuagaaguuugagacaagccugggcaacauggugaaacccugucucuacaauaaauacaaaaauuagccaggugugguggcacacguguguagucucagcuacuuggcaggcagaggaggaaggaggcuacagugagccaugaucucaccacuguacuccagccugggccgauggugagauccugucucaaaaaaaaaaaaaaaaaaaaagacuuugaauaaggagacaggauuaggaugagaaagaaaagguguauaaauauuaaauuuucaagaugccaguauuuuuaaauuuaaaaaacgacauuagauaaccuagaaaaauauuccaacaaugaaaaaagcuaugugaacauuacuaccacuuagguguuuucuuguuuguuugcuuuuguguuuuuuuuugagauggagucacugucuaggcuggagugcaguggcacgaucuuggcucacuguaaccucugccucccaguucaagugauucuccugccucugccucccgaguagcuggaauuacaggugcccgccaccacaccuggcuaauuuuuguauuuuuaguagagauggggcuucgccauguuggccaggcuggucuugaacuccugaccuugugauccgcccgccucugccuuccaaaaugcugggauuauagauaggcgugagccaccaagccuggccucacuuugauguuuuucaaacuuuacuuagugauccuuuagcagauuacaaaaaucaguccaguggguuaugauaagcacuuauuuuucuaaaaaguuuuacauuuugucacacuuacauuaucucugcauaaauacauacacauucuuucuggcgaauccuuuaaaaguggcagaugcuuuuguccuaaguguuucagaauucacauacuacauucuacuacacaaccacaauaucacaaucacacuguuagcuaauaucuagaacauguuuaaauuuccauuaauugugcuacuuuagagauucuucuuuuaaaccaugguccaaucaaguuucaaacagugcgauauaucuaucuguuauuuuuuugugugugacggagucucacucugucacccagacuggagugcaguggcacgaucuuggcucacugcaaccucugacuccuggguucaagugauucuccugucucagucuccugaguagcugggacuacaggugugugcuaccaugcauggcuaauuuuuuguauuuuuaguagagacaggguuucaccauguuagccaggauggucuccaccuccugaccuugcgaucugcccgccuccaccucccaaagugcugggauuacaggagugagccaccgugcccagccaaacuuuuguauuuuuaguagagaugggguuucaccauauuggccaggcugguagaguuuccauuucuugggagaguuuuuuuuuuuuuucuguuucugguuguuguuguuguugcuguuguuguugaucuccugaccucaggugauccgcccaccucggccuccugaagugcugggauuacaggcguuagccaccaccccuggccuaucuaucuuuuuaaucuaggauaguucucucucuacucuuuucuuuacgcaauugccuucuagaaaaaugaccagcauuaagaaaaaaaucagaguauacauuacagaaauauuauuuuagaauuuacuuuguugauauugugugaaaauuuguuucagccauuaauaccuuaugcauaauuuuaaacacacacacagaaaagacccuguccaggugugguggcacaugcuuguaaucccaacaccuugggaggcugagguggaaggaaugcuugauccccagaguucaagaccagcuuaggcaacacggcaagaccuugucucuacaaauacuuaaaaaauuaguuggguaugguggugugugccuguagucccagcuacuuggaaggcugaagugagaggaucaccgagucugggaggucgaggcuacagugagccauguuugcuccaguacagcagcucaggugacagagugagaccucacacacaacaacacaucacaaacaacaacaacaacaacaacaacaacaacaaaaacaaccaccagaaacagaaaaaaaaaaaaagaaaacucucccaggaaaugggaaacuuuaaaguuugacauaaacuuauuucuuaguaaaaccuaaucugaugugaugucuuuuauuuuuauuuaugagacgaagucuugcucuguugcccaggcuggagugcaguggugcgaucucggcucacugcagccugcaccuccuggguuccagugauucuccugccucagccucccggguaacugggauucaggcacgugccaccaugcccagcuaaugucuuuuauuuuuagcauuuauuuaugccacuuggaaugaauauuguagaaauaguguuaaaaaaagggugcugccucauaccuagcugagaugacauauaucauuuaugggccauuuuaucuuuuaauaucugaaaauuucuuaauuuagaaacucaucagaguccaaagguuucagauaaaggguuggacucauauaugagucaacauguaaauggaauuuacuacuauuuuggcaguaaauugucuucaaaaacaaaaaccaagagguaaaacauauuacaaaugcugaccuuuaacaacugaaguuucuaucucugaaacagguucugauuuuucuucuccauuagauucaucaacuucugccacuguuguuaacucugguucacucuuguagagucuauaaucuggacccuugaaaggaagacauguaauuacccuaaaaaacugcuaaaaguuucuuuuaaaauguuuacugcuaaagacacaaaucaaacucuaaacauuaguagcccuagugagccaucugggauauaacacaaauaauaccuaugucacaauuacguggaaagaagaaauuugagaaauuuuuaaguggcaaaacuucguuuuaauauuaagaauauuucuggccgggugcaguggcucacaccuguaaucucagcacuuugggaggccaagguggguguaucaccugaggccaggaguuugagaccagcccagccaacauggugaaacccugucucuacuaaaaauacaaaaauuagcugggcaugguggugugcgccuauaaucccagccauucagaaggcugaggcaggagaaucacuugaaccugggaggcggagcuugcagugagcugagauugcucuacugcacuccagccugggaaagagugagacccugucucaaaaaaaaaaaaaaaaaaaagaauauuucuguuccucuuaggaacaaagucacauuuuuaugauggaauaauugagggcuaaaaauaacuauauuaauucaauaaauuuucauucacaagguagucuaagugaggcccaucccagcacuaaaauuccugucacagacauuuuguuguucucaaauuagcucaauucuaauuuccuuuuucucuuugcuuauuauauccuacauuauuugcuuaacccuaaacguauuucccauuuucaggggugacaucucuccuuagcaacauccacaucuuugaguaguuuuccuagaccaaaauguccacaucccagccccuuuaccaucccuaguaacggucuuuuucuuucucccuucuuucugaucugaagguauaaucuugccuccaauacccuaaaaugguauaucuaaaauacggcugcuucaucaugggaaaaguuaccacuuuaugaaaauaugaaaaaugcuaugaaauuauaaaauauuaaaauuauaaaaauauuaaaaaugagaauagcaaaaccaaaacaggaaagacacaaaugauaaagucauauauaaacuaaaaacugcuggccaaaaaugagguuauaaagguuauaauaaaaaaaaaguuugaguguaaaauaaauuaauuuucaaaaaugagaggacauguaggauugauuauucuguggcuauuccagccacuuacacagugagauccauuucuuggauauccuugaacuugauacaucuucuuuucuucaggcagaugaacugggccccugcuauaacagagcaaggagcugcuaucacugggcagaggggggauuaugggaggcugcucuguaaagucauaggaccgaggaaguggaggacgaggugggacuacuuccucuuccuaaagauuguagaacagucaccuuauuuagauaagcagauugaauuaagcauaucuaaauucuuugcaaugguauauuaacuuaaauuuacuuuaagauacuaaaagggacacugccaagccaaaagucuaauaaugaaaaguaaaaucaaaaauuuuuuaucauagccaauaauuggaauuuaacauauaauuacaucugauucuuuccuguaacauauagguuagcuucacacugaaacucaacauugaaagagauuacuauuuaaaacuaauuacuggguuucauuuuaaaacuagaaggaaagaacugauuuuaaaauccuauucuuauauuuucacaauuuaucuuauuuauuuauuugguagagauggggucucgcuauagugcagugauuugaucauacauagcucacugcaccuuugaacuccugggcucaagggauccuccuggcucagccucccgaguagcugggaccacaggcacaccaugcccgucuaauuuuucaauguuuucuagagaugggggucuugcuauguuuaccaggcuggucucaaacuccugggcucaagacauccuccugccuuggccuccuaaagugcugggauuacaggcaugagccacugcaccuggccccccaauuuuuaagagaggaaaaaaaaaaguuaccucuuugguuuuuauacgaaauucaaaauaauagauucuuuugguuagguugacaguaucucuuuguaguuguaauuucuuuaugcuacgcaugacauacaaccaacuuaucuaucgaucauccuauaaauuuuacauaguauaagaaacaaugauaaguauucaaacauuacuuagauuagaaaaaguaugacaacguuaaaauucuaacagauaaaaagcagagauuccauuuuuuugcauuaaaaaagggaagaaaaaucacauauuagaagcaccaaauuacugauccaauaaaauuucaagacuaaaacaauaucuguucaauauauuuaaaaaauauuuuuguuauuaagauuagagaagacaauuacuucuaauucaucucuuaagcauuaaaaguaauuuauaauuagaaaaacaauccaaacuuaccucauuuuuguacuuaacuguugagaaaggcuuugauccuaucauaccugggaauauuagaaaacguaacuauauuaaacauaucuuucuaauacuauaaaaaaagaacaauuucuuuuguuuuuuugaaaugaagucuugcuguuugcccaagcuggaguguaguggcgugaucucagcucacugcaaccuccgccuccuggguucaagcaauucuugugccucagccucucguagcugggacuacaggcgugcgccaccacgcccaacugauuuuuuuuauuuuuaguagagaugggguuucaccguguuggucaggcuggucuugaacuccuaaccucaagugauccaccugccucggccucccaaagugcugggauuacaggcgugagccauggcguccagccaaaaaaagaacaauuucauguauuuuuuuuuaaauuuauuuuuauuuuuauuuauuuuuauuuuuuauuuuuauuuuuuuuugagacagaguuucgcucugucgcccaggcuggagugcaguggcaagaucucggcucacugcaaccucugcgucccagguucaagcaauucuucugccucagccucccgagcagcugggacuauaggugcacgccaccaugcauggcuaauuuuuguauuuuuaguagagauggggucucaacaaguuggccagccuggucucgaacuccugaccucaggugaucugcccgccuuggccucccaaagugcucggauuacaggcaugagccacugcgcccggcuuauuuuuauuucuuuauuguuuuucacucuguugcccagguuggagugcaguggcgugaucucugccucccggguucaagagauucucuugccucagacuuccaaguagcugggaccacaggugcguaccaccacaccuggccaauuuuuguacuuuuuuuuuuuuuuuucaguagagccgggguuuugucauguuggccagguuggucuugaacuccugaccucaagugauccgccugccucggccucccaaagugcugggauuacaggcgugagcaaccacgccuggccgauuucacauauuuuaaaugaagucuucaguuucuaaucauucacuuauuguuuucagaauuggaaagcaauuacauuaaaaaggcaacaaauauuuaaacaagaguauggggaaauggguuuucucaaacauuacugguauuaacauaaugugaaauaauccuucaggagggcauuuuggccgcaguuauccaaauggaaaacaugugcuuauuucucaccuuuuaaaauccauuaaguacuaacauauguguuuaguuguauguauuaauaauguucacuauggcauggcuuaugacagcauucauaaaaaacucuggaaacaacauacauuauccaucaauauggaaauggauaaauauauuacaguucccuuauacaauggauucuuacacugcauuguuauggagaaaaaagcaaauuauugaaaaauagauauaggaugaucccaguucuuguuguggggauaaaacuucuaaaguguaaacauuguggauauuuauaauuauacacacaagacaauaauuauuuuuguuuagguaugguugacagagcuuucacuuuuuacuuuauaaaccugugcucugauucaauguuaagagugccuguucagaaaaaugcauuaaaauaacaaaagaaacucaauuauauaugucauuccauuuagacauucagucaugugccacauaccaauguuuuggucagcaacagacuacauauacgacaguggucccauaagauuauaaugcagcugagaaaauuuuuuuuuuuuuuuuugggacaguuucccucugcugcccaugcuggagcacacuggcaugaucuuggcucacugcaaccuccaccucccggguucaagcgauucuccugucuaagcuuccugaguauuugggacuacaggcaugcgccaccaugccuggcuuuuuuuguauuuuuaguagagacaggguuucaccacguuggccaagcuggucuugaacuccugaccucaggugaucugcccaccucagccucccaaaaugcugggauuacaggugugagccacugugcccagccagagcugagaaauaucuauugccuaguuguugcccucaugucagaguguaacacauuaccuuuucuauguuuagauauacaaauaacauuguguuacaacugucuacaguauucaguacagucacaugcugugcagguuugcaaccugggagcaauaagcuauauaccacauagccuagguguguaguaggccauacaacuagauuuguuuaaguacacucugauuguacaacacaaucaccuaacaaugcauuucucagaauguaaucugucaccaagcgacacaugacuguaauacuguggucagucacaaaauaaaaugcaaagcuaauuuaccuauuucuguaguaccucuuugcugcuuauguuuacucagcccuuccaugacauccugaauucgccaaaguucuuucugaaucugugcacgcugaauuccugcugauuccgucuaucaguaaaaauggauagaccauauauaagaaaaaaaaucauucacugaaguuaaaugauuauauauuaauuauauaaauuacaucuaaaaaugcaaauugcagugaauuaaguguuacgaauauuuaauaugauugaugugacucucccaauuuugcaaguccaguggcaaauauaaaagacugagcagagcaagaaaaauauuuaauuuucauacuuaaauauacuauuuuaaaucuuuccaauaagcuuugucuuacauuauuuaugauaccaggaaggcauauugauuaaaagggacccaaaauggaaaauacaaacagagagaaugaaaacagagcagaaacaaaccccaaaagaaaaaauaauuucugggagggggagauguggcagggcauuggggaaugggugagaaauggaagguguacuaacuuccuagguucuagaacauaaaaacaacaacaaagguacaacuaacaaaauauaucaagaugaauuuugacugacagaguuuaaauguauuuuuuuauuuuuauuuuuuuuugagacagagucuugcucugucgcccaggcuggagugcaguggcaagcucucaguucacugcagccucugccuccugggcgcaagugauucugcugccucagcuuccucaguaguggggauuacggcacgugcuaugccauaauuuuuguauuuugugcaacgacauaaucucagcucacugcaaacucuaccucccagguucaagcaauugcccugccucagccucccgaguagcuaggauuacaggcaugugccaccacacccggcuaauuuuguauuuuuaguagagaugggguuucaccauguuggccaggcuggucuugaacuccugaccucaggugauccgcucuccucagccucccaaagugcugggauuacaggugugagccaccgcgcccggccaauuuucuuacuucuaaaauuccacaucaugcccucagguuaaauacacuaacugaaaccaaaauaagauuacauugguuuucucugagauucuauuagaaaucuaugacucuuauucauaaauaggguaauaauaacaccauucuggauaauacuaaacacuauucuaggaauguaacuuuauuuuuaaaaauaggcaaugacauacaaaaacugucacauugccuagaacaauacuuucuuuggcugaguaucaguuauuaaugacuauagauauuagaauauaaucaguauugcaucaauaugcuaaaaaaguccucuaauggguagaaauauguuuucagccaggcacaguggcucacaccuauaaucccagcacuuugggaggcugaaguggguggauugcuuaagcucaggaguucaagaccugccugggcaacacagaaaaaccccaucucuaccaaaaauacaaaaacuuagcugggcggggugguguaugucuguggucccagcuacuugggaggcugaggugagaggaucacuugagccugggggaagagguugcagugagccaagaucgugccacuguccuccagccuaggugacagagugagacucugucacagggggaaaaaaaaagcaauauguuuucaaagucuuccaagcacuugggaguugaucaaaagauuaaaaaaagaaaaagaaaaaacucaagaaaagucuauaagccuaaagacuaugaauuaaugcugcuccaaaaaggcacuacauaaccuaaguuaucuaguuuuccaagcuacagccuggaagcaucaaaaaguaaaaaaaaagaaaguacccaugcaagagccaaacacaacgacagcccagagauguaaauacugacacagaggaugggaaggucacuauaaauaacagauccuugcacaucuauauacaacauguauuacuuucauaaaauuuaaaagauauauauauguauagacacauuuuugccaaucugaaacgguauacaaugcaaaucuaauuuuuauuuuauuugcauuucucugguuacuacuaacuuugaacuauuuuucuuuuccuuucauuuuuuuugaggcugagucucacucggccacccaggcuggagugcagcgaugugaucuuggcucacugugaccucugccucuuggguucaagcaauccuccugccucagccucccaaauagcuggaauuacaggugugugacaccaugcccagcucucucuuuuuuuguauuuuaguagagaugagguuucgccauguuggccaggcuggucuugaacuccugacccucaagugaucugucugacuuggccucccaaagugcugggauuacaggcauacgccacugugcccagccaacuuugaacuauuuuucuuuucuuucuuuuuuuuuuuuuuuuuauugaucauucuuggguguuucucgcagagggggauuuggcagggucacaggacaauaguggagggaaggucagcagauaagugaacaaaggucucugguuuuccuaggcagaggacccugcggccuuccgcaguguuugagucccuggguacuugagauuagggaguggugaugacucuuaacgagcaugcugccuucaagcaucuguuuaacaaagcacaucuugcaccacccuuaauccauucaacccugaguggacacagcacauguuucagagagcacaggguuggggguaaggucacagaucaacaggaucccaaggcagaagaauuuuucuuaguacagaacaaaaugaaaagucucccaugucuaccucuuucuacacagacacggcaaccauccgauuucucaaucuuuuccccaccuuuccccccuuucuauuccacaaaaccgccauugucaucauggcccguucucaaugagcuguugaguacaccucccagacggggugguggccgggcagaggcgccccucaccucccggacggggcggcuggccgggcggggggcugaccuccccgccucccuccuggacggggcggcuggccgggcagaggggcuccucucuucccaguaacuuugaacuauuuuucaaacacguguuaguaauuugaguuuuccuaugauuaguuacucauguuuuuuguauguuuuucuaaaggauuauuucuccaaaucaaaaagaaaaacuuccuugcaaaucuaaauaguuaucccuuguugaauuuuugagguaaaacauacauccucccaguaggucaucuuuuuacucugucuauguugccuucauugaggguaaaucuuuaacuuugauaaagccaaaugcuguucaacaauucucucucuuucuuucucucucugcuuuguggauauucauggccugcugcuaaacucucuauucuguuccauuggucuauuuuuuccuguaccauguuuaacacuauaguuuuacauuauguuuccuuguuuauuuauuuaacaaacacuuauauagcguguuuuauaugccugguuuuauucuacaugcugcaaaauauaaacauauuuauccucauaauaaccuagcaggaguagguauuauuuuauuuuauaguuguggaaacugagacccagaguuguuauguaacuggucuaaggcuguauaugcaauguuaccauucauagaguaugacuucucauucuuuuauuuuuuuuugaaaugucuuaacuacuugugguuuuuauuauaccuuaaaaauauuagagccauuucagaaauuucuuuagaaaauucuacuggaaauuugguuggaauaaaauugcauuuacaggaagaauuuucauugugauaauguuaaaucagaccauccaugaauaugguauaccaauuacaccucuccauuaauucaggucuucucuuauauccuguaauaagguuacuaaauuuucauaauaaauauauuuuuuggcagguuaaaucugggauuggcaaauuucuguggccugcagccucuuuugguauggccugugaguuaagaacaaauuuuacuauuuuuaagaaguuauagccgggcacgguggcucaugccuguaauccuagcacucugggaggccaaggcgggcagaucaccugaggucagguguucaagaccagccuggcuaacauggugaaaccuugucucuacuaaaaauacaaaaauuagccagguaugguggcacaugccuguaaucccagcuacuaggaaggcugaggcaggagaaucacuucaacaugagaggcggagguugcagugagcagagaucacaccacugcacaccagccugggcaacaagagugaaacucugucucaaaaaaaaaaaagagaaguuauaaaauaacaaaaaacauuaaauaauaugugacagaucuggccuuuuacagaaaguuugcugaccucuaguaauaucuuagguauuuauagcuauuuuucuaguguauuuagcaucucauuuuuguagcugauuucuuauuuuuuuuuuuuuuugagauggacuuuugcccaucacucaggcuggagugcaauggugugaucuccgaucacugcaaccuccgccucccagguugaagugauucuccugccacagccucccgaguagcugggauuacaggugccuguagcugauuauuguagcugauuacugacaguguaacuucaguguccaauacagaagucccagccacauguggccauuuaaauuuagacaaacugggcuuggugacucaugccuguaaucucagcacuuuguguuuuuuuuuuuugagacagagucucccuuugucgcccaggcuggcauacaguugcgugaucuccacuccacugcaaccucugccucccaggcucaugcgauucuccugccucagccuuccaaguagcugggaccacaagugcccagcuaauuuuuguauuuuuguagaggugggguuucacugcguuggccaggcuggucucaaacuucuggccucaagugauccucccaccacggccucccaaagugcugggauuacaggcaugagccaauguguccagccgaucccagaacuuuggaaggcugaggugggaggaucacuugggcccaggaguucaagguuucaucuaggaucaugcuacugcacuccagccugggugacagaacaaaacccugauucaauaaacaaguaaauacauuuagauaguuaacaugaauacaacuaaaaguucaguuuuaauuguguagucacaauagucacauuucauaugcccaacaacuacauguggccaguacuaugcuggacagcacagauagagggcagcugaauuucugauucaaccuuacuaaucuuuuuuuuuuuuuuuuugagauggagcuucgcccuuguugcccaggguggaguacaauggaguggucuuggcucccugcaaccuccaccucccggguucaagcgauucuccugccucagccucuggaguagcugggauuacaggugccugccaccaagcucggcuaauuuuguauuuuuaguagagaugggcuuucacaaucuuggccaggcuggucuugagcuccugaccucgugauccuggcuaauuuuguauuuuuuaguacagaugggguuuccccauguuggucaggcugguuggucuugaacuuaacuaauuuuucauucauuguauugaucugucuguuaaguccaugcauuuccaacuaaaauguucaaauuuacauugggucauaagcgugacguaacuuuuauuauuuucuuaaacauguauuaucugcguuccucagagcaacauuuuaagacaaguauuauuauuucuuuuuuuuuuuuuuuuuuuuugagauagagucucgcucugucgcucaggcuggaguacaguggugcgaucucagcucacugcaaccuccaccucguggguucaagugauucuccugccucagccucccaaguagcugggauuacagaugccugccacuacaccuaauuuuuguauuuauaguagagacaggguuucgccauguuggccaggcuggucucaaacuccugaccucaggugaucuacccacuucagccuccgaaagugcugggacuauaggcgugagccacuaugcccggccaaguauuauuauuucuauuuuauagauaagaaaacuaacccuuggaacuaggucucagaucuguuugcuuauuaacuggauucuuuauagcaaauggugcuguaucuuccccuauucuaauaaggcuugguggugcaugccugugaucccagcuacucgggaggcugaggcaggagaaucgcuugaacccgggaggcagagguugcggugagccaagaucgcgccauugcacuccagccugggcaacaagagcaaaacucugucucaaaaaaaaaaaaaaaaaaaaagauaaaagauaaaauauucauuauuugauaaauccauauaauucaacaucucaauaccaagugacacagauggaccugugaaaggauaugaaaccauguuuuuaggaaacuguagagcugagacugauaggagcacagaacacuccagggcucaccaugugcccaacagaacaaagaacucuuaaacaagaggggauggucuccuuugugagauaguaagauuccugucauuaaaaguauucaaauccaggucucagguagccaauaauguaaaaacuguuauggguaugcguaaaucuaacaagguggauuguacaguaccaguaaaaacaguuaaaacaauauaaagaauauuauacuuuuguaccugaacuucaccaaggugauccagcugcucuugcaucugguuccugguaacaguuacaucguauucuaacuuaucauauucucuccaugcucguuccaauuccuaaaaccaaaaaguguuaauuacuuuaauggggaaaaugugcuuuuaugguguuaucacuccaauuguaacuuucuagauuuuagaaagucauauaguuuauacuuagcaaaacaggaauuuuuauaaccauuuuugucccuuuuuaaaacucaauucaacaaaaauuuacuaagcaaccuaaguauuauugugcugcuguuuauuuccuaaaauguagaagaggcauaaauaaagcauuuucuuaucugucuucauuaaaaguucuccaugaauggaaauaguuuguauuuuagcauauuggaauuucaauaacaucagaggcuugacaugacuuuacuuacaauaagcuuauaguaauacaauaaaacaaaugaauuuagcuagcuauuuaaacaauucagugaauccuguuugugaggacucaauauagacacuauuauccaucuguacuuuucuccuuuggaaaaaaaaucacccccaaaccaauaauaucacagagaagauuuugauguuuggucuuuaacagcuugucauuuguugaauauagaauaauucuagaggugcuuaaaaauacaucaucugccagacgcaguggcucacaucuguaaucucagcacuuugggaggcugacgggggcagaucacuugagcucagcaguuugagaccacccuggccaacauggugaaacccugucucuacugaaaacacaaaaauuagcugggcccgaugacuugugccugugguccuagcuacuuggaagccuguggagggagaaucgcuugaaccuaggaagcagagguugcagugagccgagauugcgccucaggaggcugaggcaggcagaucacgaggucaggaguuugaaacuaccugaccaacguaaccaaacccugucucuacuaaaaauacaaaaaaaaaaaaaaaaaaaauuagccaggcgcaguggcaggcgccuguaaucccagcugcuuaggaggcugaggcaggagaaucgcuugaaccugggaggcggagguugcagugagccgagauugcaccauugcacuccacccugggugacagugcgagacuccgacucaaaaaaaaaaauaaauaaaguaaaagaaaaaaaauaaagagcuaucuuauuuuguauauucuguaacuaacuuaaaauaacuuuagaaaauuuaggugauuggcuggguguggugguucucgccuauaaucccagcacuuuaggaggcugaggcagguggaucacuugagcccaggagcucgagaccagccugggcaacauagagagaccccaucucuacgaaaaaauacaaaaauucucugggugcgguggcgcuugccuguggucccagcuacucggggcagggcugaggugggaggauugcuugagcccagaggcggagguugcagugagccaaaauugugcuacugcacuccagccugggugacagaugaccaugucuccaaaaagaaaaaaaaaaaaacaaaaaacugaagcuaucuugccagucuuuuuuuuuuuuuuuuuuuucauaaaaaaaaaaucuuaggugaagaaaaauuauucaaaauguacugggaaaacagaugugugccaucaccccuaugcccggcuaauauuuugugugugugugcguauacagagauauauauauauauauauauauauauauauauauauauauuuuuuuuuuuugugaagacaggauuuugccauguugcccagguugcucucuaacugcuggucucaagugauuccaccagccuuggccucucauagugcugagauuacaggugugagccaccacaucuagucagcaaauucuuuuuacaugaauaaauaugaaaauuaauuuccuuuaacaaaaauuaauucuagccaugguuuaauuugugugcaccacaaaaacugcaaauagugggucuuugauggcuuuagggagaguaaauuaagacaacagauccaaugacagcccaguggcuaagaggguauuacaggcuaacaccuaagcucccuuguggaaaugcagaguucaggguaggcuuaacugcacugcagaggcauuuaaguauaagaacauuucaggaugguaggaauccuucucuuucuuaaagaaacauuaaaaauacagauugagagcuagacauuccuuuaucaguauuuuagaagugaagaggcacaguauacuuucaauuuuccuaaccuggagaguccugccacugaacuggcccaaguccuguaauccugcuaggccuaccuguuucugucuuuacuucagcuccucaaacaugauuaccagguggguaggaacacaagacaacagaggacagcgaggaaaggacagcaauggcacaacacauuuccucccaacaucuggcuggguauuucauuaaagaauuuacuagauuauaugaguaccaugcuaauaaucuuuaaauaugaccuuacguauuuguggucaagaagcuaauauagcaagauaauuuacaagggcuaauacuuuucaaauauacaauuaccuuaaaaucucaaguacuugccacaaaauagugcuuucaauaaaaaguagagaaugccaggcuauacaguuaaaagaauaaaugaaggccaggugcgguggcucacgccuguaaucucagcacucugggaggcugaggcagggggaucacgaggucaggaguuuaagaccagccuggucaacauagugaaacccugucucuacuaaaaauacaaaaaaauuaucugggcuugguggugggugccuguagucccagcuacuugggaggccgagacaggagaauugcuugaaccugggggguggagguugcagugagccgagauggugucacugcacuccagcucgggcgacagugcgagacuccaucucaaaaaaaaaaaaaaaagagaaugaaugaacucuuuuuugagauggagccuuaugcuguugccuaggcuggagugcaguggcaugaccuuggcucacugcaaccucugccucccggguucaagugauucuucugcaucgaccucccgaguagcugggauacuugggacuacaggugcgcaccaccacgcuuggauaauuuuuuuuuauuuuuaguagagacgugguuucaucguguuagccaggauggucuuaaucuccugaccucaugauccgccugccucagccucccaaagugcugggauuacacccaugagccacccgcggcuggccuucuuuuuuuugagauggaguuucacucuuguugcccaggcuggaguguaacggugcgaucucagcucaucgcaaccucugccuccuggguucaagcgauucgccugccucaggcucccgaguaguugggauuacaggcaugcgccaccauguccggcuaauuuuuguauuuuuaguagagacgggguuucuccauguuggucaggcuggucuugaacuccugaccucaggugaucugcccgccugaauggauucuuucaaucuggaacuauauggaugaaccucguaaguuaaaggaagccaggcaaagaguauaugguuacacuucacauaaaguucaagacugagugcaguggcucaugccuguaaucccagcaguuuaggaggccgagauggacggaucgcuugagcccaggaaucugagaccagccugggcaacauggugaaaucccaucucugcaaaguauacagaaauuagguaugguggcgcaugucuguagucccagcuacuugggaggcugaggugagaggaucgcuugagcgaggugcagguugcagugagcugagauugugccauuguacuccagccuguguaagagacuuugucuccaaaaaacaaguucaaaaauaggcaaaacucaccuauaguuuaaaugucaggugcuaggcuauagcuacucaggagacugggcagggggaggaucacuugaggcuaagaguuggaggcuguggugugcuaugacugcaccugugaauagccacugcacucccaucugggcaauguagcaauacccugucucuaaaacaauuuuaaaaaguuaaaggaaaagaaagaagaaaaaagucuggcaguguuccuuuugggagaggagcuucugguaugcuaguaaaauucaaugucuugauauagauauuggcuaaacuccuaaacugugugcuuuucugagaacauguuauauuccaagaaaagaaaaaaauagugugcauguugggcaggaggagggauugcugcagaguuuucuagagacaggguuuugcucugcugcccaggcuagaaggcaguggcaugaucauaauucacugcagccuugaacuccugggcucaagcgauccuccugccucagucucccaaguagcuaggacuacagguuugcaccaccauguccagauaauuuuuuaauuugggguuucaccauguugcucaggcuggucuugaacuccugggcucaagcaaucuuuccaaagaacugggauuacaggugugagccucugugccaggccagacuuuucuuacucugucaccugggcuggagugcaguggugugaucucagcucacugcagccucaacuccccaggcucaagcaauccucccaccuuggccuccugaguaguacaggugcacaccaccaugcuggggcauuguuuuuuaaucuucuguaaacuugaggucucacuauguuguccaggcugguccugaacuccuaggcuaaagcaauucuccugccucagccucccaaagugcugggauuacacauaggagccagcaggcccggccaagauuuuuuuuaaaaaaauugucuaaguuuaggguauggaacaaguaaauuuuaauagugcuuacuucuauguagucuguacugagacaagacuuggccacugugcgggggagaaagugaagcaggaauguaaugaaauuccagauuuccaaaaaaaucaguuaaggauuuuaauauuuagcuagacggcuauauagcagauauauacuauguccuuuauuaagaaaggauuaauggccgggcaugguggcuuacgccuguaaucccagcaguuugggaggcugaggugggagaaaucuccugagcucaggaacucaagaccagccugggcaacauagggagaucucaucucuacaaaaaaauucuauuuaaaaaaaaaucaaaaccaaugaugcauuuccaaguuuuuaauaugaggaaaacuuuccuuuucuuaucuaaaaucaauggcaauuuacaacaaaaucuacucaagggaaugguuacacaauacacuagacacaaaucucaaauuguuuucucuguauuuugcugucacauugccucuuuuuaaaauaaucaaguaaauauuguaagacuacagguggcuauaguuuaaaaaaaagcaaauaauuacuauuauucuuagagcuaauaaacuguuuuacuucugguuugcuucucaauuaggguuucuaaguuuuaauuuaagaaaugucaauucauuuuucugcuuuucauuaaaaaauaaaaccuacaacuuuggaaaaguauugacauagguuuuuaauaucaaaaugagggagaggcaauagauguaguguaauuauucauuaacuuccuaauuuaaacucaaacaucucuuuccaaauuuaaguaauauuacaaauuaaugcccaccacuauaucuuggaaaaucaaagccuuaugauauuuaaauuaauuuuacugguauauuucgaggaucaggcaaaaaaauuaaaauguuaauuuuuggucacuaauacuccaccauaacaguccugccaacugguauuagaagcaguugauuuuucaggucaaucaaaagaaacuuaugucugauuuauucauuuuuucauuuuaccuucaggauguagagauuuccuggcucacauuugaagaaugugcuuaauuauuuaaggaguuuuuuaaaaaauaauuuuuuuuuacgaauuuauacuugucauguaacugcuucucaaauaaaaucacuacuuauuaagcacauggcaugccucauuacacuaucuaaugacuacacuggcuuuuuuuaaccuaaaaagauguuuacguuuuauuauuauuuuuucacuuagccucgacuugaaacacacuaaaaaagauguuuaaaagggcaccaacucaaacuguauaaagugaggcucaacuaucagccacaauuauaaagcuauccauauuuuaaauuucuaguuuaugaccacaauuguagucauucuauguuuuagcuauuuguaauuguuaacucccauguuuaguuucuucucuaauguuuucaaugaaacaaaacuaacuucucaucucaaagaaagugcuugcuuuuuauuguuaaaaauucuagauauaauaaaaauagaaaggcuagcacacaggggaagauuuaaauaaauaacuauuacugcgccacacuucuguuggcuuuuuuguggauuuucuuuuguuuuguuuuuugaaacagggucucacuuuguuguccgggaccucucugggcucaggucauccugcugccucagccuccugaguaguuggcacuccaggcacacgccacugcgcucggcuaguuuuuuuuguuuuuugcuuuuuuuuuuguagagauggaguuucaccauauugcuuagguuggucccaaacuccugggcucaaguaaucugccuaccucagccucccaaagugcuaggauuacaaguaugagccaccacaccagccuggggaaaucaaaaguugguucuuugaaaacaaaaacaagauugacagacuguuagcuagaauaauaaagaaaaaaagaagauccaaauaagcacaaugagaagcaacaaagaugacauuacaauggaucccacagacauacaaaggauucuuagagacaauuacgaacaccacuaugcacacaaacuagaaaaucuagaugaaauagauaaauuccuggaaauauacaaucucccaagauugaaucaggaagaaacugaaacacuuaacagaccaauauugaguucugaaauugaaucuguaauaaaaaaccugccaaacaaaaaaaggcacggaucagauggauucacagccgauuucuaccagacauacaaagagcugguauuaauucuacugaaacuauuccaaaaaaauaaggaggagggucuccucuuuaacucauucuaugaagccaacaucacccucauaccaaaacuugguaaagacacaaagaagaaagaaaacaaaggccaauaucccugaugaacauagaugcaaaaauccucaacaagauacaagcaagccaaauucaguggcauaucaaaaaguuaauucaccaugauaaaauaggcuucauuucuaagaugcaagauugguucaacauauacaaaucacaaaugugagucaccacauaaacagaauaaaaaacaaaaaacauaugaucaucucaguagacauggaaaaggcuuuugauaaaaucuagcaucucuucaugauaaaaacccuuacgaaauaaauccauauugaaggaauaugcccuaaaauaguaaaggccaucuaugacaaauauacagccaacaucauacugagaugggcaaaaacuggcagcauuucccuugagaacuggaaaaagacaaggaugcccacucucaccacuccuauucaacauaguacuggaaguccuagucagagcaaucaggcaagaggaagaaauaaaaugcauccaaauaggaaaagaagucaaauuaccucucuucacggacaaugugaccuauaccuagaaaacccuaaagacccuaucaaaaggcuccuacaacugauaaaugacuucaggaaaguuucaggacacaaaaucaauguacaaaaaucacuggcauuucuauacaccaauaauguucaagcugagagccaaaucaagaaugcaauuccauuuacaauacacacacacacacacacacacacacacacacacacacacuccuaggaaagcaucuaaccaaggaggugaaagaugucuauaggaagaacuacaaaacacuguugaaagaaaucauagaugacacaaaccaauggaaaaacauuccauguucauggauuagaagaaucaauauuguuaaaauggucauacugcccaaagcaaucuacagauucaaugucauuucuaucaaacuaccaucauuuuucacagaacuagaaaacaaauucuuaaauucauauugaaccaagaguccaaacagauaaagcaauccuaaacaaaaacaaagccagaggcauuacacuaccugacuucaaacuauacuauaaggcuacagacuaaaacuucaugguacuaguacaaaaacagacgcagaccaagggaacagaauauaaaacccagcaguuaagccauacaccuauggccaucugauauuugaucaaauugacaaaaauaagcaauguggaaagggcuucuuauucaauaaauggugcuggaauagcuggcuagccauaugcagaagaaugaaacugacccguuacuuucaccauauacaaaaauuaacucaagguggauuaaagauuuaagugucaggccucaaacuauaagaauccuuuagccaggcaugguggcucacgccuguaaucccaguauuaugggagaccaaagugggcagaucacaugaggcuuggaguucaagaccagccuggccaacauggugaaacccugucucuacuaaaaauacaaaaaguagccaggcuugguagcgggcauuuacaaucccagcuacuugggaggcugaggcacaagaacugcuugaacuuggaagguggagguugcagugagcaaagaucgcgccacugcacucuagccugggcaacagagugagucucugucucagaaaaaaaaaaaaaaaagaaaaaagaaaaaaguaauagcaacaaaaacaaaaacugacaagugggagcuaauuaaagagcuucuguaaagcaaaagaaacuaucaauggaguaaacagccuacagaaugagagaaaauacucgcaaacuacccauccgacaaagguugaauauccagaaucuauaaggagcuuaagcaauugaacgaggaaaaaacaaaacaaauaacccuuuuaaaaaaugggcaaaagacaugaacagacacuuaaaggaagacauacaaguggccaauaagcauauaaaaaaaugcuccauaucacuaaucaucagagaaauacaaauuaaaaucacaaugagauaccaucucacauucaucagaauggcuacuauuaaaaaguaaaaaaaaaaaaaaaaacaaaaacagaugcuggcaagacugcagagaaaaggaaaugcuuauacacagugaguggagauauaaauuaguucagccacuauggacagcaguuuggagauuucucaaagaacuuaaaucagaacuaccauuugaccaagcaauugcauugacuggguauauauccaaaaguauauccaaaagaaagcaaaucuuucuaccaaacauacacaugcacuugcauguucaccacagaacuauuuacaauagcaaagacauggaaccaaccuagaugcccaucaaugguggacuggauaaagaaaaugugguacauauauaccacgguacuacacaaccauaacaaagaaugaaaucauguccuuugcagcaucauggaugcagccauaggccauuauccuaaguaaauuaaugcaggaaaagaaaaccaaauaccguauguucucacuuacagguggaagcuaaacacugguacucguggacauaaagaugguaacagugaaacuggggacuacuguggguggggaaagaauggaagauaaagguugaaaucgaguacuaugcuagguaccugggugaugggcucauucauacuccaaaccucagcaucacacaauagacccaguuaacaaaccuacacauguacccccaaaccuaaaauaaaauaaaaauaaauaaaaaguauagggaacacugcuuuacaugcuucccuugugcuaauccuaguuuuguguacuuuuguggccuaccaggugaggagaagauguuuucagaaucacagcuuugaucuacagaggugcuaauguuauaccccuuaugcuuggggcuuagauuugaacuagugcuaugaacugacugugaaagauucagugaaauccuuugagauucugccagcaaaaauguaauucaaauuuaaaucuaaucaacauucacugagugccaaccauaugcccaguaugauguuaugcacaugcuaacauuugcagccuuaagcuacaaauauaaauaaguuuacauaaaggcacaaauaacauaguuuguauucuaugcaauaagacuugucuuagaagaauauauucugaggguuugucauaaccacugauuauuguugaaggcaaggaaaaagaaaccaggaaagugauuacauaagacaaaaaccagaaaaagggauacucaaacaagaucaaauuuuauuuuauucuauuuuauuuauuuuauuuuauuuuauuuauuuuauuuuuuugagacagaguuucacucuuguugcccaggccggagugcaauggcgugaucucggcuuaccgcaaccucagccucccggguucaagcgauucuccugucucagccuccugaguagcugggauuacaggcaugcgccaccaugccuggcuaauuuuguauuuuuaguagaggugggguuucuccauguuggucaggcugguuugaacuccuggccgcaggugaucugccugccuuggccucccaaagugcuaagauuacaggcuugagccaccgcaccugccuggccuauuuucuauuuauuauuacuauuuuuuuuuuuuugagacagagucucgcucugucgcccaggcuggagugcaauggcacgaucucggcucacugcaaccaccgccucccggguucaagcaauucuccugccucagccuccugaguagcugggauuacaggcaucugcccccacaccuggcuaauuuuuguauuuuuauuagaggcgggguuucaccgugucagccagucuggucucgaacuccugaccuugugauccgcccgucucggccucccaaagugcugggauuacaggcgugagccaccaugccuggccuucuauuauuaacgauuuuguuuuagagacaguguaucacucuaucacccaggcuggagugcaguggcacaaucacacaaccuugaccuccugggcucaagagauccucccaccucagucuccuaaguagcuaggaucacagguguacaccaccaugcccagcuacuuuuuuguuucuuguagagauagggucucccuaaauugcccaguuuggucucaaacuccugggcccaagcaauccuccugccucagccuuccaaaguacugagauuacaggcgugagccagcacuccuggcaaaauucauuucuauuaagauauuuuuaacaaauuucccaucugggcuaaaguuaaccuugagaugcagcaaauucuaaaccuacugaugagauuuaauuuauuaaucccaguugauaaggaaagggauucccuaaaaucggaauuucaagagcagauaccaaaucauuaaauaguuuccaacuaaaugucuguagagccuaccauuuugauuugacucaaguugucacagagacccugagcuucucauuagcuuggcauugacaguuuaaccccauuuucccuuucuaaucucacauuuucuauccucucacaggaauccucuaucccagucaggcuguuaguucuauuuccuccuuuuccaaacaugucuccuauguucucaucuuugcuguggcuuaggguguuuuguauuauuugaauaaaccacucuucacuucucuucucauuguauccaaauccuaccuauccuugauuagcucaguacuacuuccuuguagacaguauuucaggugcuuauauuuucuuuaugacuauauuacagaaauccauguagaucuaaaucuucagaaaugugguaagaagaucuggauuugaguuuuagguauauuauuuauuagcuuuguaaccuuggguaagucauucagcucaaucauucauccaaugugaaugagacauaguuucuuauuucaagauacucacaauggaaaggauauuaaauuucaaaaaagucuacaaacaugacaauauaauuaagacucaaaugagacaacagaaauaacaguauuuuaaaaauggaaauagaaauguaagguauuuaagaauuccucaaacuaaguuuucagugauuuuaaaaucaugguauauuccuuuaaaaauggcucacguuuggaauucaggguucagaauagaagccaaguugagauucugggaucuugccagccuggaaagacuccucuaaauuaagcuauacugucuguggcccuucuuaaaagauagcugcucccuagcccauugaagguacagacaaggguuugggagcaguuuuauauaacauggcaguuuuuccuaagauuucucuuucaaagagcugcuuagacuggugcucuuacuauguuuauagagaugaccacaucauaggaccuaaagccagcuguuuaaacucauaaaacaguuuauaagcugcaaguuaagacuuuuagauuugguaauuccaagagacucacagucauaguuauaugacuaugaguuacacgguucuguuacguacauuucuuucuuuuuuuuuuuuuuuuugaaacagagucucacucuguugcccaggcuggagugcaauggcaugaucuuggcucacugcaaccucugccuccuagguucaagcaauucucgugccucagccucccaaguagcuaggauuacaggcaccugccaccacacccagcuaauuuuuguauuuugguagagacgagguuucaccauguuggccaggcuagucucaaacuccugaccucaagugauccaccugccucggccucccaaaguccugggauuacggugucagccaccgcacccagccuugcuauuuauauuucuauugauugauugauugagacagaguuucagucuuguugcccaggcuggaacguaauggcgcgaucucagcucacugcaaccucugccucccgggcucagaugauucuccugccucauuacaggugcaugccaccacaccuggcuaauuuuguauuuuuaguagagauggguuuucaccaugcuggucaggcuggucuugaacuccugacuucaggugauccacccaccuuggccucccaaagugcuaguauuacaggagugagccaccacauccagacuacuuauuuucuuaaugcaauaaacaggaguacucaucuccccuguaaaacacucauuucacaaaggacaaaauguuuggcugggugugguggcuuacaccuguaaucgcagcacuuuggcaggccaagccaggagaaucacuugagaccaggaguuugagaccagucugggcaacauagugaggccccauuucuaugaaaaaaaaaaaaaaaaaaaaaaaaaaucuagccagguguaguagugccagccuguagucccagcuacuugggaggcugaagcacucacuugaguccaagagauucaggcuacaagugaguuauagucaaaauacuguacuccagccugggugacagagugagaccuugucucauaaguaaauaacagaaugcccacuaauuaaauaaucuuuuaauuuuauguuccuaaacagaagcacacuaauaacaaauuaauauuuucugcuauaauaauauagaagaauccuaaagagagcccaguauuaaaaaaaagagaagaaaauagaacuacauauuuaagcuacuuuuauuaggggaaaaaaaaaaucuacuuacggcaguggcucgagaaaguucucgacacguacuaagcaguccauuuuguaaaucaucccuuuguaacaccacugucugaauggcugcuggguuaucugcaugcauuucuaucucuuggcuggcugauagcaaagcuugcucaagcguguacuauuaugauaaaaagaauuacacuuaauguucugcaucauuguauuaauucuuuuuacuuaucaguguccugauaauaaucauauuaaguaacaucaauuguagacaauaaacauaauuguccuacuuucuccuuguggaguugcugaaguuucucuuccagagcaugcaccacuuuaucuuguucacauaaucggcuuaacuuggccuagguuauaagagaagaugucuuguuagcaauuuuuuauuuuuucuguaauuggagguaggcagucauuauaugaccaaaaaucuauauuucaaucaauaaaaguuaaaauauagcuuacaaagauagaauccuuaaaaaauaggcaugcaagcauuuugccucuacaaucugcuaaauagguuaagugauaauaugcaguccuuaauuaaaaugcuuacuggauucuauuguuauauguuuaaaaaacacacucuuagauucuuagaaaauaauauaaacaauagaucacuucuaauugaaauacaaauaaaaauauuauuaauggagaaaaauaacuuucaucaggguuuuaguguuuaaauucuuaauauuacccuaauuucuuaauuaugaaaguacaagaaaguauucuaauaaaauuucaauaguacaauaaaccaguuuuaauguuucaaaaugaaaacacuggacaaauuggaaauauguccccaacuuuauggcauaaugacacauaagcaagaaauuugagacuuuacuuucuuugccauuuaucuauuaaaauaacuaccuuaucuuugucagacaacaagacucagccuacacaaaaugaaagguguuaaaaagaaaaaguagggggcugggcucgguggcucacccccguaucucugcacuuugggaggccaagguggguggaugaccugaggucaggaggucgagaccagccuggcuaacauggcaaaacccugucuacuaaaaaaaaaaaaaaauacaaaaaguuagcugggcaugguggcaugcucccgugaucccagcuauuugggugucugaggcauaagaaucacuugaacccgggagguggagguugcagugaguugagaucaugacacugcacuccaacccgggugacagagagagacccugacucaaaaaaaaaaaaaaaaaaaaagaaaagaaaagaaaagaaaagaaaaggggguauaaugagugaagaauguauggcaaaucagcaaucuaaaauaugauuuaaaagaaacuaaauuuaaaaaggaguagugauaaaauuucuaaaggccgaacuuuaucugaaaaacacagcaauucgucuccagucucuagucuuccauaacuuuuuuuuuuuuuugaggcagggucucacgccauaacccaggcuagagugcaguggaaugaucuuggcucacugcaccugucccuccuggguucaagagauucucaggccucagacucccgaguagcugggauuacaagcguguaccaccaugcccagcuaauuuuuguauuuuuaguagagacagggucuugcuauguugcccaggcuggucucaaacuccuggccucaacugauccgcccgccucggcuucccaaagugcugggauuaaaggugugggccaccguguccagccaaucuguaacuucuaaaaaucagaaacaguuuuuacuuucauuuaagugaugcuuaauaacguuggacugcuaacaauagggagcagugggacguagagggcagggaauaauaauuuagagcacacacauaaaauaugaauuuaccugaugucacuuuggaggacuugggagaaagaaguuuuuuggucaugcuuauuuccaguguuuuuggcggagaauacgacagaguacugaccacauauaucauacuaauacuuacaucaauaucuacuucuucaggucuguauuuguauaaugugccucuaccuucaucuugugacagcuauaagaaaaaaaucauauagcaacuuaaaaaaucuuauuuaaaaauauauuuacccuauuaauuaauacuuuggauuuauauuaaauauauauaacauaacaaaaauagauuuuaaugauucuuacacuuuuagaaguuuaauucaaacacugaucaacaaaguagaaaauacuuaacagugauauaauaugcaagauacauacgaacgauguauguaacaagcuuguuaaacauaauaauaugcuggucaaacaaaacuaauacaguaucuuacaucauuucuuuuaaagacacacauuauuuuaauaaaaaaacugacaaauacaaucguagcaacugugucaaaucaaauacuuaaauuaagcauaguucaacagccaaaaccauccuucacgguauauacauaaacacacacuguguauguguacacucaaaugucaacacaucuuaacaaaaccuauaacauauuguauacauauauauaauauauaaacacacauacacaauauagacuuaucuugcucuucugucuuaagaacuaaaagauaaugaaggaaaaggauggguuuaauugaaaagaggaaaaucauucgaaaucuuauaaaacugaaagccuauguuauaaacuauggauagucaaauuucauaaaaaguuuauguguguuaguugacuccauuuauguuacuauauuguaaggaauuauucaguguacuuaaauauccuuucuucagcuucugcccaguacauuuugguuaaaagauauuuugguuacuucugauugugcuuagcaagauuucaauagccaucccagucaguuauaccacagauaacaucacagccucugcaggcaauacuucacuauuuuucuugucuuuugauuuuuauauugacugugagaaaauaacaaaaacacaguagaaaaaauuuaaauggggcucauugcauguuuacuaaauggcacaauguuuucaaggugggguuagaaguaaugugucccaauuacauuccaguuuaaaaaauuaaauuucauauacgcauaauacauaagaauguauaaaugacaauucuauauguuuucucuaugaaagaaacugcuugacaguuacagcuuuaaaaggaagcaucauuuaaacaggagauaacuuugaauugaucuagaaaugugggaaucaggagaagguuaaaaauauaagcauuccaaacauacaauaaauccuggauuuauauuucauuucaagacauuacuuucacauaccucaugcaaaugaaucugugacuauuuaaggguaugcagugauuguuaaaccacaaaacuuucauaggaaugaauauuacaugaaaaaugaauuuaaugacaaaaguuagaauacucuuauacuauucaaaauaaguauccucagguguguccugagaagugucaacugucauuguaaauuaaagcaccuagauccaagaaaauaauuuauauuccuaucuggaaaaaaaguaauaugaaguaaguuuuaaauagguagaucuaugauaaaaaaaguaagacaaugccaaaauuccauuuucauauuuauaacaaauuaaagaugaaaagucauaagcuacuaagauguucaaauauaguuugcuuaauauuuauuuauuuuuugagauggagucucguuauugcccagccuggagugcaguggugcgaucucggcucauugcaaccucugccuccaggguucaagugauucuuuugccucagccuccagaguagcugggauuauacgugcaccaucaugccuggcugauuuuuguauuuuuaauagagacgggguuucaccauguuggccaggcuggucuggaacuccugaccucaagugauccucccaucuuggccucccaaagugcugggauuauaggcgugagccaccacgcccagccguaguuugcuuaauauuuaaaguuaaaugcaaaacagcuuuacuagauuacagaaucugaauauaacuagcagacaguguuucaucuagauuaaaauaucaaauguacccuauaucucagagucaacagaaaaaaacauuaguauauuaaagugaaaacuuacuaauuuauaguaaaucuuuaggauauugauauacuauuuuuauuuggggaaucuuauugcagauuuauuuuuacaucaguuagcauaucauaauagagaaaaaugucuacuguaguuacaacuuuagagcgauauauccuuuauagccauauaaauauauuauacauaucaaucagauuuuugugguauuucuacuuuuaguaccaccgaaauuuuucuugaaaucuuuuaucaaguuauucaauaaagauauucauuagacaucaacuaaccaaauccuuaaaccucuccccacacauugcuuuuaugacagaauaaaagcauaagaaaacaaaauuuuuccuuaaacaaacaaaaaacgccuucauagaauugaaaagguugcuauuuuguccucaacaugaaaauccugacuccucaucccaaccccuggcccuaccgaaaaaaaagaaaaguaaauuucaugagcauucugguuaauuuaaguucaugguaacacuguuuaucauuuuuuucaaauacaccuuuagccaaaaaaaaaaaaaaaaaaaaaaaagguuugguuugaauacuucauucgaaguaccuuagcaacacuagaaaagcaaaugaaaaaaugggcuauguaguaauuacauaaacuugugcagugcuccaacuucagguugaggaguguguuauauggauuuuauuaacuacauaaggacauguguuauauuuuauuuaggaugucggaaccauuuaaaguaucugauacuuuuuuuuuuuauaaacugucuuggcauuaaaacaaaguuacauauguuaauuaaaauucaacuucaauaucccuuagguauguggacuauauauauuuuagaguauaugaacaugauacauaaacuccaaaaaggaguuuuggggaaauauuuuaaaauuugauaaaauuagacauuauauccacagauggcaaaaaaaaugcucauaggacuauaggcauuuguugauauugcaucuuuuaggacaaauuacuuaucaggugauuaauuucacugguauuaaucauguuauaaaaacuaugguccuaaaauguaacugugaaaggugguguagaauacagaaugcuuaaaaaaaaaaaaaaagagauaguaucucauucugucacccaccaggcuagagcacagugguguaaucguaaucacaguucauugcagcuucggacuccugucucagccuccugaguagcuaggacuauaggugugugccaccaugccuggcuaauuuuuuuauauuuugcagagacagggucuugcuuuguugcccaggcuagucucaaacuccuggccucaagcgauccuucagcuuuggccucauaaauuguugggauuacaggcauaagccaccucgacaagccuggauucaguuuuaagucuuuuuuaauugaccaauuuuaagaaaauuacugccuagguaauuucuugaguguucuccaaggaagaaaaaugcaaacauuuccaaaaacugaguggcuaugauucagaauaaaauagguuauaaaacauuuugccauuguauuucuagcuaaauaucaauaacuuauuaauaaaacacugucauucaacuucagaaaagcaaacuguagcaguacauuuucccuggauaauaacaugaugagggaaaccuggagaaaaauaaaauauaauuucaguuugugcaaauuuauaaacacaguuuaaaaaaugugucgggcugucacuuuaaucuauuaaggaugcccugcuuaauaauuaaguccuuuacuaguggcugaauaaaaauaagacagucugaagacucccuagccuuaacagcacugagaguuaacacugauuuccugguaacuggugacucagccaugcccaggcaaggcugcugacauuagacauucagaucuuucuguucuauacaauuuuaguuuucuuucacauauuaauauaaagaaauauuuauacaaaucuauugcucuuucgguauucaaggucagugaugcuauaaugugccagucucagacaucuucacuuuccccccccucagcccuucccauuucagaucuccacacuuugggaaaaccccaauuagaacuuuuaaugcaaccaaauaauuuaaacuaucagacuuccgcauccugaaccaugaauguugagcauuauaaaaaaaaacccaaccaaaccaaacagauuugaaauccaggcuaccauucucaucuaaaauaugcaaaaugugauaaaaacauaaccuauuacaacaaaaucccuuugaucucaugucaauuuagcaucuuauagaugauauauuuuacugacagcuucagacacugcagaagguaucaguuuuggaauaauacuuauucggaauaauacuuauuccaaauacucucggugugguacuuuggaauagaguaccaaggucuauaaucuggugacuuuaagaauugaaagauuccauuuucuuuugauaaguaaagcuguuuaacuuuaaauauuuaauaguuuguuaaucucuuuauugcaaauuugagacuauuuucagucaucuaauaauauacuuuaaauauuuugaaaacugugcugaaauauaagucacccucugaucaauuguauccauuccucaguuacauggcccugugaugcagaucccauggcaacugaaccaaauagaggccuuaaaagccagcaugagcucaaagucguucuuuuuacuaggugccuuauauauuuaaaucaaaauauauauucauuuuucauguuaguuaauuuucuucuucugcaugauuuuuaaagauuguaaaggucauacgccagaguaauuugaggguguugaagugaaagaagcugauguugagaaacacauagcuagaaacauuuagaccaugagauacacaaaaauuugauagaaacauaugacuucuuuugcagaucugcagauuacuaagguuccuaaguuaaagccagccaacuccaugacacacauuuugaauaaggaaaaacaauaggguaacuuaugauagucuugacgacugcuugagaaugguaagaauacagcgacaaaauacccccaguauguuaaaaaguggcuaucuuuaaguuuuaccauaccauaguacagaaacuagauuuaaauaacgcccauacaaauauaauguauucuuaaaacacuagguugggggaaguuguggagggcaaccccugaaaguaaauauuuuuacaaagccuuuucccuaaaaaauagguauaaugcuuuuaaaguuaauaaaaccauaugaaaaucuaguaauuuugcaaauguacugcagaccuccaaguacauaucaaucaaauacucugcacaaaaacuuuaggaaaauggcacauuuaauauucaacagcaaaauguucagcgaagccaugcuaagaauacugcagcaucuugaaaagcauggaugaauugugguuuuccaaauaaacauaaacaaaaaauaaaauaagaaaaacacugaugucaugaguaaaucugagaauaaaucaaaacugucacugagggauuuugcagaugauaaagcaguaucauucacuguccaagaccuuacuugcugguacaguuggggucuuagcgccgaguucucaaucauugugugaaccauggugauaauagguucauuuucuuucaucuauuucaaaucaggaggagcauacagcaaacaucaguuuacagcauagcuagauuugaaagacgacacuguaaauauagccucuacuuuaauaucuuccuaauagugcaguuguuuacauuuuaccccaugguuguacagauuuaauucauauaaaccauuucaaacaaguauuaaacgcugugaaauacuuccaagaaaaaacuacuaauugcaacacugucacaacuaguuuuacuucauacauauaaucaugauauagucaauuaaugaauauuucuacauauaauaaaauagaugauaaaucauaauucaaaggguaaacuaaagggugagaaccuacacaaucaggagaaaaaugguacaauuugauuaugaauucaguaauaaagcugaaaaugauauucaguucuguguaagguuauaaaaaauuaguucucuacaaguauuaaaauauaauauacugaaugugucacuuaaucacauauuuuauuaaagguaaucuugacauuuauagagacucuauuuuggauuuucucacaguauaauaccacauguagaauuacucaaggauaugcaaacuaagacuuauucagcaaagacuugguaugucuccuuagcuucuaaaaagguagucugaaaccaagcuuaacauuuccagcuauguuguacuuaauuacugccucuagaaaaauauuuguuuuagcaggcucuguacuugaguuaaagcacucaaaagaccaucaugauguauauaguaaaaggccaagaaagcuuuaccauuuguaagucgacaggucuguuuauaaugguaauuuguaacgcuuaauuuucaucuuucauauacagaaaauaagcauuucuaucgugguugacaaaugcuacuuuacugguucagcuaagucuacaacaaaaguucauuaaucucaaaauuaauaaauuuauuaauauaauguaagaaaaaacuaaaucuuaaaacucuuuuucuagacaauuauauuuucagucuaauugccaauaaaauuuguuuaguuaucaaauuagaaaccuccugugacugguuuaaucuacuuuuuagucaguuaagugauaaugaaacacauguuugucuuuuaacaauaucccaauuaaaaauuucauucagacuagaccauuuauuuuuaaaucucugugccuacaacugcuuuuuggaagugaggauauuaaaaaaaaaacuucacugaagaauaaauugacaaauuuuaguuauacaucaacgacuuuugacaaaaguauucacauauguaacaaucaaaacauacagaauguuuccaucuacccagguaguucccucauguuacuuuaccaccaaccugauuaauuaauaaauuaauuuugucaaacuuaauaauuacauguaaagguauuuggaacaacacaucaguuaaacaaaaaauucuuaaguguuacggugaucuguugcccagauuggaaugcaguggcccuaucauggcucacugcagccucaaacuccuaggcuuaggcgauccucccacaucagccucucgcauagcuaggacuacaggcacaugccaccaugcccagcuaauuuuuuauuuuuuguagagacaggggccucauuauguugcccaggcuggucuugaacuccugggcucaagcaauccuccuggcucauccuuuauaauuguuuugggggagccaggaaccucgcucauaagagaugaugaaaucgauaaagguuguguguucuguuucacugaccagccguuaucccaucucucuuccuuuccuugggccugccuauuccucgagacacaacaauauugaaaucaggccaauuaauaacccuacaauggcuucuaacagugcaagugaaaggaagacuugcaugcuuaucacuuuaaaucaaaagcuagaaaugauuaagguuagugaggaaggcauguggaaaagcugagacaggccgaaaacuagaccucuugugguaaacauuuacccaaguugagaaggcaaagaaacaaguuguugaaagaaauuauaagugcuacuccagucaacauacaaaugauaagaaagcaaaacagccuugcugcuaauagggagaaaguuuuaguggucugaagagaagaucaaacagucacaacauucccuuaagccaaagccuauuccagagcaaggcccuaacucucuucaauccuaugaagguugagagagaugaggaagcugcagaaggaaacuuggaagcuggcaguuugguucaugagguuuauggaaagaagccaucuccauaacauguaagugcaaggugaagcagcaggugcugauggagaagcugcagcaaguuauucagaagaucuagcuaagauaacugaagaagguggcugaauucaaugauagauuuucaauguagacgaaauagccuuguaugggaaucagaugccaccuaggacuuucauagcuagagagggaaagucaaugccuggcuccaaagcuucaaauaggaugacacucuuguuuggggauaaugcagcugguaauucaagcugaagcugaugcucauuuacuauugugaaaauccugauguuaaaucuacuuugcuuaugcuccaaaaaaggaacaaagccuggaugauagcacaucuguuuacagcaugguuuacugaauaucuuaaauccacuguugagaacuaaugcucagaaagaaagauuccuuucaaaauaugagugcccacugacaaugaaccuaguuacccaagagcucugauggaaacauguaaguggaugaaugugguuuucacgacuguuaacauaacauccauucugcagcccauggaucaaggagucauuucaacuuucaauuacuauuauuuaggaaaugcauuucauaaggcucuagcugcuacagauagugauucuucugauggauaugggugaauuaaagaagaaacuucuggaaagaauucaccauucuggauacuagauauuugugauuuaagagaggaggucaaaauagcaacauuaacagaaguuugaaaacacugguuccaacucucaugaaugagguugagggguuuagaacuucaguggaggaaggaacugcagaugugguggaaauaaaaagaaucagaagugaagccugaagaugugagcgaauugcuucaaucucauacuaaaacuugaguggaugaggaacugcaucuuauggaugagcaaagaaaguaguuucuugagauaaaaucuacuccuggugaagguacugugaacauuguugacaacaaagcauuuagaauauauaaacuugguugauaaagcagcagcagaguuugagaggauucaguucaauuuuacuuuuuuuuuuuuuuuuaauuuuucgagacagaguuuugcucuguugcccagacuggagugcaguggaguaaucacagcucacugcagccuugaccuccucuccugggcucaagcgauccugccgcuucagccucccaaguagcugggacuauaggcaaguacauuuuuaauccuggcugauuaaaaauuuuuuuuuuuuuuuuugcagagacagggucuugguauguugccaaggcuggucucaaacuccuggccucaugcaagccucccaccuuauccuuccaaagugacaggcaugagacaccaugcccgaccccacuccaauucugaaagagguucuacgacgggcaauauguucucaaacaccacugcaugcuacagagaaauguuuucgugaaaagaagagucaauugauguaacaaacuucacuguugucuuauuuuaaggaacugccacagcuaucccaaccuucagcaaccaccacccugaucaguuagcaagcaucaacaucaaggcaagaccuuccacuagcaaaaagauuaggacuugcugaaggcucagaugaucauuaguguuuuuuagcaauacaggauuuuuuuucuuagacauaaugcuauugcacauuuaacagaauacaguauaaucauuacuuuuacaggcacugggaaaccaaaaaaacaaaaaaacaaaaaaccacgcccagcuaauuuuuguggagaugggguuuugccauguuucccaggcuggucuugaaguucugagcucaaagcaauccgcccgccuuggcuucccaaagugcugggauuauaggcgagagcuacugugccuagccugcauucuuuuuuuuuuuuuuuuuugagagggagucucgcucugucacacaggcuggagugcaauggcaccauuuuggcucacuucaaccucugccucccgaguucaagcaauuuuccugccucagccuucugaguagcugggauuacaggugcccaccaccacacucagcuaauuuuuguauuuuuaauagagacgggguuucaccauguuggucaggcuggucucuaacuccugaccuaagaugauucaccugccucggccucccaaagugcugggauuacaggcaugagccuggccuucaaguucuuaaaauaaauacauaaauaaauaaagaauacauauaauucacuucugguuugaauauaagaauccaagaaaccauuuuaagagugguguuaacagucuacauauuguguaaggaaucagaggaaagacuaaauaguacacguaggauguuuaaggauucacuugaaaugaguuaaaugcuuugcuucuuacuuuaauuccuucuuugaaguaacagguaauacagauuuacauuuaauugcuaaauuauaaagcuauuauaaaaggcagauuauuucauaauaauaggaaugaaaauguaugauucaggcauuacacaauuuucuuuucuuuuuaaguuaaaggguuuuauuaucaaagucuuguaaaauaauuucgaaauuguacaucaacauggcacagacuguagccuacuuuuguuuuuacugcacauaguggagcuugaaaugucuguaacaaagaaagcaguugccuaacuacuuugcauauauaacaugaaaucacugugugccuaagaauacuacugcaguaacacaaauguaucgguuuuauacaacuugagauuuuauuauuuuuuuuuuugagacagagucucacucugucgcccaggcuggagugcaguggcacgaucuaggcucacugcaaccuccaccucccggguucaaguguucuccugccucagacucccgaguagcugggauuacaggcgccuaccaguaauuuuucuauuuuuaguaaagacgggguuucaccauguuggccaggcugaucucgaucaccugaccucaggggauccgcccgccucggccucccaaaguguugggauuacaggugugagccacuacacccagauuugucuuauuuuaaaagcauaugaaggucaauuuccaacagaguuuaaaacaaauaaauuaaugaaagaguggaaaauucaaaauaagggcaagagaugaguuuuuuuuuucuuuaagauggacucaggauagguagacagcuuucacugauguagauguggaauaaauuauuucaggaaaaaaaauucccaaacaucuuaugaaaaacuauacaacucuacuucaaaauauacuauuuguucacugccaaagacaguuuuacuugaaaccuuguuucuguaauuaaacccuaauuagccaucaaaaaagguuagugcauaauaaccguccaaaguuaaaccaaaaucacaaaaauuuugcuacaaggcuuaaaaaauuaucuauuucuuuucucuuuuuuucuuuuuuuuugagauggagucuugcucugucgccuaggcuagagugcaguagcgcaaucucggcucacugcaaacucugccuccuggguucaagugauucuccugccucagaaucuggaguagcugggauuacaggcaugcaccaccaugccuggcuaauuuugugugugugugcguuuguguuuuaguagagacaagguuucgccauguuagccaggcuggucuggaacuccuuaccucaggugaucugccccccuucggccucccaaagugcuaaaauuacaggggugagccacugugcccagccggauuaucauuucaaaugcucauuuccagauggaacuauguuaauuuggcaugucaacaaacaagaccauaaggagauccaucauguuggaggauuuuaaugacauuuaggauauucuugccacaauaacaugcagucagugcauuuccuacauggcucuauuauggcaaugaauaaaacucuguaaguaauguaagugaacuuaguaaaggaaauuauaugacauaaacaauccauucuggcuguagauguauauagcuuuucauuuuuguuaugaagcagcgccaauaguaaaacggguuacaccaucagauuucaccaugacaagaauugcuuacaucauaccauuuucuaaaagcuuuuugauguaaauagguaauaucaauaacaagagcuuuauaaccauuaauaacucagagcuauauacaucuaggguugagaugaacaaauacaacauucagaaaucacacaaagcaaugacacugaugcauguauacagcuggauucccauagaggcaauauucagucacucauauccaugucuucuucaugaugaucauucccauucacuauggguucuccuagugaaucaccaguucccuuuuccacagaacguuucuuuguuuuaggggaaucugcuucuauugcuuucuucucuuuuuuuccucucucucacugucauacccuuguuccucuucaucauaaacccguguaacuuuuacaucuguaucacucucugauuuucuuuccugguccuuuucccuaucuuuacucuucuucuugcuuguugaucguucucuuucauaccuauuucucucuuuaucuuucuucuucuuuuuauguuucccaggggauggugagagagacaauuuucuuuuaggacaccgagacuuuuuaggagaucuuguuccacuccugcuucuucguuguugucucucuguuuguacuucuauaaugucuagccgugcuguaacuuucuggggguguuuuugaauguuucuuuugucuucuuucuuucugucucucguuuuugaugugcuccuugaccuucugccucucucucuggaaugagaucuucucugucuugggcuuuugaaucaucaacgacuccuagacugacaauguaaucacucucuugaucugcuccuugacugugucuagaagaugagaguccuccuccuccuagaaugugaucuugaaugccuucuuuuuucuuucucugguucuauagcagccgaaauuaggcagugugcuucuuguacucuuuucauagcuuccucuauuuuuuuuugagccaagaguuuugugcucguugcccaggcuggagugcaauggcacaaucucggcucacugcaaccuccgccuccaggauucaggcgauucuccugccucagccuccuaaguauuugggauuacaggcaugcgccaccaugcccggcuaauuuugaauuuuuaguagagacaagguuucaccauguuggucagguuggucucgaacuccugaccucaagugauccacccuccucagccucccaaagcucugggauuacuggccugagccaccauguggggccccuuucucuauuucuuuacuagagguauccgauuucagacuuggugaaacaagaccagcagcuacaugcuucaacuugggaccaacagugcucauaagcuucagcaacuaucuguggcaacagauugaguucaaguuugcuccaggaagcccaagcgcagcaagggcaggaacaagaguaggagcccccaaagcagccgguggaacagcgccagucugaguaaguggguuaggaguaggcaggagcccaacaccaagcagaagaccugccauugcauuagcuggugccaacagagacaagccuuagccuuaucaggaauaacuccuucugcauaugguacguuaucaaagcucugucaaggaauacaguguuugucagacauggugcgacaacugcugagucuggaucauggaauuuaacgagauugcgauuggcaaaggugaauuauccggcgggaagaggugugguucgucgaucuugccuaggaaaccgaagagaguccgcaucugcucagagcuagcgcccggggagaucagucaccuauuaccucgaugccgccgccuccaccgccgccaccaccuccgcuacugggcccgccgcuagggcccggauccgcagugcuggggacgaugguaguguugcucacggcgcugcucgcggcguucucccuccugcuucaacacaucaaacacacagcaaggagggggaagaggaaccgguucgugggagguggguauccgaugcuacagccucugcugcuccagucgccgucgccaccuuuucucuaccccacugcacgccgcgggggaggggaagagagcacgcuaguuggagagcacgagaaaacaaacggccacccccaccucgccuccaaccccacaauuuucauaauuaacucuagcuguaaauaagaaaacauacguggcaacaucucggaaauacacuuagguaauaaugccggugaauuucuguucacaacaaaacacauuuuuacuugaaauuucuaaguccaaauguuuagaaaaacuaucuagaaaaucugauacuuaauccuggccucuucagcaguuuugaggucuguuuggcaaauacgaauaacuuguuuuuuuuuuagacggaguaucggauugucgccugggcuggaguacaauggggcgaucucagcucacugcaaccucugccuccuggguucaagcgauucuccugcuucagccucccgaguagcugggauuacaggcgugcgccaccaaguccagccaauuuuuuguauuuuuaguagagccaccgcgcccagucuucauaguuguuuuuuuuuuuuuuuuuuuuuuugagauggaguuuugcuguuguugccccaggcuggagggcaauggcgcaaucuuggcucacugcaaccuccgacucccagguugaagcgauucuccugucucagacucccgagcagcugggauuacaggcaugugccacaaugcccaguuaauuuuuuguauuuuuaguagagacgggguuucuccacgguagucaggcuggucucaaacuccugaucucaggugauucguccgccuuggccucccaaagugcuggaauuacaggccucaagccauccgugcugggucuuuuuuuuuuuuuuuugagacacagucucgcugucacccaggcuggagugcagcagugccaucuuggcucacugcaaccucugccucccagguucaagugauucuccugccucagccuccugaguagcugggauuacaggcgcucaucacccugucaggcuaauuuuuguauuuuuaguagagacggaguuuuaccauguuggucaggcuggucuugaacucccgaccuugugaucugcccuccucggccucccaaagugcuggaauuacaggcgugagccacugcaccccaccuauugaauaacuugauuuuaaaaccccaucaucaaaaaccacugaauuauauguaauuacaucuacuaggaucuuguguagaauuucccaacugacacccaugggcuggaaauggguuacaagguguggggacaaggaccaccucagcuucagaaggccuagucuggucccugcagggcuaaggcucaugacaucaccuccugcuuauuuguuucaaggugcuguacaaauauccucgcuuucuauguguccacacaugaaaaaagguagcaccaagacagugcuuguuucagaaaaccuagacuucuuucuuuuuuucauuucuaacuaaaaaauuuuaaaaaaagaaagagagaagggguuucgccauguuggccaggcuagucucgaacuccugggcucaagagauccacccguguuggccucccaaagugguaggauuacaggcaugaggcaucacauccagcugacuuuucuucuuucuuugguguaguucucauaucuggcaaaagaaaaaaaaaaaagccccccggcccccauaaaacuaccuguggagauuuaaaaccuuuacaggucugggcccuggcaauucuuauuggggacugggggaaagacagccuugaguauuguacuuuguuuuugucuuucugaagauuuacugucaguucugagaagucaggcuugugaaccaugguccuauccuggcaucaauucaaguaaacaugacugccaaagaauuuuucaagguccagaugaguugauaucagauacugaucaagguaauugcacaacuaucaaagauaaaaaacuucaaacuaaguaaacacaaauauuggaucuagauuaaaauauuuucuuguugucuaagauauagcauuaagagauuuuaacugccuuuuaaaagcugaugugcaauggcgcaaucucagcucacugcaaccuccaccucccugguucaaucgauucucuugccucagccucgugaguagcugggauuacaggugcccacuacuacgcccggcuaauuuuugaguuuuuaguagagaccggguuucaccauguuggccaggcuggucuugaacgccugaccucaggauucccaaaguguugggauuacaggcgugagccaccgugccuggccaguuacucuuuuucuuaagagauggggucucggccaugcgcgguggcucacgccuauaguaccagcacuuugggaggccaaggcagguggaucacuugaggccaggaguucaagaccagcaugggcaacauggugaaaccccccccucuacaaaaaauuagcugggcaugguggugcaggccuguggucccaguuacuugagaggcugaggcagaaggaucacuucagccuaggggguugaggcugcagugagccaugauugccacugcacuccugggugacaaagccagaucaugucucaagaaaaaaaaaaaaaaaaaaaaagcucaaagaaaggauaucuuaaaaaaacaaaaacaaaaacaacggggucucacuauguugcccaggcuugagugcagugcuuauucacagaugugaucccacuacugaucagcacagaagucuugaccugcugcauuuccuacugggcuggcucaccccuccuuaggcagcccagugguccuccguucccaggagguugccauauugaugcugaacuuaguguggacaccugaucggcauagugcacaaaagcccacaacuccuggacucaagugaucuuucugccucagucuaccugguagcugggacuauauagccuugcgccacugugccagcuacuuuaguagcuuuuaaaugucuguuucaaaucuaucucuggagaaauuggaccagcucugaacucagaaaaaauaggauauucuaacucaugagguaaaaugcuccugaaucauuuggggagggggaaaagagaugaguagugagcagagccaagauggucauucauauaauucauccuuagaaaaaauuaauucuccauacucccuuuaaaaauaacaagugauuaagcaguggcuuaauugcucucuuaaaaguuuauauaauaaucuagaggcuggaugcggugacucacucugggaggcugagguggguggaucaccugaguucaggaguucgagaccagccuggccaacauggugaaaccccgucucuacuaaaaaugcaaaaauuagcugggugcgguggugugcgccuguagucucacucacucaggaggcugagacaggagaaucaguugaacccgggaaauggagguugcagugagccgagauggcgcugcugcacuccaguccgggcaacagagcaggacuccaucucaaaaaaaaaaaaaaaaaaaaaaaaaaaaaaaaauuucauacagaacagugcuguccaacagaacuuucugugaugauggaaauguuccacaucuguguaguucaauauugacuacuugaaauggggcuagcaugacugaggacauguuuuuacuuauauauauauguaacuacaaauuuaaauagccacauguugcuaguggcuaucauauuagauaccaggucuaaaaauucuacaccaguaggcugggggugguggcucacaucuguaacggcagcacuuugggaggccaaggugggaggaccacuugaggucaggaguucaagaccagccuggcuaacauggugaaaccccaucucuaauaaaaaauaccaaaauuagcugggugugguggugggcgccuguaauccuagcuacucagguggcugagucaggagaaucacuugaaccugggagguagagguugcagugagccaaaaucaugccacugcacuccagccucggcgacagaggaccaguaaagcaaguaugauuuuccccaugaucugcaagucauuugcaggaggggaaaccuuugcucaagcugucuuguaacuuaguuuacuugagucugaauucugugccaauaguuccuuuuucuugaacaguguggguggauacagagcagagcuucuguccuucacuguuaacuaagaagaagacccaucucuugcugucauuuuccauuuaagagaaaaagggacuuuuuccugaguucuuaaugacuucuucggaaaagauuuuuucaguugggaaucugucuuaacaaaagcaaaaaacuccauagcguaaucacagaauacuccauuuucucaagaauguccuucugugucuacaucaauaagcucuuaagaugugcagcaaaacuaaaaagcuaaagaauuugaugugcccagggugaggcuuuagggaaugcaggggucuuuauaaauaggucauuuagauaauaacaauguaaauuugccuuccacucucucuaggcacaccugaaaguccaagaaccugagauugaaggguaugcuaccuauugaaaccacucuucaacaggaagcagggaaaugugaagugacuucaguaacagaagaauguaaauaagucucuuuauaacugaagggguuauugagauuacuucagaaguuuuaaaguaauuugaauaaauuaucauacguuuuuuccuguaaguaaaaccugcaaacauuacuauuguuauauagucauaagaaucaacaauauuuuuaaagauauagcuagacuuuauaauauuuccccuuuucuucaaggaagauagauuauguccuugugguauauuugaaagcaaacuuugaaggccugggcuagugccauuccaaauaauuuacuuacauuuggcuagggauaaguuuuacagaucugauuuuuuuuuuacuucaguagcuuaauguauuuuccuuguuuaauggccuuuuccuaaucccuguuccuuuaauuucaagcaaggcuacuacuauguuuaucccuggcauccacaggaaacaggaaauauuaaaagaacucaagaugaauuaaaaaaaaucuuuuacugugaacauaagguuugaaauugucacauuuucuucuuugcaaauauuuuaaggauacacuaaaaucuaccauuuuuaagugaaaaaacauuccugaagugaaaaucuuacaucucuguuagucaaaaagguacuuguucuugccauggauaaaucuauucuaaaauauacuugaauuuuauuuuauuuuugagacggaguuucgcucuuguugcccaggcuggaaugcaauggcgcgaucucggcucaccaugaccuccgccuccuggguaaaagagauucuccugccucaggauccugaguagcugggauuacagguaugugccaccacaccaggcuaauuuuguauuuuuuuuuuuuuuuuuuuuuaguagagaugggguuucuccauguuggucaggcuggucuugaacucccaaccucaggugauccgcccaccucggccucccaaagugcuaggauuacaggugugagccaccgcacccguccaaauuuuaaaucaaaauuaaaauaacuucuagauagaaggaucuggauuuuaucaaugguuaacuguguucuuacaaaguuacaaauggcacugaguagcugaauuccuaccauuaauucaaagauuuaucagcuuauguuucaacaacauaaugacaccuuuaggucaauuuuagaaauguuuuuggcauuuauacucaaccucauuuccuuccaaguuuugaacaagaauucuacauugugggcauuagcaucauggcuuaucuuugcauccugaguuccauaaaucuuugcagaaugaauaaacuugcugaaaaauguacauaaaauuaagacagaggcaaaaccuacuguaaaauuaagacagaagcaaagccugguauaaugagcuacuuuuauaauuuuguaacuguaaaauaguauuuauaauauuuuguaaauaaaaauagaauuguauaacuauuaugcauuuuagaauagguagggacauuuuguuuucacuuugcugucuuguuagagccauagcuagaagcugauauuccucagguaacaaagacugcagccaaacucuaagaacagaaugauccauuaacuuugaaagaaguuaaaauagaauuuuuaaaagaugaaagaaaauccauuaauacaagguuuucacucuagcuuaugauuuugggcaagucauggaaucugauuuaauggggauaaagguuaauugguccauaugcugcagagccuguguaugugaaacaagugggauguuguauaggauggugcuuugugaacuguaaagugauacuuacacaguaagguugaacaggcacuacacagguacaccaugcagagaacggagugcuuuggaaguaucugagaaauggugagucacuggcuggagaaacggguuuaugggggaggaauuauuucacaaguuguggcguggugguggaagacugaaggcuuaaaugacaaaaagagacuuuuuuuuguaaggcaaaaggagucugugacauuuccugaguuggcuaaaagacauaauguggcaggagcuuuaggaagaucaaaugagcaacuggaccuaauuucaauuucagcagucacagacuucccauuuaccgagggcuuacaagcuccucuuacuguguucagaaguuuauagauauuaccucaauuaaucccuaacaacccuuaaagguucacauuacuacucuguuacaaaugugagaguggaggcuuacaguuaacaaacuuauuauccaaagccagggaaauuaagaugaggaauauccaagacuauuauacaauaaaacgggauacgugacgaaaucuagaugugagaccaggaauauugcuaugugcgugcaaagauucaggagaagcauuacagagauuugcugacuaaaugauuugcugacuaaagauucaggagaagcauugccaagauuugcugacuaaaugguaaugagggaucucauauacauaagguguuaugguagccuuuguucuccugagcaaacaccaugccaacauguaaucagcuaaaaaaaaucuguucagacaguucuacagaaucucaugauuuuuccauuuucagugaaacuguuuuuaaaguacauuuaauuccaguuuaaagucaucaguuuaacuuuaauacaugcugauguugggcagacaagauuuuaggagaacauaauagaacuccaggcacuugucugacuuaauucugccauuuucacaaauuuggaaaaucuccauccuuacagugauggagaggcaggcaggaugccaaggaggcuugucauaccuuagguccuuccaguuauucugccacuuguuuuucuucuucuucaucagucagccagacugugagagacuggugucaggcugucccagccauagccuguagaggagacucggccucacuuucucuauguguuauccucuuuuccgcuggggguuuuaaggugccagccuuaaguuccuagucuaagcaaauaguaaagcaagagugcugacggcucucaaagcccagugaguuccuucugaaggaagauguauucaauaaaugcuugugacaugaccaacguuaauagcaacugauauucugaaccauuuuuuuuaaauuauuuuauuuuuuugcuuuagcuuuuuggugagggacuugagggauaaagaugacaagcuuugggccaggcgcgguggcuuacaccuguaaucccagcacuuugggaggcugaggcggguggaucaccugagggcaggaguucgagaccagccuggccaacauggugaaacccuaucucuacuaaaaauacaaaaauucaccaggcgugguggugggugccuguaaucacagcuacucgggaggcugaggcagggacaccaagagacggagaucuuccccaguuagcacugagauagguuacaaaaaaaaaaaaaaaaaaaaagcuaaaaaaauaggacagauuacugcuaagaacagacccaugauaauaauguaagagcacuaaauaggccaauuuaagagacacauauuaaauucuaauuuacuccauuauccauuuagucuuacaguucugccauuauuauuauuucauauccugcucaaggauuuucucaguuuuaucucugucccuccuacuccucuucuuuuuuuggagauggugucucccucuguugccuaggcuggagugcaguggugcgaucucgguucacugcaaccucugccucccagguucaagcaauucuccugccucagccugccaaguagcgggugguacgcacuacuaugcccggcuaauuuuuuguauuuuuaguagagaugggguucaccauguuggccaggcugucucaaacuccugaccucaggugauccacccaccuuggccucccaaagugcugggauuacaggcgugagccacugugcccagcccaaaaaagauuuucuuacccuccuccucagaauuugauaauuguuuuuuaaaaaauguacugauaaaaagacacauauauaggugcugacucuguugacaaucuauccccagucuacuggaucuccaaauaaacaugaaauguuuuucauucucaaaaaaaaaaaaaaaauaauaauuuacugguaaauuauaaagaaggauuuagcuauugacucuggcaaaccuuaaacauuuucaugcaaaaaagaauacauagguaugcuugcacuguauuuuuuuuuuuuuuuuuuuuuugagacggagccucgcucugucgcccaggccggacugcggacugcaguggcgcaaucucggcucacugcaagcuccgcuucccggguucacgccauucuccugccucagccuccccaguagcugggacuacaggcgcccgccaccgcgcccggcuaauuuuuuguauuuuuaguagagacgggguuucaccuuguuagccaggauggucucgaucuccugaccucaugauccaccugccucggccucccaaagugcugggauuacaggcgugagccaccgcgcccggccuguauuuuuuuuuuuuuaacuguacuauggcaaacugauuugucaugaaaaacuuccugcuuuuccaugacuuugaggauaacguccuuuagcuaucugauguuaaaagaagaggcugguuacugcaguagaauaucauaauucuggggggguugguacauguuugguuuacccacaguagggagcaugcuuaccaaaagcaugugaagcauugcucuaagucucuggauccuucugcacaucuccaucuacauacuucguagucacaguuccuaauaucucaccugcuguuaucauugccuacuugaaaaucuggcaggaagguuauuagggaaaaggaaaaggggaauaucauuuaaguucccucacaacugcucuucaaacacuagcagagaauguuagaaagaaaaagaguaagaaacaaauggaaggaaaagcuaaaauagacgugaggaauauggagggaaacacguuccaacuuccccauuccuauuaauacuccuuucaugccuggaucaaaaaagugcuaccucuucacucauggagaguuuuugacugcuuccugucuucagcuccuggucuaguuucuaaacgccuaauuucauucuuuugcucaacccaaccagaccugguccaggcuacaggagccaagaacuagaaacuagcguagaucuaguaagugacaagacugagaaacuucaagucccuacucccaauguuagaucugcugaagaaggcauacguguuccuaagaucugagguuugcacacugaauacauuuuuuuuuuuuuuuugagauagagucuugcucuguuacccaggcuggagugcagggcaugaucuuggcucacugcaaccucugcuuccuagcuucaagugauucucauuccucagccuaccaaguagcuggcauuacaggcacacaccaccaggcccggcuaauuuuuguguuuuuaguagagaugggcuuucaccauguugucccaggcuggucucggaauccugaccucaggugauccacccaccuuggccucccaaagucuugggauuacaggcgugagccacagugccuggccacacugaguaauuuuuuuuuuuuuucagacggagucucacucugucgcccgggcuguagugcaguggcgugaucuuggcucaccacaaccucugccuccaccucccggauucaagugauucuccugucucagccucccaaguagcugagauuacaggugcccaccaccaugccuggcuaauuuuuguguuuuuaguagagacgagguuucacuauacguuggccaggcuggucucgaacuccugcccucaggugaugcaccugccuuggccucccaaaguuuugggauuacaggcaugagccacugugcccagccacugaauacauuuuuaaaagagauauuuucuucagugugguuagggugugugauacuguuagucuggucuucagauauagcacaggguaaaauacuaucuuucauggccuggcuugggaaucuaaccaccagggauacuaugaaaaauccuuaauaaccaguaggguacaggagccaaaacaaccagugugcuccuucuucucuaucuuacaaccaaauaucaucaaaugguuuggcuacaaucagcuccuauggaaaccuguuacuccaguuucaaacaaaugacuuauaguuggcucuauggaaccuuuuagggacuccuaaucauaaaaugauugcucagcagggcagcuuaugcuugaucugcccuguuaagaaaaaaaauuuuuuucaaaauuuucuuuuucccucauaaaauaaacaccagcuacuauggcacuuucaaagaacuacaacaggauauuucauucuucaggggaggagaccccacuuuaacugcugauaaucugaaauuuacuuccaaccuccuggcaaguacacagcaagggcaacacuuuacuuauggcuucccuccaucccuauuauauucuguuaggcagaaaaauaaacauggaaaaagcuaauaaauguuaaauccauucaguacaugcauuuuaggaugaagcuggcaaguuucacuuaaacuguaaccaaaagugucuccaauauucagcaacaacuaagcuggaugagaagaaaaugaguuacugauauauuaugcauuuauucauucucuacauagagcauggaugagguacauaaaauauauaguugggauuacuguauguauacagguucuacuuugggccuaugcuaucuuaaaauucacaaaaaugacaaauaaaccagggcuagucuuauauaaauguggacuuugaauaauacacuaacugggcuauggaagcauaaacaaacuguaauaguguacuuaaugaugaaacaaaaaacugaagaaaauucuaccauguaauuaguauaucuauuguuauuuuuaaaccacuuuaauacaugauucauccucauaaacggugacagugagaaucaaauuauauugcugaaguuacaggcaccagaagucaagauuuuuggauugccugcuuaauauguaaaucugcagacuuucagauaaggcuauuuuauuuuuuauuuguuauuaaacauuccaguagcaucagaaaugaguugaccucugaaguaacuaugagaauacucuuugggucuauguguuuugugaauacugacagugauuaacagaauuuaaagaaauuacaguuuugcuuuugauuauuguaauaccucacaaggggcaggaggaaaacuacauuuuguugcuggucuuggguuauucugaugauuuauuaggggaggcagaguaaguguuagagugagaauagauuaguacauguucauuuguuaugauauauaguauaaaaugugaccagagccuuuuccucuuucagauuuuauaauuuacucucaaauuugugguuacauaaaacugaugaaucaauucauaaauccagggaaccaauaaucccuacaaaagcaacggaccugguacucuaaaauguuacgcuacuggcaguaacaagauuaaaagcuggaaauguuugagcugaaugaaaaauuuuauuaaaauucaaaguuaucuaaaucauaaauuuuuaauaaaauuaucuaaggagagauuuucuuuaggaaaccuuaaggauacauacauuuaaguauaucugaguuuuugggcagucuccaccauguuuucauaugcugucuaauuauuaccuaaaaauggcccaauuuuugcuaucaaaauauucuuacuucaaacacaaguaccauucaaacaauucuguaauucuucucauuaucacaaacuuuaaaaauugaauagcuuuacuucagauaaauuacuggaaaagcuuuggugagauguugagagaauagagaagaucaauaacacauuaggauguuuagaagucaccaguaggaccacaagcauggagcaguagaaaagguucaacaaagcuuucuuugagaggagagaugggaaugugaaccucaacgaggucuaggucauuuagguaaagggauaaaacacaaucucgaugugggaaagugauugaggaagggcaucuuagcauauggugguguuuuugauauauuuaccuguccuuuucuaaaauuuucugaaguucuaugucucugcaaguuuugauucaaugaggucaguaauaaauuacaguaaaccacaagguuuauuuucagagaugugggguaacuucagauucauguuuauaucauuguuuuuuaaaccuauuuuuuaggacuauuugcagcucuaaauacaaaggaguuuuuuauuucccauguaucuuagcagcuuucuggcaguguagaauuuugaaggaagaugcauuuuucuagugcauaauauacaaagugcauaauauacacugugguuaaauuucaauagccucaaucucuggauugaagaucuggaauucggauacaugaaaugcugauuuuuaaaguauuccaauggccaaaaugcugaugaaaauguuuuguggaaaauauauaaauuuuauauuaacaaaaguguguuacuuuuaaaaauuaaaauaaggaaaaugauuuaacaccuuucaaaggguuauccuaaugcaaaaucccucuuuaaauacaacuaauuuaaaguagcacauuacuguuuuguuucaaacaggcaaauauaaauaugaaagcauuugucuuauuuucuacaguaaccucuuuauuugauaaaauagucaaguuuggacauuuugaaacaagcuagaauaaguuuuagcuugauuuauauaaaaaaauguauucaaugaaagaaauuaugucuaauaacaaaaaauucccaacaaauuaaaauuaaauauuaauagaacauuuuauaaaaacugagucacuccuuguuaaaugccacuuucuuuuuuuuugagauagagucucgcucuguuacccaagcuggagugcaguggugugaucuugguucacugcaaccucugccuccagggcucaagugauucuccugccucagccucccaaguagcagggauuacaggugcacaccaccaugcucggcuaguuuuuguauuuuuaguagagacgguguuucgccacguuggcugggcuggucucaaauuccugaccuuaggugauccaccugccucagccucccaaagugcugggauuacaggcgggagccaccacacccggcccauugccauuuucacuuuugaacauucaccucaaccaggcacaccuggugccaccacugagguaaugcuaggaaugugagccuccuauaaaacuggcucuacacacguuggcaaagaccaaacauuggaaguacacagcaaacagggaauaaggacaggcaacugcaaaucaccuccacuacacacuucacccaucuuccuuccucccuuacucccucccucucucucuuucucuguuucuuuauuuuuaagacagagucuugcgcuguagcccaggcuggagugcaguggugcaugaucucggcucacugcaaccuccaccucccggguucaagcaauucucaugccucagccucccaagcugcugggauuacagacguucacugugacgcccggcucauuuuuguauuuuuaguagaggcaggguuucuccauguuggccagccucgucucgaacuccuggccuccagugagccgccugccucagccucccaaagugcugggauuacaggcaugagccauugcauccagccaacuucacccaccuuuaaacuccccuuuaggaauacagagcacacuacauucacccuccuucuugccuuccaacaagacaauucacagcuuggugucuguuccuuuaauuaggucagcuccaagcugagauaagccucaaggaguagguguuuuaaugggauaagaagaacgaagucuagagaauuuaggcccucaauuucaggugacccagcauuuguaucccucuuuaccuccacaccuguccuuucucccuguuuauuauggaauuccugaauccaccuggucagagauuucauauucuaucacuuguaaaagucauguuauuaauucaacgugacugaaauagcugagaagccugaaaaacuguauuauauuuaagaaguucuauuaaguauuaaaaguaagaaaaucucuaugaaucccaccugaugauccaaauauaugguguuccuuuggagaugaugugaaagaauuucauucuaguaggcaccaauuaagaaaaaagggacagagaaagaggauguggaauucaagaaaaggucaauuuuggaauaagaaaaacagguaauuuacuacaaccuauuauaucacaguacacgacaacuuucacgcacaugcuccccuguaaaugguaccgcugacauauuaaauuacaaaauuauauuuuguuuuguaagaaauuacguagacaugcauaugaacaaugaacuauuaagcagaaaaauuccuuaaaauagcuuuagcaaacugacuguuagaacuuuuacaugucaauuauuuccucuaauauaguacuacuucuuuaaauaagaucuuucuuauauaaccagagcuauaaacccuuugagaaacgguuauguguucguucuuuucauuaaaaauaagacauuuuaaaauuaauuuuuaacauuuaaaaggcaguauuauuaaagcuauaaugaauuuuuaauuuauuguuuuauuggaaauuauaggacuucucaauauuuguuuuaccagauauggaagucacaguauucagugaguaacaacaugaaguuaaugcguacaugaaguauuguacgcauugccuuccucaaaaccaaaagccagugggugagcgggugggguagaaggcuaagaagaaaugcacccuaccuguauuuucuuucaguaauguauaaauaaguugaauucucaaaggguuaauaggagauucuaauguugucacuauaaugaugguaugggcucaugcucaacacuaaugaugcugaucauauugacugaugaguguuucaaaauaagagaugauggcagacgacacagacaaaucucuccauagcugaccuuugggcugugggccucaagcuuuagcugcaugagcugugcuaacguaugcucccggauacuacucaguucggcuugcugccgucucagcuuuauuagcagcagcguaagcuccucuggcugaaggaguacaauuuaagaauccaaacaguggaaaacagauuaauuguugucuuaagugacagauauuaaaccaagauuucuuggcaaguuuccucuuaugguugacaucaaacauagugccuaggcacuaugaugauagguccuacauaaaugcauagauaucuagagaaauagaaggaacaguguuacuuuaaaagauacagcaaaacaacaguaaauuaaggcauuuucucagaacucaugagaacauuuaaauguuaaguacaaaaaagcacaaugccaaaaaaacauuauaaagguuuguacauaagugcuacuaaaaaauuauuaaaagauauuuuacuaagauaucuaaaaaaauuacaccuuuucccagcaauaguacaaauaccugcauguccaacuuucuaacagaacuacauaaaauaauuaaaauaaauguaguccgggcacaguggcucacgccuguaaucccagcacuuugggaggcugagggaggcggaucacaaggucagaaguucgagaccagccugagcccugccucuacuaaagauuaaagaaaaauuagccaggcaugguggcacgcaacuguaaucccagcuacucgggaggcugaggcaggagaaucgcuugaauccaggagguggaguuugcagugagccgagaucacgccauugcauuccaaccugggcgacacggcgagacuccaucucaaaauaaauaaauaaaaaaauaaauaaaaauaaaauaaaauaaaauaaaacuuggauaucuucacauuauuaaauuugggaucuggguucuauuaauugcuucccaguuauacucugaaaugucacuguuagugcuuucauauagcauuuuuuaugaccaaaagaucaguuuuauuuuuuaagaaaaagagaguuuccaugggcacauaaacccuccuucuucacucugggaaaagaagagaaccuuuuuuugguuccugauuggugacugugauccaaaggaaaauaaauuuucaacaguggaugaaauuccuuaaugggccaauuuaauauacuuuucuuagaaauacaguaaaguaugaucauuggcauucuuauagcccauaaaauauuacuugguauuucucugagcuuuguuaugauuaacaacugaaagcaggcuacaggcuuuccucacuggagugcugcaauguacucuuaaaaauuccaggcuaaaaaguauucccaagauugguuuguuuugccuacacgacagcauugcauuaacucucuuccguucuguuuauuugcuauugcucuuuauuuucugacaauucuuuucaaaaacagaaaucauuuuuaaccauuauccaaaaucauauuaaaaauuauugccuucagaagaaaaaguguuagcagaaguuacuauuggauuccuuagauaaaacuggguauccacaggugagacaacaguuuuuuacuguauauuaaauggucaaagaauauuugguguaugagauuuaaauaaaccauguaagagaaaaagaacaguugcuuuugcucugaugccaauccuaucucgugaccucaugaugcuaggauaguccuuguuuuaugaucaucaucuccaacacuugaggucuugccagggagaagguaagaugggcaaagggauuuagauauucuaagaacccagagugauaccgcaaggaauacugaaacucugguuuauuauuuauggagcuaaacagacuaagagauuuucaaaaggaugaaagauaccaauaacuuuauuuagauuuugaggccaaauaaagaggcacauuugaccaaagaaaguagguggugguaaauaaauuuuggcuaaauauccacuagagggagcaaggcagaagagaaacauuugugguaugcuauuuagcauuuacucuaugauuaaugacuauuugucaggccaacaaucuaauguuuuaagauucccacauuuaaaaguccuuagucuuaaucaaauaaucuuuggcaaauaaacugcaggaagcuuaaagcaaggaaauauuucauuuuaucuaaauguguaaaagauaaaauaaaacaauguuuuuacaaaacacauaagaugaauuugauuacugcaggaagagaauuuuaaauaaugaacaacuauacacacaggugcuaaaaucacaucuuuacagaaacugagguuaucuacugacaauaaagccagugccccugauaaaagaauaccauuaaaauaaacugaagugaggaaaagucaucuuuucucuuuaacuagaagaaguguccugcuaauguaacuccuuuccaauuaacauaacacugacaaugaaaugguaaugguaaauacuugcuuugaucgaacgcuuguuacagucuuuuucugcugauauguaaaucaguuuauuuuacaaacagcucuaaagaaguuaaucuaaaaauucacacgaaaaacuuaauacgcugguaguuugacuacaaauaacugcuugcuggauuuguucacuaaugaauuacugcaacuucuguuuuaaggauaagggaaugaaaguaaagaaacccaccuaguucauacaauaaaguuucuuuuuuuuuuuuuuuuuuuugagacagagucuugcucuguugcccaggcuggagugcaauggcaggaucucggcucacugcaaacuccaccuccuggguucaagugauucuccugccucagccucccaaguagcugggauuacaggcacgcaccaccaugcccggcuaauuuuguauuuuuaguagagaugggguuucaacauguuggccaggcuggucuugaacuccugaccucaagcgauccgccugccuuggccucccaaagugcugggauuacaggcaugagccaccgugcccggccauaaaguuucaaaauauaaucuuuuauuuggccagucagacacuuaggaaaagguauccacuaaaacacugaaauggcuacaugauuucaaauucugaugagcaucucuugcacaaaagcaguaauguuuuuucuuugggagaaccucugaaaauucaaacuuaaaaauuauguuagauauguaccuuccugugcagcacauaaauaaaacaugguaugguaaauaaagauauuacucaccguuuucccuuggaggcucuggggacuaacagacuguaaagucaggccagcuggcacugaccuucugucaggcacauagacaugcuaggaaaguaaaggcacaauguaauucugugguaaaguuuuuuuuuucuuaucaaugucagcaaggagaaaucuuaaauuccuauuaugaaauaccauuuaaaauugcuauuagugcuuaugaaagaugauagagacuaacauuucuugacauaaaauacugauguggggcugggugcgguggcucacgccuguaaucccaacacuuugaaaggccaggguggacagaucacuugaggucaggaguucgagaccagccuagccaacauggugaaacccuguccuuucucuacuaaaaguauaaaaaauuagccaggugugguggcgugggccuguaauccuagcuacucggaaggcugacgugggacaagugcuugaccccgggaggcagagguugcagugagccgagauagcaccacugcacuccagccugggcaacagagcgaggcuccaucuaaaaaaauaaugauguggaugagcagaguaauucuuuuuuuuuuuguuuuuugaagcagagucucacucuguugcccagccuggaguguauggcaagaucucagcucacugcaaccuccaccuccuggguucaagagauccuccuaccgcagccucucaaguagcugggauuacaggcgcaugccaccacgucugacuaauuuuuguauuuuuaguagagacgggguuucaccauguuggccaggcuggucucgaacuccuggccucaagcaauccaccuaccucggccucccaaagugcuaggauuacaggcuugagccacuugcccggccugaacagaguaauucuaaaaucugguuuagagguucucaaaaacucuuugaccucaggaucccuuuauauucuuaaaaagaaaauuuaguggcaagaguggcauuguuuuacaguuuugcaaaucuuuaaugucuggcuggauucuuguaucuguuucuguauuuaaucuguugugauaaucucuuuuaguggaaguaugugaagaaaaucuacccucaauauauauaguuggaaaaaaggagagaauuuuaauaguuuuucuugauaauuauagauguucaucuuugacacugcgcuauagcucaaaaaacugauauuuuuuaaagguuaguuacaaagugauaucugaaaccuuaucaaugaacuuuugauacucuguuacauuaauauccacuuggucuauuuguacuuuaaaugaaucuugugacaucaaacacuggucaucuggaaaauauugguucagugaguuaugcaauguucuaaauauugacauaugucaguauacaauauaaaaacaucacaacuguuaauaucaccgccaaucuuuaagcaccggaaagcugucaaguucaggguggcagauacaugauuuucaaaauucuauuuuuugcuugaaaacucaaacguuguuaucaguaacaaauacugucaguuguuuuccuugaagugacaggauagcauucacuuugagaaagugugucuaucaaauaccacgucugaauauugacaguugucuuuuguucaaguaaaaauauguuucacaauaaaaggaacuaauucagcuugcaacuccaucauguguuuuacugugagacaacgguuagcacuuugguaugccauagaaaugcuuuaugcauuuaccauuucaucacaaguaauaguaaaagaauauguaacaaaauguuaagguucaauaaaauuauuuucuacuguuucaugaaugagauuuauaagugaaccugauacuuuauuuuuuacuucaaguguguggcagggagggcuacaaugaccacuagcauagucuggauccacugccuugauuuaugcuaaggugccagaaauuuuacucaccaucgcuucugcacuacuagagcaaauaggaacacaaugaauaaugccuuauuaugaucauaaaaauaguuuugacucccugaaacggucaugggagggaacccccacagggguccaugaacuacacuuuaagaaccacugaucuagaucaaggaagaggauaggauaguuugaaagaaaaauuuggcaauuuuggagaagucuuuugggaguagcaguagcagacaguugagaauuggauagagaauauagauucaucucauauuugcugucgaaacagaugauauauucuggccaagaacaugaaaaauacuauuaaccaugagagcauguaauuuagagccaauuguuagaccauacacauuaaguuguauuagaucagauuuuucuuauauauuguuacuauuuuuaucaaucaugauuuagucuuuggaaaaagugaggaaacacugaacuuuguuacgauggaguucaaagugagccuuuuguugugaggcaaauuaaaacuuucuucaaaggaaaauuccugauuaaucuauuaaucuuaacaaaugcuuauuuauggaaauaucaagcaaaugcuuagguaauaacgcagcugaagaaaucagcuugucacaaggauaagaaaagagcauuuuaaaacaguauaaagcaauaacuuauuauuacuauuuuuugagucagaguccugcucugucucccaggcuugggugcaguggugcaaucacagcuuacuacagccucaaccuuccauguucaagugauccuauggccuuggcuccccaaaguguugggaauacaggugugagccacuauguccggucaaagaacucuucaguaugaaaaaaaaagcacuuuaggauagacauuagggaacugguuguguacuagcugacuaaucaaagccacugcuuuagcauuaugaaaagcugauugauacaaagcacuuugaauucacuucaaauaaucuauacuaagcaaugcuuaaaccaacuuaauauacaaaguaaaacaugaucuccauuuuuaaaauguauacauaccauuaagcuacaauauuaaaucgaguguuuaaggaguuaucucaauaugccauauauucauugguuagaagauaaaguuaacacuuuuauccucaugaacaacaggaugagcuugauacaaaauuucagguaugccagaagacaguagguguagaauuuccaaguguguaaaaagccaauaaaaaugaauguggucuaggccaggcacaguggcucacaccugcaaucucagcacuuugggaggcugaggccagugggucacuugagaucaggaguucaagaccagccugggcaucacggugaaaccacaucucuacuaaaaauacaaaaauuagccaggugugguggcgcaugucuguaaucccagcuacucgggaggcugaggaaggagaaucgcuugagcccgggaggcagagguugcagugagcugagauuaugccucugcauuccagccugggcaacagagagagacuccaucucaaaacaaaacaacaacaacaacaaaaacaacagaaaaaugcaugugguguuaagcuacacggagaacugaugagauaugguaucaagcagagaaaacagaaugcaucugcucaaaagaacugcuccuguguuccugagagaugaaguguugcaauuagguauuuuuuauacaugagaucuuaauguuguaaaauauuuuuauuuauuuuuuaaaacaaaaaagagcugccuugcuuacuuuauccccauucuuuugucucucacauuuaaaauaguauacuagaaagaaaacacagcauuuauaagguagugaguuaacacaaaaucagcagcuauuuuaccuuagggugaugggcccugugucugcggucuauugucacaucuccucucugaauuggugaagacacuuccgaucuguaaguucguugaggggaguaucccugauaagcagcuauugacccgugggaaggugaugugggaauagagugcauugucuggucagaaauauuuaccaugguuuugggacuacucaaaguacugugucgagggagggugcucuguuuguuauaaaacugacgcugcugccauucguagagcugccacauugugucaucucucauggaccuccguuucuccuccgcuccggguccuaaugucuugucaugaguggaagggguuacacugcagauacuuucaggccuugucuugcuguuucuugggaguguucuauaaccuucaggguagcgggccauaaucugggcucugugacuuggcauauuucuugguaauguuugguaagaaauuacucuaaaauaaaaaaauaauuaaaauguaaacaugaaggaggguuauuuuccaaauucuaaauuagaguacauuucuuuuguuccaguaaguaaaauauacauuagaauuuuuuuuuuuuuuuuuuuuuuuugggagacaagagucucgcucuguugcccaagcuggagugcaauggcgugaucucggcucacugcaaccuccgccuccugggcucaagcgauucuccugccucagccuccuggguagcugggauuacaggcauccaccaccaugcccggcugaucuugaauuccugaccucagguaauccacccacuucggccucccaaagugcugggauuacaagcaugagccaccgugcccagcuuagaauguauuuuuuuaaagaucaaaauauuauccaagguauaaacuauuaacagauuuuaaucuuuuuaaugaaauucgauuuaacacacuuaauacaagauaaacagcaucuauaucaauuacacaaaagacuauuaguuccacacaauguagaguuugauuuaaagaugaaagaguauuauacuucauuugagaaauaagaauguuuaaaaucuaaucucaauucugucacuauauuuuauuuguuuuuauauaaauaaacucucauuuuuauacaucucaucagaggacuaggauuucuauguauggaugaaauaugaagugaguuauacccauagagcauaaagacaggaaauaaauuacuacaaguauauguugacuauucuguuguauguuuucuuucaggaaguaugguuauuuaugggaguaaauacaucaguacauuugguuugaaggaauaacuuccuuucauagcuuuuccuaacuugagauauaaaagugacuuggagcugaugcucagaauucuauuaaagauaaaauacuuaaauaucacaauauuucagauauaaaagugcaaucucagcaauuuugcaaaguuuccagcacaguaauuaauauuccacuucauagaugguagaauauuuuucaggaggcuucuuaaagcaaucuaaaaaugcuucauguacauuaugcaugcaaaguauaauucuuuuaaaauguuaauuuugggaauuggauauguaauugcauauuacuaagcacagaauacuaccauuuccaaaaaugaaagaauacaauuucaguuuacuauuuuuaaaaaaaccacuuugggccgggcgcaguggcucacgccuguaaucccagcacuuugggaggcggaggcaggcggaucaagaggucaggagaucgagaccauccuggcuaacacagugaaaccccgucucuucgaaaaauacaaaaaaauuagccgggcgugguggcaggugccuguagucccagcuacuugggaggcugaggcaggagaauggcgugaccccaggaagccgagcuugcagcgagacaagaucgcgccagugcacuccagccugggcgacagagugagacuccaucucaaaacaacaacaacaacaacaacaacaacaaaaaccacuuugauaaacauacucuuuugaguuuauaaaacuaucacagugccaacuucauacuaggugaaauucaugauauaaaaaagauuuuuaaaaguuaggggagaagugagccagaaaaaaaagaaucaauuaaaaacucuacguaaaguuagcauuuguguuucccuauuaucuuuuuuuuuuuuuggagauaguguuuugcucuguugcccaggcugaagugcauuggcacaaucucagcucacugcaaccuccgccucucagguucgagugauucuccugccucaggccccugaguagcugggacuacaggcaccagccaccaugcccagcuaauuuuuuguacuuuuguagagaugggguuuugccauguugcccagggcgaucucaaacuccugagcucaggcaaucugccugccucagccuccuaaagugccaggauuacaggagugagcgccuggccuccauuuccuuuagauacagagguguagguauaauucaaauucuaaauacaaacauacuuuuuuuuuuuuuuuugagauggauucucacucugucacccaggcuggagugcaguggaguacacugcagcccgguccuccugagcucaagugaucuuccugccucagccuccuaaguagcuaggacuacagauauaugccaccauguguggcuaauuuuuuauuuuucccaaacguaacuuuuuaaccaccaccagaacaagaaacaucuagauuagaaaaaguaagauuaggcugggcgugguggcuugcgccuguaaucccaguacuuugggaggcugaggcaggcagaucgcuugaggccaggaguucaagaccagcuuggccaacauggugaaacccugucucuacuaaaaauacaaaaaucagccagguguggugacgcacgccuguaguuccagcuacucgggaggcugaggcaggagaaucacuuaaaccugggagguggagguugcagugagcugaaaucgugcuggugacagacacucugucucaaaaaaaaaaaaagaaaaagaaaaauuaaauuacaaguauucaucuuauacaaucaucuccauaggcauaaauuuauauccuaauaucaaaaucaacagaauucaaugaaccaaguauguggaaggguugggacuccacaaacucagguuuucugaucucuucuuucaauguuuaguuaacaacuuuuuccuaauauuacaugggcuccuacugguugugaaaaugucagagauauugguaauuacauggacccgaagggauuaaauauuugaugggaaaaucauuugaccauacucuuaauaaucugggaauccuucgcugauaaucuggauauaagagcucucuuuugacccaaagaccugucaguaacaaugcacaaauacugauauauuauaguuacaaaaagauuucaggcugggugcagcggcucaccccuguaaucccagcacuuugggaggccaaggcggguggaucacuugaggucaggaguucaacauagcaaaaucccgucucuacaaaaacuagaaaauauuagucaggugugguagcaugcuccugcacucccagcuacucgggagguugaggcaggagaacugcuugaacccaggaggcagagguugcagugagcugagauugugccacuguacuccagccuggccaacagagggauggcccugucuccaaaaaaaaaaaaaaaaaaaaaaaaaaaaacagguuucauugugaugaauuaagugcauucuggacuaugaggcaccuaauuaauaaacugccggcauaauuugugucuauuggggcaguaaaauuauguuaccuuuacacuaagagaaaaaucucauguuaaauauaccuucucuuuguggguuaaagcauccagaggggauauagugggaaaacaguaaaacaggaaaagugguugaucaaaaaucaagacagccaaguuuugauucuugcuuuccuauuaaguacuuagaccuuggaugaguuacauauucuggggcuuucagaauauugggggcaggguaggggaguaggggagaaaagaccaagagauuuuauauauauauguauguauuuuuuuuuuuuuugagauggagucucacucugucguccaggcuggagugcaauggcaugaucuccgcucacuggaccugucucccagguucaaacgauucuccugccucagccucccgaguagcugugauuacaggugccugcugcuacacccagcuaauuuuuguauuuuuaguagggacaggguuucaccauguuggccaggcuggucuugaacuccggaccucaggugauccaaccaccuuggccucccaaagugccaggauuacaggugugagccacaccugguccaagagaucauacuugggguuacagaaagagcuugcgggcuaaauagaacuaaaaugcaggucuccuacuuucuaaagcagcacucuuuuaacuaugccagugaucccuaaacuuuuugauuuuuuaaaaaaaucccucuauuuuuaaauuuugccacgauaugaauauuauuuuuaaaaaaccauacucaucuaucacaaugacuuaguuaaaaauaaaaagguauuaaaaauuaggaaggauauaaucuuaucgcaccagagagcucuuuaauaugcuauuaaaaucuagccaauggccaacugaaacugggauccucuuuucucaucuagaagaugauuucaucauaaacuuauucuagagcucuaaaauucuaugccuuauuuuguauuuuaaauauuucuaauucuuucaaccguuucuccuaaacuaaauuuccuucaucauggugguuguucuucaggauuucaaugucucuacucaaaaagagguuguucaaaauugaacgaaaugucuccagacaagaaccgcugcauucaggccaaccauccgauucgaugccuucgggguggagagagggagaaagguacccaauugcucuuauauaaccaguauaaagaguucaauuccuugaggcuuucccuccauggguauuuccuauuuuguuucugcuuggucuuccuccccaucuucaccgucuccuaucacacgaaagccagaaacuggaaaacauccagagcuggcaaucccaugacuaugugcaaauaugucagcuagggaaagcugacuccaucaaagagacugcccuaguacuaaagcaauuuacucugacacaccuugguuuguuuggucauucauaaauugaagaaauacuacaggaggcuuaauaugcaaaaagcuagagauuaagcacugagcuauaucauagaaacauguaaggaaggggacauacauuaucaaucuaaaacacacccaaaguugcuuauaaacuaauaucuaaauuauaguucaaaaauauaauuacacuaaaacacuuuugucaagugcucugaaguauucauaauguuuggguuggacccuguuguagagacguauauugaaccugaacugucaacuaucauaugaucauuaacagcaggauauauauauuuuuaguaagcuugccuaauuaaugacauuaaaaggcucuucugucaucuuuggaaccacauuuggggaauuuuaauuaaaaauuaaauuauuaucaagcaaauuuauuuuuaucccauauauuucuagcacuuugagaccuguuuuucaaaacuacaauucccuuuagugacuuuuuuccccaaagaaauucaaauuaagcaaagugugauuuacuuuuaacugaaagcuuaagaaaugaacacucuaagcuccuacaucagauuuagugccccauuggccagcagcugccugucaagcaccauaaaagcccuuucccugugauucugccaugcagaacaauggcuuaaggaccaugcaucuuaacagugccugccacucagaaugaaacuuuaaagcuuuguucacagaugcagggaucuacuauuuugacuaaauauuaaaccuuuuucuuucuaucagaacuuuaauaauagaagacuuucauaaagcuuuuuaaaaaaugauuuauauauugaauuacaauuguuucauuccaccaauaaaaaaucauuucauuauaaaacacuacaacuauuuuuaugaugaaguuuauaucauaauguagaugauauuuucuuaugauccaaaguggacucaagccauuucaaaagaacaucuaaauaacaguauuuauaaaaacuggcauaacaguuaacccaaaaauguaggaggaacccagagaaaaucuuagcucaaaauaaccuaaaaccagccuucagaagcuguugguguauguccaaaaggaagaagucacugaaagacuuuacugauauuaauuacacucauaaaggaaccuaaaacuaguauuuauacuucacaauuuuuaaaaauccucuaauuuccagauaucuguugacucucucuauacacuuuuaaacuuaagaaaguaugauuuucggggaaaagugauucuucuuugaaguaagauuuaacuuggugagcagagacgcaccaaucuucugauuuggauuuuuauaauuuuucugaaagugauuacuuucccaaguacuuccaaacauccuuucauuuuuuuccccccagaccugcuuccugcuucuuuucugucuaaucacauuguauuaauuuauuuuccugcuaguaauauauaagcuuauucaugucugucauuccauccaacauuaaguaaucuaauuuuuauucaucuaugccuuaauucuuuuauuuaugauuuuggucaaucugguaagugaaaaauaaugccuaauuguuucuuuaaugugcaauucccugauuacugguaaauuugagcaucugccaguuuccuuuuuaaagaaaauugacaaauaagauuauauauauuuauggugaacaacauguuuugaaauauguauauuguggaauggcuaaaccaagcuaauuaacauauguauuaccucacauaacccauccaaccacuaucuucucuuuucccaaaucuuuucuuugcaguaaaaggcaccaaaucacccuaguugcccaggccuaaaaggcagggugucauuuuugauuuccuucaagaaacuuccagauuggagugcaguggcacgauccuggcucacugcaaccucugccucccggguucaagagauucuccugccucagccuccccaguagcugagauuacaggugagcacuaaaaugucuggcuaaucuuuguauuuuuaguagacaugggguuucaccaucuuggccaggcuggucucgaacuccuggccucaacugaacugcccgccuuggccucccgaagugcugggauuacagacucaagccaccuugcccggcaccaaacuuaaucuugagcaagacgaguuugcaaucaagcacaucaaagcaaucaacuagacuugucaauuauaucccgaauacauccucauccucuucucacuucaaucacuuaaguaacuuuugaacuuucuccaauuuauuauccagauuucugagacaccaaucugaaucucucucuccuagcuuaugucucuagccuguucuucacucauugauuccccaguuacaaucaagucauacuggauuucuuuugauucuucuguucucuaccaagccuggcgcuuugcauaucuaagccauaauaugcauguuauucuucguaucacugcuuguguuuugcuuccucuacaaagguuuuccuagacucugaauccuuaagauugugcuguugucccgaaauguguuccuacagcacccuggucugccuucauuguauuugucacacuaaauugcaucuacuuauucaauugucuccucuacuagagaauuaucucugugaguaucuggacuguaucuuuucauuauuuuacuuugcggucccacaauuagcauauaguaguugcaaaauaaauauauuaagaaaaggugcaugcaaaaaugaauaaaugcucauauaaauauauuuacauuuuuuuuuuuagaguuggguucucacugugcugccacgcuggagugcacuggcacagucauagcucacugcagcucccaacuccugggcucaagcaauccucccacuucaacuucccccaaguaguagguacuacagguaugcaccacuaugcuuggcuaauuuuuaagaauuuuuuacagagauagggucuugcuagguugcccaggcuggucucaaacuccuggcaucaaacgauucuccugcuuuggccucccaaagugcugggauuacaagccgaaaaacugcgccuggccuugaauuuaauaguuaugugcauucugauuuaaagaaagcccaagaauaagacugggaauuagagagcaguaggccuuugcugccuccauauuacuugucucaggagauccuugcauuguaccaaccugcagaaacugguaauggaggacagucagagaagaggugauaauggcaggggacaagacagggguggguugggaggacagggcuugcucccucccucucccaaauaaacucgaucucugccuguaacccaagccuuuccuugugcuuggccaggaaggaugacuccuugccauuagcaaaguugggugacagaacauaagagacagagaauaaauacuuauaucugaucauuauaaacaaaagacguaguaaugaagcuauaacagcuaaaacacaauuuaaaccaauauuuuaaucaguagcucagaaaccaaucuccaccaacacagcaucaaagaaaccuggguucauaaugacaagacagacacuuacccccugguuucuucuucaugaccccuccccuucuggauuuuaauccacuguuccaacugcugcauugaauuuguucucuguaugacucgaucggccucuguguauaagggcccuguauuggggcgauuuccaccucuaagaucugccaggcuaacauugacuauuuuguucucugaacugcucaaguugauuggucuguagugcacagucugagcagggcaugcugacccacucucauauucagauggcagagaauucagcuuuacacuauuaauuuuuguuaagggucuaucuugaccauccuucugaaauccauauuuuucagcuucuaaugccuuuuuuucuucaauuuugcucauuuccuuguuuuuuugauuguuuuggaucucugguuuaauuagcacucuaugguugggaauguuauugguuucuuuaguuggugcauuuucagauguaaucuuguccacucugaaaucagagaagaaaaucauaguaaaucagaugaaauaauguacauauuacuucugggauucaaucuaggaaaaauuauacuuuacgggggugggggccaggggacuggaaagggucacaguggacaagucuacacaaauacccaaugcugugauauuaacauucaagcacaacaccagaauguauaaacagaaagggggaaaaagaaaacauaaagaacuagagcguaaaaagugaugugugcucccaccauuaggaaucugaaaauaaagcaaauuaagauugccuuaugacaguuaaaccacaaagucuacacuuaaaggaccacaguagauagucccuugaaaggagccacauggcucccagccaagguuagcugcuuguugacucaugagacaaacaugagucugguuguggaaauggcugcaacaggaaaucauagucugaugcuaucaaagaucugaaccauauaauuaacuccuuuuguuuguauucaagaggaacucaguaugauuuuagagcucuuggagucugacugcacauguccagcuugcaacucuguucuuacuagcugagucuucaggcaaaguacagaacacuuaaagugccuaugcuuccucuuugguaaauggguaugauugugccaccaagaucagaggguucuugugagaaucagaugaguuaaugaguggcuggcacagaccuuauuuuaccauuauaauuccaacacaucaagcaaucuuggguuagaaucuggcaucccauguccaccuggccacugaaagaaugagcucguuaacagcaugugucuaggucacucgacaguuguacuugcucacuauucuaguugccauaucuaggucuuucccugagccuaaucacuuccagacucugaaaagaucaagcugagugugugaaccugcacgaaacugccaagaucaugccacucuaggaggccucucaggagccagccaacccuccauauuccaauaaauaaaaaugcuucuaucagaaacuaggugugguaaugcugccaauguuuaugacguguggaaaggauguagaucuauauacauauaucuguaaucaacuauagaugaagauaucuagaagcuuuggaauauggucaccaaggaaaaaaaauuaaaaaaaaaaggugacuauuuuucuuggaguaaaguuaugaaccauccauauauuuagguuaaauauaaaccauggcuucuagauuggaggcaacauuagacauugggaaaauuuacuaagauagacuaugugcuucuuucucuugaaaaauaaaaguuggccagguguggccacugaugccuguaaucccagcacuuugggaggccaggguggguggaucaccuaagaucagguguuugagaccagccgggccaaaauggugagaccccgucucuacgaaaaauaaaaaaaaaauuagcuggcuugguggaggacaucuguaaucccaccuacucgggaggcugaggcaggagaauugcuugaaccugagaggcagaguuuggagugagcugagaucgugccacugcacuccagccugggcgacagagcgagacuccaucucaaaacaagaacaacaaagaaggcauagaacauuuacacuaaaagcauauguaucccuugcuauuugggaggguaggaauuuuaacauuaaacauaaaauaacugaaaagauuuuuaaaacauauuuacuguagucuaucuaaagcuauuauuauuacugucaucaugauuauuaucauuauuauuugagauaaggucucuugccguauaacccaggggggagugcagugacgugaucuuggcucucugcaaccucaacuuucugggcucaagugauccuucccucucagccucccgagcagccgggacuauagguacacgccaccacaccuagcuaauuuuuaaauuuuuuuagagacggggucucacuggucaccuagguuggucuugaacuccugggcucaagcaauccucccaccuuggccuccuacauuauugggguuacaagcgugagccaccgugcucagccuaaagcuauuauuuuaaauuaaaacugugguggguuuuuuuucuuuuuccccaagauuuaucauugaaaaaguagucaaaaagacacauaugaugacuuuucucuaaauggaacaaagcugacucagaaaaguaugcuaagguaccauaaauaauauaaaacuugugaucuaauuuuaaaaagugacauuuaaguuauugcagaaaauacacugagauauauaaaaugaaaauaaugggcuuagagaugaaaauuauucagagaauccauauuauacuuagauuuuuuuuucuuugggccaucaaugaucugcacacuaggagacuaugacauuaucgugaacaggugaaauacuuuauaaaguuagggagaaugaacucucaaguuaaaaacuggauguuguauuacagugauaagcucugauaaauauuuuaaguauuugagccauacagcaaaaugagugcauuagcuuaaaaccaagcaaacaaaaucucucuauacuuacuuucacuuugaaugacuaaaucuaauagagugggauaaaaaugccaacaacuaggaguagaagaaaacacauaauuucuacaggauaacggacucuaagcugggcacgcaggugguauuaauaaaucuugucugaguagauuacacuaacaaagacggcugaaaacuguauaagcaccuaacuagugaacuaucagguugccaaaagccaagccaaauaauugccaucuuuaucaucccaaauuacgaguaauuaucaguuuuuagagugguaaauuuaauaaaauaaaguagaaacaugcugaaauucugagaaaaguauaauauacaauauugaaauuauuuggacauaaauauuuuaauuauuauacagauuucuguauucuaaacaauuuccuaaaaauuuugcuuugaaguuaaaaguauugaaguuuuauuuuuauuuuuuuuugacagggucucacuccguugucuaggcuggagugcaguggcacagucacagcucacagcagccucaaccuccugauucaagugauccucaugcuucagccuccugaguagcagggacuacaagagugugguacuacgcccagcuaauuuuuguauuuuugguacagaugguguuucaucauguugcccaggcugaucucaaaauccugggcucaagugaucccucaaccucccaaagugcuagaauuacaggugugagccaccaugcucagccugaagauuuuaaaugaauucucuucaccuacacauuuucucucguuaucagugcuaaccaccucaucuuuaugcuacucagguaauuuuuacacaugcaauuccaaaaacagauuuuccuucuaucugcucucauccugcaauaugcauguggcaaaagugguuuuucuuaaaaauagauguccuagagcuauauccuagacccucuuuucuuuucaguuuuuccccagcucuaauuacuagugauuggguaacuugauuuagacuugauauuuacaaaaauagcacaaauacacagcaucaaccuaagucuuuuagccaaaaagccaagacuuuauuaaaaugcacacuagaauaagaaaaacaaaggacuagauguauacuguaacaaucccuaauuuccugagaagagggaaaaaaaagaagagggaaaaaagaugcacauuagcaucuuucuuacauaagauaugugcucagcugucacugacuggaagaaaaauuaacuugcaucauaauuuuuucuucgaauuacaggaauauauauuuuuuaaaaagcacauuauacuacuuguauuuauguagucugagaaucagauuuccucuaacuagcuauacugaagaauauuaaaaugauucguaucuucaagcagggaaaaauacaugggucaauuuuaacagcacuuaucuauauuaucaaggaaucugaguaguggaguuucaauauaaaaaagguacaauucaccaagaaguggauuuggaaacaaucuaaaugcuugacgaacuauuuucuggagacauucauuacaaaaacaauaaaaauuaaucagaaauguugaaaaaaugaaacuaucaaaguuucuuacuguaauucaucacacuuuagaaacaucaacacacuauuacagaaaaacacaaauuaacuucauaaaaauaaacucucuucuaagauuuagaaucuuaaaaacacuaucucaaaggauaaaaaucuguguagcuuuaagguaacaauuaaaaacguacucaccggaaauuaaagguaauucuguaagaagaaagaacauucaguuugaauguuaggauucuggauucaccccaguacaccgauaggugaaaaugaauaaagaagaaaaagaagaaaaguggaauaaaaauguaggugguaucgcaaacuaacaaaauguguauuaauuuaauucagaacaggaauugauccuugcuuucugaggaaaaaaugauuucauaccaugacuauuaaaaugauauguacuaugacagugaaauacuugcaaggcauggaauaaaauggaaguggaaaucaccaucauuuuuucuacaagccuuuaccuuuucacagguucugucuguacuagggcagcaucuaacauggcuuucauccacaacuccauuuccuuuccuguaucagugcagaaauaauagguccgcauguuuggaugggcugccugauugaaaaugacacgaucauuuuaaauaaaaauauaggauucuguaaaagaaaaagaaaaaaagguaagugauuccugacauagaacguugcuaucaaauuucagagaaaguagacuuaucuuuuaccugagauauggaaaugaaucaagaaaaaauauaacuauuaacuugaaaaauauauauuaauuucccccuuaauuuuacccucuuucuuuuaguugugugcacacucuaaaauuaaaaauaaaaaaaaaaaagagugcauggaaaggaaaggaggugagaaaugaaguacuuaguggugccucuuccaucuccacauuucuagcaauuuccauuuacugcaauucacaccuuuuuuuuuuuuuuucuuuuuuuugagacagagucucacucuguugcccagguuggagugcaguggagcaaucuugguucacugcaacaucugccucccugguucaagcgauucuccugccucagcaucccgauuagcugggauuacaggcaugugccaccaugcccaacuaauuuuuguauuuuaguagagacgggguuuugccauguuggccaggcuggucucgaacuucugaccucaagugaucugccugccucagccucccaaagugcugggauuacaggugugagccaccacacccagaauaagaauauuuauucuugaauaaauauucuuuauuuaagaauauucccagcaaccagcaacaaaauuaauagaaauguacauguuauggcauuucccuccugcguuagcaauuucuuuaggccucaaaaggcacugcuguauuuuauagaauccuuuauagguaucuacacccaaacacaaaagauuuauaaaugauccgaaaugguguuuucuuuuugagcuguuccuuaauaaacuacucaaauguucuauguuaagauaauuaaaaccaccuacaaaauguuacuggacucccugagugggguuuuggaaaaauaaagaccacugcccauauuugugaucaauguaaggaacacuggguugguaucaagacgauccaguucuagccaugacucaagacacuaagaauccccaccaugcucgccaucagucaaauggaaauauuuacuagaugaugucaaaguacccagucuagcuuuaaguuucaugcuuguguucaauaauugucuauaaaguuucuacuuaccauucugauaagcauuugcaacaaugucagcaaacuuaggaguaaagcagcucauacauucagaggaaacaacaucacagaagagagaaagugaaacagcaauuacuaucauuguuacagauaaaauuaaaacugaaccaaauaauugcagagaaaauauacuuaacauguauggucacuuuuauugcuauuuuaacauuguaguauuuuuuaagagucuaaaaacgcagaaaaaaguccuacaaauagcauaaauugauaaacauuugcuaaauugauaagcaacaaaaaaauuuaaauucauggccuaauaauagugcuaauaucacgcaccucuacauguguacuucauaaaguuauaauuuuaaauuuucaaaguguuaacuuuuguuuuaacaucauaaaauacuuaauuauguuucucugguuuauacuguugauacaguuuauuuugauaaaguuaauuuaacuaugaagauacuccccucuuauccuuaggucuuugcuccaguuacauuaccuucucauugaggccguccaucacccaaccccuuaaccucaccacuauaccuuuccuguucuuuuucuccauagcucauguaacaauuuuuuuuuuuugagccagaguuucgcucuuguugcccaggcuggagugcaauggcgcgaucucggcucacugcaaccuccgccucccagguucaagugauuuuccugccucagcccaaguagcugggauuacaggcaugugccaccauaccuggcuaauuuuguauuuuuaguagagacaggguuuuuccauguuggucaagcuggucuugaacuccugaccucaggugaucugccagccucagccucccaaagugcugggauuacaggcaugagccaccgugccuggcuauuuuuuugggggguugggggagggagggagucuuacucugucgcccaggcuggagugcaguggcacgaucucggcuuacugcaaccuccgccucccagguucgagugauucucccaccucagccuccccaguagcaaggacuauaggcaagcaccacaaugucugguuaauuuuuguauuuuuaguacagacgagguuucaccauguuggccaggcuggucucaaacuccugaccucaguugauccugaccugccucagccucccaaagugcugggauuacaggcaugagccccugugcccggccugcucauguaacauauuaauuagcaaaaguuauaaaucagcugcaguccucaguauucucuacaaguggugggaauuuaaaauugaaucaauuuuauaaugguacaaacauguucauuguuaaccagcagcacuuccccccucuuuucucuuaaaaugaaauuucugcaagaaccuuauaguuccuuacucuaaaacagacugaaaaacuaggugaccucugaaauuuauuuuagccauaaucauaaagcaaagaaugcagaaugauuuuugaaaacaaaaaucuccaaaaauagcauugaagaccucuuacuugagagugauccacaaaccaguaauaccacaaagauugguggguacuauuaaucagggaaggggaucucaggucugcuuggauuuaauaacagcagauuucacauccugacuucaguguucucuguaaaguacccgaugaucaugauguacuuagacccaagaacaucuuugcaauuauucucuaaguuuuucaauaaagguacauauauauaucuuuauuaaaaaauauuguugucucuuauaguacucuuccuccaaauuuauuauuaauaauuauuaauacagagucucacucugucaccuaggcuggaguacaguggugcaaucuuggcucacugcaaccucugccuccagggcucaagcgauccucccaccugagccuuuucuguagcugggacuacaggcacacaccaccacaccuggcuaauuuuuguaauuuuaguagagucgggguuuuaccauguuggccaggcuggucuugaacuccuggguucaagcuuucuguccaacucggccuccugaagugcuaggauaacaggcaugagccacugugcccaucuuauuaauaauuuuuuuuugagacagggucuuacuguguugcccaggccggacugcaguggcgugauccugucucacuacagccuugaccucccaggcccaagugauccuuucaccucggccucccaaguagcugggacuagccaccaugcccggcuaguauguuuuuuuuuuugguuuuguuuuguuuuguuuuguuuuagagacagggucucacuauauuccccaggcucaacuccuggacucaagugauccucccaccuuggucuccggaagugcuggaauuaccgccacugugcccagaccccaaauuuauuauuaaaaaauucaaacauacaguaacguugaaaaaacguauaauaaucaccaggacauccauaauuauauucaucaauuauuagcauucugacauguucauuuuaucuagaaccauuugaaagcacagacaugaagacacuugaccccuaaauauuuuagcacgugcuuccuaauuagagggacauucuucuauacaaccauaagaccauuaauuaauauauuuuaaauauaaaaaucacuauaagguagcuuuuuuguaauaaucuauggcucaauauccauuuuaaccaacgcaaguuuugaacacagaauuaaaaacugcauuauuuccuuaccuuaaaagcauauuugcgauuaaugugaucuucagagguaagcaaagcuaucugaaaacuagguaacaguaugcuucccaggauacccucuucuuucucaucuaagagauaauuuaacaucugauuagaauuuuaaauguucuuaugaagcaaaguuuuucaagaucuauuuuugccaaaucaaaagguucuuguacauaaaugaacuauauucauguucaggcaggccuuuauaagguuuuaaaugaaaauaucaaauagcacaagaauuuauacuuugguauauauacugcauucuacaaagccccuuuacaugucauucacugaaaaacauacuggcauauaaguaauggcauuaacccacccacaucucugauaggauuuaaaugcccaaccauucuauccccagacaaauacauggcuuucuugguuacauccuucaggcuuugcucaaaggucucaucaaugaggccuuccuugacuacuguauuuuaaaauguuauuuauuuaacguuuucucuguucuccuucgagaauguuaccauugccuacucucaauaccuccggcaaacuauauguuuuagcuauuuauuugcuuauuaucuuuuucuccaugcuagaauguaaguucuacaaagacacuuagaaugacagugguagaugcucaaaagaauuuguugaauaaaugaagacgacaugugaauacauauuugaacuaugcuauauaaauuauacgcuuuuuaaaacauuuaacuuugaaggucugcuuuuuacuaaucauucugauauacaauagugugacuaaauuacaggccuacaaggcaagcacauaaaauauaccuaggaaaaugauaaacauuaaucuugacacaguauagauucacauuauuaacuugcugcuugggggcagagauguuuaugaaacuugaaauauguacuucauuguuauagaccuauaagacaaguuaauaaagcggugucaucaggcuaauaaacucaccaaugagaaaucauaaaagugaaauaauucuuuuuauuauguuugcugugugugacuuuuuuguuuuuccuaauuaucaaaaacuuaacaugggauuuuauuuauuucgcccucauuuccagaguaucuggugaaacauccagaagggaaaaaguuacauuaaauggaggcuuuuuucaauagcuuuucucauagcaauggaacaaaauuuuguuuuuacuauucugugcucauucagguacgauucguuaaugcguaaaaggaugaacggaaguacagauuuaguccaaaagguuaaaaagaguuggaaagcagucaugaauuacagagaaugugacaauuuaaaagaauaagucaaacccuaauuuugaauccaauuuuauguuuuauguucauguaaaggguauagucacaaacagcacaugaagucaucuuuauuaaaaaaucauuuuaaucaaauaauacauccuucuaugucccauaauaaaauaaucuuuucuaaaguugcuucagaauagacagaggcacuaaagcacagggugauuucccuagauuacgugaggccguuuuccugccuaacacuaacuagcugugaaauccuugccaaguuauugaugcuuaguaucuguuuuaucaucuauaaaauugaggauaauaggacuuaccucaaaagauuguuaugaggguuaaaugaguuaauacacaucaaaaacagcacugagagugaagcauuaaauaaauauugccauuauuauauaaaaucaaagacagugcguguaaaaaaucuucaccuucuaucaaaugacuauccugaguucuucagcuucuuaaacugcuucuaaucaugacauucuucuguuuaguucuauaucaagccugauggaagcacuguccuaguuucuauuaccuagagagacucauagacugacaaagaguaaguacucaguaauguuuguagaaugaaagaacucucuauggggucagccgaggccuuucugagacugcauggcaucccauuuucuuuugucucugccauuuccuuccuucacuuugccacagcugaugguuccaagaacaacacucuccaaaaagcuuucuacauauuaaucuccaucacaaaauuugcuucguagggaagaugagcugggacaagagccguaagaaucucaacauuuuacuggauucaagugacauuuuagauuccccauuucuacuuaguuuuaaagauauuugggaauaucuuuagcaaaucaguuauuuucucugucuuaauuuccauuaucuguaaaacauggacugaucuccaaaaaauucugacaacacacuuuuuaugucaguagacuagaugcuuugagaaauggagaagaaaugaauggggccacugcccucagcauuuaagugaagaggauaucugagugggggcaaaaacucgugauuaagagaauagaaacuaacagugucagcucuggagucagagugccugaguucaaauccugacugugccacuugcgaauugugagaccugagguaagcacuuuguauaugaguuuccccucgcgugcaaugaacauaagauuccccacguuaucagguagcugugaggguuagauaaaauagagcaucuauauaacuugcucagcacaguacucaacaaauacuaaauaugcaaaaaaaaauauauaggcuauuaugaucucacugaaaucuaauuauuuuaauuuaaaaucuaauauuucuuauugauaaaauaguaaaaauguauaauaucauauacuucuuuccaacagccugcagagcagucaucugaaaugaguuaaaugauauuucucuuguuucuacaguuucuucuuuuuuauauuccccaucugggaaacuacuaaaauuaauaaauacauugcauauaaaaugcaggugguuaauaauaaggaaucucagacucagcauggcuuguuuuuuguuuguuuguuuuuccaacuucuauuauagguucagggguacacauguggauuuguuacaaagguaaauugcgugaugcugaggucuggaguacaaaugaaucagucucccagauagcacaguacccaguugguacuauguucagcccuccccucucuugugcuccccagugucuacuguucucaucuuuauauccaucagcauggcuucugauucacuuuuacauuuuugaaauaugaucaaaagcuuuccuauuauaguaaaagugaugagucccaccuuucccugagcaacaacaauagcaaauuacaaggaauucagugguuuuuguugcaaauuaacaucaauaaauucuuggcugggcaugguggcucacaccuguaaucccagcacuuugggaggcugaggcagguggaucauuuaaggucaggaguuugagaccagccuggacaacauggugaaaccccgucucuacuaaaaauacacacaaaaaauuagccaagugugguggcgcgugccuguaaucccagcuacuugggaggcugaggcacaagaaucacuugaacccgggagguggagguugcagugagccaagauugcaccacugcacuccagccugggcaacagagcaagacucugucucaaaaacaaaacaaaacaaaacccaacaaauucuuguauuagaaauuuaaaauauuagaaauaauaaacauuucuuguuauaaguaguccauaaauauacugaaaaagagacgagaagagaaauuauaagcuuaaggauaaugccugaaauacaacuccuaacuuucugaaagagugagaaaaccccuaagaaaaauuguagaguaagcuuagcauuuaacuaaagacaacaccgcaauugcagccuaaggaacaucucuaugacaaaaugcaauuuuauacgguugguuaauucugacucagcaguaauucucaacuacaauuugcagauggaaacaauucuaguaauuccaaauuuugaagguuaauauguauuacaaugcuucaauacacaacuauaaauuuugcuaccggucuuuugugcagucaaaaaauguagaaacugcuaaucaguucuaaaacucuguuauaucuuauaagcuauacuucuagagaaaagucauaaauuauuaauuauggcuugacaaucuaauucuuucauuauccaaaguuuaaaguagagaagaaggagagauuauccagauucaucauuuuauacuauagcugagacagacuuuuccggagagugccacccagguaugccuuucauuggcagguaacaacuuuguaguaucuuguaguaucuaagagauccaugugguguaugaaacaucucuggauuuuuauuuaaaacugaauuaauaauuuacuaaccagagaaaagcuaucaguguuuggucaaaaaaaaaguucaaaaugaaauuuguauuucacuuuuuucauuugccauuacauaauaguaguccuuaauauucuaauaucauuugcuggggagcagaauugggugcuugaaggacccauaagcuagaucugacaaaacugacaugugaaaagaaccuccucaaacuaaggauuguaucuauuaagcaccgaauucaagaguagcauuauagagcaaagauuagggaagcugaaccaaaacucagaccaaacacggucugaagcaccauauuuauucuaucauaaccccaaaacucagaaugauaugucaaaggagaaaaaaucuguuugauacuauuuguugauaauaaaauagcacacagaguuacaauacuuuuuaaaguaucugauacuuaacuuauauuacauaucaauuacaaaauaauacacuaagacaguaggguaaacuuaccucuauaauaaaagaggcaaaggucagaaagcacaaaccagcguuucuuccacaauuucaugccaguacuguccuggauuaaaucagcauauuuaaggauuauuucucaaacaacaaaaacucacaugugcauuuauuuauuuauuuauuuuuauuuuuuugagauggaguuucgcucuuguugcccaggcuggagugcaauggugcaaccucugcucacugcaaccucugccuccuggguucaagcgauucuccugucucagccuccagaguagcugggguuacaugcgccugccaccaugccagguuaauuuuuuuuuguauuuuuaguagagacaggguuuuagcauguuggucaggcuggucucuaacuccugacucaggugauccacccgccuuggccuuccgaagugcugggauuacaggcuugagccacuguuccuggccuugugcauuuauuuaaacuuuuaaaacaagguauguuugauacauguguaauauaaccuaucuaaaaggccaauuaaaaauuuggagguaguuuucuagggccuuagauauucccaacuagacuggucuccgaaaauaccaucaugcaaaaggaauauauuaaggcaauuugauuuggcuucguauuuguaagcaauuuggaauucacucuucucaacacaaacaucugcuaggaugagaauaauguaaccaugcagcagugcauguguucugguaaaccagauuuaauaaauauguuaaucuucaacaagaagagaaauaugugaauugaaauuauuccaaagguaaugugauuuaaaaugacuaugaauaaagaaaccuuaauauacaaaugcaauucauaaacauuuuuuucuuacaccuauaguuugggauuugcucaucaugcaaaaaagagagacuuuuuggcagcuauuucuaaguaauuuaguucauuaaaauaucaggcucaaacaaaauuagaauuuuaauaaaaauuacuuucccauaugcaauguagcaaaauuggaagugagaauuaaacagauaccaaaaaaaaagaaaaaagaaaaaagaaaaaacgagaggccaguuuggaugugcauugauuauuucuaaauuuauuucuagcugugaguaaugacuucagaauuauagaaauuaacauggguaaaaucuuucaaaauaaaagauuuggccuuaaaauugacagcuauaccaaaaaagaaaccaaaaaaaaaaaaaaaaauuaaauggcaaaugauaucuucaauuuuuuuuuuuuuccgagacagucucacacugucacccaggaugguguguagugcuacaaucucagcucacugcaaccucugcuuccugguuucaagugauucucgugucucagccucccgaguagcuaggauuacagucgugcaccacuacagcuggcuaauuuuuguauuuuugguagagacaggguuucuccauguuggccaggcuggucuugaacuccuguccuaaggugauccacccaccuuggccucccaaaguguuggaauaacaggugugagccaucacacccagccaucuucaauuacuucauuauauucuuucuuuaguacagauaagggacacuguaaacaaauaugugucacacacauauuacaaaauaaacacuuuuuuuuuuggagacagggucuugcucugucacccaggcuggagugcaguggcaugaucauaccucacugcaagcucaaauccugggcucaagugauccucccacuucagccuccggaguagcugggacuacagaugcacaccaccacaccagguuaaucuuuguuuuuuguuuuuuuuuaaaguagagaugaggucucacuauguugcccaagcuggucucgaacuccugggcucaagugauucuccugccucggccucccaaagugcugggauuacaggcgugaaccacuguacuaggcccaaaauaaacacuuguuagagaagcuacuugguaauacuuuugcaaugcuaaauuaaccaagggaucaagaaauaagaacaagagcuauuuuaaauaaggaaugccauuaggguaugaggcucaguuuugcacugaaauaguggaucauaauuuggacuuauuagaaagacuagcuggaaaauauggagaaaauuuucuauuagaaacugggcugggugugguggcucacgccuguaaucccagcacuuugagaggccaagguggguggucauuugaggaaaggaauucaaggccagccuggccaagguggugaaaacccgucucuacuaaaaauacaaaaauuagcuuggcgguaguggcacaugccaguaaucccagcuacucgugaagcugaggcaggagaauugcuugagcccgggaggcagagguugcggugagcugagaucacaccgcugcccuccagucugggcaggugacagagugagacccugucucacaaaaaaaaaaaaaaagaaaaagaaaaaaaaaagaaacuaaaugugcaaaaaccuuuuagccuggaaagcuuaaauaucagaugguuaaaauauagucaaugaucuuucaauaaaaauuaugacucaauaaauaaaaaucauuaggucaccugaaagcaaucagcaauauuuaacagaauaaacugacaccaaugaacuaauauuuaacuugcuuuguaucaucuguacguauauagaaucagaaagaaaaaagccuugaagauugaggaugucaccucaguuaucuaccagucacuuaucugaaaccuagcugcaaacugggaaguaaauagccucuauguaaucgaaaugaugucaaaauccaaggaaguaauguacauauauauuuacuaauugcaaaacuaauaagguuccaaaagagcuuagauagcaaguuccccagucagugcagcaauaucaaccaaucaggacgccugagaguaaacccuguaugagcaaauuaaaaagaaaagaaaaaauaaauaaccaaaaaaaauaagaggaagaaagaauaaucucauauuauagaaucaaaaaucugaaaaaacucagaaaaaucugaaauuauuguaaaauuucuguauaaaggggggaaauauacaacuguauauuucucuaacaauuuuuauaucaauagaaaaaugaguacccuuguauuaauauuuaguuguuuauuucaauuuugacauuuuaaaaauauuucugucuggauacuuuuaccaugcuauuucuaacauuuucauacagcauauauuuaauuuuaagucuagaaauacccauaacaaacacacaaucucaguuguaaguaauguccacuccuuuuucugucuucacuguucccuugauauucuucagggguaacaagcagucaaauaaccuggguggcuucuccauaguuccuucuuaauuuuaugauuuuauagaauugucuuagguacauucaguuuaaaagguuccuucuaauucugucuuuuguuucauaucaaaaaaaaaaaaauaccuguuuauaaagccaaccucgucugacaaccggugcauuaggauuccuuuuaauugaauuugaccucuuuccaaaauuaugaacuuuuuuugaagcucgugaagucuaaauagaaaaagagcaugacagaaaaugugguauuaaugccuagagauuugagcuuaucuuccucuuaaaauuuaaucucuuuucagauuuucccaagacuugcaggacuuaaaucuuuucagaaaaauuauuaaaauucuacuuuugcuggguuaguuuuuugaaguguaagaauuccgcaccaaaaauuuuucccccaggguaucacaaguuuuacaaucuuuccuuuaaaaucuggauaggauauacaauuuuuagaaacacagaguauguggcaguauuuuguccuaccugcuauauaaaaugaauagaucuugaguaaaaacuguuaacagaucuuuaagaauaaaccaaaugacagaacuuuucccuuuauaucugcauuuaauagugcagguucaauuaaagaaaguuaauggcacucagucugaggagaaauauacagauauuaaauauaaacaaauauaucacaucaagucaaaacaggacaggaaggaucugcuuaaugugauguaguguuuucuuuuuuauggacaacucugaacuuaaacuagacagaugggguuuacuggauucuucaaaauacacauaaggauauacagucuuuaaaaauacugcuaugguuaccaugaagauuuauuuuggcaggaaucauaauggugaccaacaaagaugaaaacaaugaagcuauaaaguaacauaaaauuaucucuuacuuuucuacuuguucagaaucuuuggaaauccagcauacuucuuuagaauuuuguuuugggaagcuuuuauuaguauauaagaaaauuuuaaggcccaauaucaacaaaauuuuuccuaaagcauguuuucuugauagauuuuaauuuacuuucaaacagguaaugcuuaaaaacaguauaaaacucaaacgacacaaaaagauacacaaagaucaaucuacucacucuugggcuccagcacccagcuagccccacucacaacuguguggcaaccaauaucacuguaugugugugccuaucuaucuaaaauaauuguucucaugauuaaugaguauuuuucugaaaugacugcauauuuuaauauccacucuucuguuccauuauuucuuggagcucacuauauaaaccgaaugccuauuuacccauacuguuguuagugugcuguguuaugaaacuuucugaucuuuggaaaucugcagguggaaauggugucuuuuucugguuuuaauuaguauuuuucauauuauggaugaggcugagaaucuuuuuucauauauuuaagaguaaauuccauuuucuuucccgaaaacugauuucauauaauuuuuccauuuccaaacuggcucauaagcccuuuucuuauugauucacagcacuucuuuaauuauaaggaaauuauucuuuaauuguuauaugaauuacagauacucugcauggauaauaauuacgugugguugaauuucucauuauuuuauauuguuacuucugaguuuuaugucauauuuagaaagcccaucugcauucugagcuuuucuuuuuuuuuuuuuuucaaaucuuccauuguuuuuuucuuaguuuuguuuuuaacauuucaacaacugauccaucuagaaaauuucugguguaaaguaugaggaacagauucaacuuucuuucaagacaaugaccuaguggcucucaauccauucaucaauuucuccagauuuuaauuaaaauauacucauaaagcauuaugcucaguuagccuguuggauuuauuuuacuuaauaaucagaaauuauuuauauuacuugaaaauuuacauucauuuauaaucuccuaacaaaauuuuauuucaaaaaccuuaacuggcauuuaaaauacuauuauuauaauuaucuuauaauuaucuauuuccuuacaauaaacauaauauacuauuacaaugguuuugcugaaaaauguuuucuccaucuaagcauucuuauagucagauaauuugauuucuaggcuauuacaugaauaaucaccuuuaaaacuuaaguguacccauucucucucacaaauaucaauguauuucuaaaauuauuccaaauuuaaaaauuuaagucacugaauuacaaucuuauuacuuuguauuucgggcuguugcuucuuauaucaauuaccuucaaauucauguaauaauaaaaauguaauuauuauucuauacuuuuaaguccauuaugaguaacgguauagauacuguuuacuccuuaucaauaauuaauauaaagcaaaauaacuuacucugccuacagggcucauuggaugcacugcauaaucugaagucacguuauaguuagaagcuucauuuaucauacuuauuggccguuccuucuuuucuucagaugucaugguugcaacaguccugaaaauauaugucaaaaugcuagaacuugcuguguauguaacccgcuuuauaauuacacuucucuacaguuaacaaugcgaguguccuacuuuuucacaguacuuggauccuaguuacucuagagucaggccuuaauacuuacaacaacuuuaaauacagcuaacgcuuuuccuaagccaaaaauacauuauuaucauguuuauuuauuauuaguuuuuaagacaagagucucacucuguugcucaggcuacagugcaguggcguaaucuugguucacuguagaaucugccucccagguucaagugauuuuccugccucagacuccucaguagcugggacuaccagcacguuccaccaugcccggcuaauuuuucuauuuuuuuaguacagucaggguuucaccauguuggccaggcuggucuugaaugccugaccucaagugauucgcccaccuuggccucccaaagugcuaggauuacaggcgugagccacugugcccggccuaucauguuuauuuauaauaggcauuauugcagauauucuacuuggucacccaacugaaaaauuaaaaaugaauuaugagauuauucuaauuuuaaaaacaauaacaauuucaguaacuaacucugugaauagcuuuauaguauaauacauucuuugaugcuuauaaaacucuugugaaauaguaauuaccacuaucugauuuaaggaugagaaaagugagcucaaauuaguuuaauaaucuaaccauuuacacaguuucucuaagcuugcaucccggguucuugagcuuacugcguuugaaguacuauaaaaacagcuucugaaauuacauucuucaugaaaaaaauguuuaacucagguuucuauaugacacauugugaacagcuggcauucuguuauuauacuugacuacaaauguccagauaagaaaacugcuaaauugaaauauaaauaacagcaauuucaaugcuaacccaauuuugaauacaggcauuccaugaaacucuuuacuuacuguucauucacuacaaaaauacaauuguccugugaugguuguccugugacuggauguuugcaggucacuuuccuuucauuauggcugaaaaaaggaaaaaagaaaaacagaacaugcagguauuuaaaauucccauuuauuuauuguaacauuagucuacaaaggaaaugaaauucaaacuuccagccuuuuuuuuuguuuuugagacggaguuuuauucuugucgcccagguuggagugcaauggcgcauucucggcuuacuacaaccucugccuucuggguucaagcaauucuucugccucagccucccaaguagcuuggauuauaggcgcccaccaucacgcgcccaguuaauuuuuuguauuuuuaguagagacaggauuucaccauguuggucagguuggucuugaacuccugaccucaggugauccacccgccucggccucacaaagugcugggauuacaggcaugagacacggcaccuggccgccagccuuuugagauuccuaaauauaucuuuccuacuaucuauugagaguguauauguguguaaauguuacuuauauuuuuacaaaaaaguuaaaugcaucccuucucagucuggccucaauccuuuuucauuauuuuauaaacaaagguuaaguuguaggccaggugccauggcucacgccuguaaucccagcauuuuggagcgccaaggaagguggaucacuugaggucaggcguucaagaccagccugaccaacauggugaaacaccaucucuacuaaaaauacaaaaauuagccaggugugguggcgugugccuguaaucccagcuacucgggaggcugaggcaggagaaucgcuugaaccugggugauggagguugcagugagcugagauugugccacugcacuccacucugggcaacagagcaagccucugucucccaaaaaaaaaaaaaaaaaaaaaaaaaagguaaguugauuuggcuguuuagcucuuuacacugcauuguaaaauacaaugauuacuguauuuuacacuucauaggugggucaugaaaaguaaguaugagugucuacuuaccuccacuguuuuaugguccaacaugggugcauuacagaguacuaaugccaaauucauaaauggaaagaaaaccuaacaguacuacuauaugggcaccaguaccuuaaaaaaauagaagguucugaaacaggaauaauuuacaguguuucuguuuuaaaaauaaccuuuauauagauaauguaaugagauuaauuuuuugacacuugaggaagguauguuguagaaaaaaaugaaaucugaaggagaagcaaaaaucuuaaaugaaauguggaaacaacaacaaaaacaaagaaaaaucuguuauauuuacugaaaaaaauugcuuugaauuaaguuaugacuauuuuuggagaaaaagauguuugccuaagaaauaguauucuuucuagguugaaugauaagauuaggucuucaacugucuucuugaaugaaagaaggaaaaaaacccuauuuauuuaagccaaaaauauuagaugcucaaaauaauaugcaauauacauugauauauuaaauagucuauaauaauuuucauuaagucauauaccauaaaguaaucuguaacagagaccuaucauugacaugccugacauuagaaaauuuaccuuguaaggucuguauugaauauuaguuuucuuuuguuaaucuuaaaauauuaguacaugugcuguguauggugagaagucuauaaccacaaccugcaaacuuccagguaaauuucauaugcuuaaguucuuuuuccaaauccuaauuuucauauuuuuuuggguaacucaauacucugaagcuuuauccauuaaauaaaauugaaacaguauuaauauaaagauauagauaguuuuaaaaaaauuccauauugacuauuguaagaguagaaucauuaaugaaacauaguguuucuauuauuccuuaaaucaaguagucuaagaagcacauagagccaucuguuaauauuuagaaaaaauuuaauagauacagcacuugacacccugggagguagcuggcucacuguuagguccugaccauugucuuggcacaacggaggaguggacugcucaggaccacaggaagggcagggaagggaagacaaugauucuagccuuuucucaauucuaccaaaguuuguccccuguauuauuacaaauuguauguuuuuaucuuagagcugccauucuuuucugcauuucacaaguuuuuuuuuuuuuuuuuuuuuuuuggaugggccucaaaauucagaucaagagaaucaucaguucugcuauaacgcuugcuggaacuguuucaacaugauuuguacguuaaaggaacaauuugagcacaacacaacuuggcauuugcuuaugcaugauuuuaucugugagagacucuagauggaugcaaaaaacugcacccaacaaaacccagccauguaggaauacacaaaauguauaucugcacacaccucaaacauguaccagcuacuucaguucacugccuguuuuaugaaacacaccuauccucaucuggugauacaacuuuuuuuucuuuucuuuucuuuuuuuuuuuuuuugagacagaguuuugcucuguugcccaggcugcagugaaguggcgcaaucucagaucacugcaaccucugccuccuggguucaaaggauccuccugccucagccucccaaguuagcugggauuacgagcgugugucaccaugccuggcuaauuuuuuccauuuuuaguagagaugggguuuugccauguuggccaggcuggucuugaacuccuggccucaagugauccaucagccuuggcuucccaaagugcugggauuacacugugagccaccgcaccaggccuacagcuuucaacucaauuucagauaaccuuccucccagcaccucccaauaauucacaugcugaaacccuuucaacacucaguuacuuucacaagcaaaaugcgggucuuuuucaaggccaaaugucauauuuauuaugcuaccauuuuuauucgguuccuaucuuuauucccaugugucacuaaugaaguuuuuguguagugugcuccuagauccauuuuccccccaagcccugcguuuuuuguuuccagauuuugcaugaagaggugauuuuuagggacacacaugcuauauuuuugcaauacguauugcacuacuaaauuacaaacuaacauaucacuauccuauuaaaaaugcauuagaauuuuaacagacacugaaacaaggugucacuuaaaaaauucuugccagauauuuuaugcuuaauaaaaaccgagaauaaaaaaaaguauuuaaaaaauuuguauuucuagaagaauccuuauaaaaaggauaaaauucaagucuuuauuuuuuuuuauuuuauuaucuuuauuuuuggagacggaguuucacucuuguugcccaggcuggagugcaauggcacaaucucagcucacugcaaguuccgccucccagguucaagcgauucuccugccucagccucccaaguauuugagacuacagguaugcaccacgacgccuggcuaauuuuguaguuuuaguagagagggguuucaccauguuggucaggcuggucucaaacuccuguccucacgcgauccacccgccuuggccucccaaagugccgggauuacagguaugagccucugcgcccggccaaauucaggucuugauauaauacauaccuauggucacagaacaaacuaauucccaccuugucucuguagucacuguggccuaguaggaaguccaaacuuuucuaaauacaaugccaguguuuaccuacucuuacuuccagacuuuuaauauauaggucuagacaagugguucucaauugggugauuucgccuccaggggagcauuuggcaaucccugguaacauuuugaaugucauaacuggggaaauguuacuggugucuaguggguagaggccagggugcugcuaaacaguuuauaaugcagagcagagcccuccauguccaaauaaaccuccagaaaggucagcagugcugagggugggaagcccugcacuaggcuaucauaacccuuaaaauaacugacucgacugaauaagaaaagcaauauuuacuauucguguuccuguauuucuguaaacacaacagagguagcagaaaacaauggcaguugagagcacaguuucugaaaucagacuacauagguuugaaucccagcuccuccacuuaauagcuaggugaucuuuggcaacuuacuuuaccucucugugucucaacugaauaaaggcagcuaugucacagguuauuccuucauuuagucagcauauacauguauauacacacaaauauuuucaaaaauauaacaucuauauagacauauauuuauauacaguaguccucccuuaucugugguuuugcuuucuaugguuucaguuacccucagucaauugccgcccaaaaauauuaaauagaaaaucccagaaauaaacaauucuuaaguuuuaaauugugagcuguucugaguagugugaugaaaucucucuccauccugcuccaucccaucuaugaugugaaucaucccuuuguccagugucucuaaacugucgaugcaaccugccccguuaguuacuuaguaguuggcuugguucucagauuaacuguugagguauugcaguuuuuguguucaaacaaccuuuacuuuacuuaauaaugaccccaccccacccccuaaaguacaagacuagugaugcuggcaugcuguuacacuuuuauuaguuauuguaguuaaucuuuuacugugccuaauuuuuuaaaaaacagagauggggucuugcuggguugcccagucuggccucaaacuccugggcucaagugaucuuccuacuuugguuucccaaacugcugggauuacaggcaugaaucagcaugccugucccacugugccuaauuuauaaauuaaaauguaucauaaagcagugagaaaaacauaaaaaauccuugcccucauggaacuuacuuuauaauagaagcuguagaaaauaauaagcacuugauaaauguuauuuacaauuauuaugaacugcaggacauucaguauaugucaucauuauauuaguauuuggucaauuauuuaaauuaaaaguuuaacuucgugccuacccauacagucaugugucacuuaacuaugguaauacauuuuguuuguuuguuucaucauacucaaccccaacuauggugauacauucuaaaauauauuaggugauuuuaguugugugaacaucauaaaguguauauacacaaaccuaguugguacugccuacuauaaaaauagaaaauauauuuauauauaaaccuaggcuauauaguauagcuuauugcuucuaggauaaaaacagguaacgcauguuacuguauugaauacuauaggccauugcaguauaauguuaauuauuuguguaucuaaauauaucuaaacacagaaaagguacauuaaaaaauaugguauuaagccuguaaucccagcacuuugggaggccaaggaggguggaucacuugaggccgggaguuugagaccagccuggacaacauggcgaaacccugucucuacuaaaaauacagaaauuagccaggcauagugacacacgccuguaaucccagcuacucugguggcugcggcaugagaaucgcuugaccccaagaggcagaggcugcagugaguugagauagugccaaugcacuaaagucugggcaaaaaacuauggcauuaaagauuaaacacucuaucccucaggccauaaugcagugaugugaacacaacucucugcagccucaaccucccaaguucaugcaguccucuuaccucagccucucaaguagcugggacuaaaggugcacgccaucacacccaccuaauuuuuaaaauagcuacuuaggaggcugaagcaggagaaauguuugagcccaggaguuugaggcugcagugagcuaugauuaccacugcacuccagccugggcagcagagcaagaccuugucucucucucucucucucuuuuuuuuuuaauuaaauuuaaauuaaaaguuaauuuuuuuuuuaaaagcacucuguuauucuagagcuuccagggcuaaagaaaacaggucauauuuacaagcucaacuugaugauuaugcucuacuaaaggucagcauaaaaugaacgaaugcccucacccccuaccuuuuuuuuuuuuaaaaaaagaaaagauaccaaggaauugauaaauagcaacacagauugcuugggcuuggcauuguuuuuuuccuauuuauuaccagaguuuuaaucauuuacuacaaucagaagaguaaaugaaaggccugauacuuuaaagcuucuaugaaacuauuauuucauuuaauaauaauuugguugugaaggauuuuaagaugacuaaaucaguguguauauaaaaugguauauauauuuccaucaaacuguauaacacuaaaaugacaugucuacuggagauaaaauagaaauucauuagucuaccuaauuccuuuuccaaucuuauguauuuuauaaaccaaauaaugaauuacguagguaacuacuggaacaccugggcuaugcugaacuuuuaagcagacaucuuaguucugagcuuucuggaagcuuagauaaaaagagaaagcuaaagcacacagcuccuauaaacuacugauggaaggaagagcaauuuaccagguuuaaaucaacuuuaagugacagguuucuuuuauauaaauaacuaaaacuguaugacagcacucugaaaacgggggaagcuguuguuugccucccuuuccaggguaauuaaaggaagauacuuuucguagagucgacauugcuaugguuuucccuccucaggagacauacaaaggaggaugccaauggcauuccuuaaaaaacaucauaaccaugcacacauucucucaugaaaauaaacgcauaaagugcacauuucaauauaaaccccaauaaaaauaggcaauuagaaaaaaaacuuguuuguuaauaugguguuucaaauuuccaguuaaaauaauaaaagcccauaaaagugaggggccuauuucauucuuaauggagaguuacuucaaauuauacaaggaaagaaacuaaaguauucaauggaauuaaguacuaacugacaaaagaaauuugguauuaagauuccuguuauccaauaagaccaaaaccaugcgaaacuucauugaaugcaaaaaucuuuuuuuaucugauaucuauagguaaaauacccuuauuagaaguuauuuaaaaaucagaauuugauuuuuauagaaaugaauccaguacuaaauguacuagauuguuuuuuuuuuuuuuuuggucuugcucuguugcccaggcuggagugcaguggcgcaaucucggcuaaaugcaacauccgccuccuggguucaagcaguucccugccucagccucccaaguagcugggauuacaggcgccugccaccaugccuggcuaauuuuuguauuuuuaguagagaugcgguuucaccaucauagccaggcuggucucaaacuccugaccucaugauccacccaccucagcaucccaaagugcugggauuacaggcgugagccaccgcacccagccuuaaauguacuagauuuaaacauuuaaaaauucaaguaauguuacauauauauaacaaagcagcaagccaggcgcaguggcucaugccuguaaucccagcacuuugggaggccaaggcggguggaucacgaggucaagaguucgagaccaucauggcuaacacggugaaaccccgucucuacuaaaaauacaaaaaguuaaccgggugugguggcgggcgccuguagucccagcuacucgggaagcugaggcaggagaauggcaugaaccugggagauggagcgugcagugagccaagaucaugccacuacacuacagccugggcgacagagugagacucugucaaaaaaaggaaaaaaaaaaaaaaggcaguaaaugagauauauucuuuaaaccacauacggaaagaacuauuuuaaaauaauacuuaugauuucaaagagaugaugacucaggauugcuuaauacugcagcacugccaucuuuauuggguugcccugugccuuuuaguuaggcauccucucaagcccaagguggcugcuguaucacaaagcaauacucugaaccacgaagucuagaguuaaaaggaagguuuuuuuuuuuuuuuuuuuuuuuuuuugacagucucacucucguuccccaggcaguagugcaauggcgugaucucggcucacugcaagcucugucuccggguucaagcuauucuccugccucagccucccgaguagcugggauuacaggcgccugccaccacgcccggcuaauuuuuguauuuuuaguagagacgggguuucaccauauuggccaggcuggucucgaacuccugaccucaggugaucugcccucuaaguuucccaaaaucucccuggccaucuuucucaagaaucucacuagucagagauaugagauucuauguccaauucaaccaacggcaaaauaagugggacuacuauggugagcgagcuaacuccagucaaaauucacaacuuugucuguggccgaccuagaggaaacugaauaaaaugcaguuauauuauaauagcaaggaaaaaggggaaggaagaggcuauuagcuaagaaauauucuguuuucuuagacaaagcaacuuacacaugguccaaagaaaauaucugcgcuagcauauucaaaaguagauuucucuuguuuuauaugguaaaagaggaaaaugguuuuacuaguuucuugcuuugggaagguaaaaggguaauuuaaccugaacuucagaccuuuagagauuuuguuucuaccuucagaaaaauguuuuaauguuuuggcuacacacuaccuuucauaaugcaauucuuccuugugggagcauguguuuuuggugggguuuuuuuuuaaaucucuauuucaugggcaacuucagugacaaagcaguuaaaauccacucugcuuuuuaauccaaaauccacucugcuuuuuuaaaagaauauugaaauugcuauuaacauauugccaauaacagccaauacuauucuucugagugauccauuacagucaggcaaagcaaccuuuauuaugcaguguuucauauauguaaccaugguaauaucguugaaaauguaucuacugcgcaaaacgaguaauauauauuuuagaaucccacagaagagauuucaguuguuucuuacuaaacucacauguguacccauuuauaugauuugcucugaaucauguauuucccuuaagggaaaaagaaaaagauuuaauuuaguuuaagaaaaauagaauagcauagugguuuggcagcugccauuuggcaauucuucugccacuccuggcaacaaaggccaguaucaugacuuggacuuuugcaaaggcccaacccacaaaagcugccacacauccacaauaauguuagacuggaguggggcagaagagguguggaaacuauggaagcuacuguauuucucuaugaagaaaacuaugcagcaaaaagcucagaugugugcuuuuaacuuguguuuucaguauccuucuagugaaaccaaaaagaguaccauaauuuuuaacuauaauuuacuagcuucuuaaguuggccuuaguuucauuacucuauuaaaaacaauuauacucucuagcuugccuuaaaauugaagagauuucaucaauagaaaucacacagugucuuguaauuuugcaacucaaacaaucaaaucuuaauuagguuuaaaaaacauguuuguagcagccauuuaguuauuaaaucaacucagccuaugcuagucaaguaauuuaaaaauuauuauuaaauauaaaauuucuuaauguuucacauagauaacuuuucauuuacuuucauuguaauaaaaaggagaaaaauguccuguugaaaucuggcugccacaaagacaguuucugcaauuuauuuuuaaacugaaaauacgcuggcauagaaaauugugccuacaauuaaaggcaauguuuuaagaacaaaagaaaaacauuaaaagugcuuugccuuucuugaaacugaauucuugaggcuuuuuuaugugaagaaauaaccacugaguuagcaaucucaaagacuguaauuuuuuuugagggguaaaacaugaaaaguauauauuuccuuuccccacauuuaguucuaaaugucauuugccuuuaacuuagaacuaacugcuuccagacauccugcucaaaccucaauguuucauuuacccaccaucuacaaauucuccuuaaggucuuaacccuuuaauuucuauucuuucuccucucaucauuuagaaaacggauaauuuccaauuucuugggagaaaggaagggauuaaucaggugugaaaaccucacucaaccucaccuccagcaauaaauauuaugaucaccaccauaacagcuacccuuaagcauuucagugcuacucacauauucagcugucacguaauggccuugacaauccucacagagcccauuugagguagguguuauuauuugcaguuuaugaauacauaaaccgaggcucauagcauuuagaaaguugccagaagucauacuccaaguaggagugccuccaaggcuugagcugcuuuccuuuucagaucccaaccuuucaacagcugccccuuucuccaacucuuccacagccaaugagacuucucaguucugccuuucaucuucuguucaaugacacuagaacagaauaaagccauacuuuccuuagaggcccuuuccuucuuccacugacagcagaugugccaugcacaugcugccucucucacugcuccucuucccuccuccucucaucucacugccuaccaucaccccaggaucauuucuaucugaagcacaguaaugaaagcuuucccaauuccaguuuaauuuuaaacccaaugccucucauccuuggaagcuucauaaucauuuccuacucuuagcuguucagacaaaauuaccuccaaaacagauuuagaaauguuaccucacauuucuaccauuacagguaucaaagaauuuaaauacaaauaauaacaauuauaaagcauguguugcacccaacaggaacugaaaaucuugcuugacucagaagagaugacuuaaaccccagugagaaaauaugaguaugauguaacacuguaaguacaaagcuaaaaccauuauuauagacauuaagaacauuaaggggaaaaaaauuaaauguucaaaacauaaaaagcucacaugccaacucaccuguuuuaggauuugguuuuucacugauaauuucuaaguuaucuuucuuaaaagcucucuuaaauaaaaccagcauacacacugagaaucuacaaaaugggcugggugugguggcucacgccuguaauucuagcacuuugggaggcagaggcagguggaucaccugaggucaggaguuugagaccacucuggccaaaauggugaaaccgugucucuacuaaaaauacaaaaauuagccaggugugcaguggcgcccaucuguagucccagcuacuagggaggaugaggcaugaguauugcuugaacccaggacgcggaggcugcagugagccaagaucgugccacugcacuccagccuggaugacagagugagacucugucucaaaacaaaaaaaacaaaaaaaaacaaaaaaaggaauuuacaaaaugaacaccuuuuaaugaauuuaaagcaauuuugaaaguaauguaagaaugauucaauuaacaccaugcuaguuaaaauguaccuaucacauccaucccgaguauuacagcagaguuacauuuuagaucacuugauaaauuaaaagcaaaagugcuuaacauaauuuagauaauucuuucaccuguaaguaauuugagugaaucugaacuuaaccauuuaagagaaugggaagguuaacugguacuauaugguuaaaacagaaauaugauucuuaaaauguacacacuaauuugccaaaguaauuuucugccaaguauucaagaauuaagugauauugacugcuaauaacaucucagccacugugcaggcgcauaugguucuaagacucuuuuuaaaaaaaaaauuguauguauuuaucuuuacaauuuauuuuucuuuucuuuuuuuuuuuuuagauggaaucucacucuauuacccaggcaggcuggaguacaguggugugauuuugggcucacugcaaccucuaacuccuggguucaagugauucuccugccucaaccucccaaguagaugggauuacaggcaccacaaccaugcccagcuaaucuguguauuuuuaguagagacgggguuuuaccauguuggccaggcuggucuugaacuccuagccucaagugauccgcccgccucggcuucccauagugcugggauuacaggcaugagccuaucacacccagcuauuuuuacaauuuauuuuucaacugaaaaauuaagacaguauguauuuaucguguacaacauaagacucucuuaacagcaucugaauccaccucauuguaacaagacucuucacuauugagucuauccuccaagcugagcuucagcuucuuucuguagaauaggaauuaaaaccaaaaaaccaaaccagcagcacaacaaaaccccuaccccuuuaaaaggauaaauuaucugguuacacaucaaggcauauuagcuggaucuaauagaguccucaccauauaacagcugaacuugaauguguuaguagaaucagauuucuuaaaaacaaguaaauuaugucacuuccuugcuuuaaauaauuguugguucucugcaucaucuuuaaugugaaguauaauggcuugcauacaacuguaauuuaaugaauaaggaacacugauaaugugauccaagguuaaaguuuacuguugaaugauauauggaaaaagcacuuauaaagccacauaacagaauaaaaaugcucacaggguauauuuuagcggguuaaaaagaauacuuacucgaaaaguugcagagucacuuguauaaaaauauugugucacaagagucuuacugacuuucaaaauaaaacugggcagaacccuaacucagaaacauuucaauaaucagaaauauucucgucauuuaaaagcaauaacauggcauucaaaaauauacacagccuguaaucccagcacuuugggaagcugaagugagaggacugcuuuaggccaggaguuugaggcuagccugggcaauaaagaaaggcccugucucuuaaaaaaaaauaauaauaauaauaauuaauaauaauaauauuaaaacuuagccaggugagguggugcaucccuguagucccaguuacucaggaagcugaggugggaggaucccuuaagcuuaggcguucaaggcugcagugagcuaugauggugccauuaugcuccagccugggcaacagcaagacccugucuuuaaaaaaaaaaaaaaaaaaacucccuaaugaaugcuaauuuguaauauuuuauuguaacaugcauuauauagaaguuuauuauaccuuugggaaggaagcaaaaggcaaauuagaaaaaguuuaaguauccacucuuuugcguguggucacacuccacuuuagaaaguuaaccaaauuauaaccuauacauaaauugccacacaauuuaaagagauccaauuauuuuauuguagauaaaacacauucuuuccaguagagucaaacugacagaguaacaguucaauucaaaaggggaaaaacugcuaaucacuuauuccguaucgugcaguauucauuuucauauacugcaugagcuuuaaacaauuucuucaagaauaaaaaaggagcugacucauaagucaaaugauauuccuaugauacaaaaagauuuuguaaaaaacguuuggcuuucuuucaaaauagcuaucuuguagcauaacaaacacuuuuauucauucuauaugugcuaggcacuggugacacagccuuaauaauaucacaaauacaaauaaauaaacaugaagagucucauaaccauaaacaaaauacaaaggggaaaccgauuagggauugaucuugcuuagaaaggaaaagagcagagaaggcaucacggaaguggcuaccauuugaauugagccugguggaaucagcgggauuagucagauguggcuggaguucagcacagauugaagcuggcuagggcacaaagaaaugugguugaaaaucuaggcuuugacuaacaauauguuuauguauauaaaauguguuauauaaguuuugaaacaauguauuugcuccccuccuagguuuucuuuuacuucaauuccaaaauaauauauuuguuaaaacucugaaaaggcccagauaguaaugcacuuuaugugaugcacauaacaccuaauuuagguucaguuuagucaacaaaucauuauccucaagcacugagaaauuucucacuugcagaugaggcacgagggggacagaaauucaauccagaauagcaggguaaguaacccaguuuccaauagcagugacauugugagcagagugggcaauaacuggagacauggggggaaauccaauggccacuacaggacacugugauggcaauauuucacucuggagacacauuuccuuccagcagaguacaacgcagggcaugcuaucaacaggcuaguuaacuagcagguuuugaucaucagagugaagauggaaucucuacaaugcaaagaucaagauauccuccucguauuuaacuugcuuugccaauucauuucuucguguugaaauuauuuauuaagcauccuauauauacaacguuuuguacugucuaccacaagggaacaaaaauauaguuuaagacuauaagggccuuaagaaauacuauuccaucugaguuuacuaggcuaaacuucaaacaaagaagaguagcacaauuacacuuuuucaagcagucuauaguauugguggaaagcguuccucaaagcauaccuuauucacuggaaaacagacaagugcucuguuuuacugcuuuauucuugaguaaaacuuuuauguuaauuucaaguuauccccacagcucugcucauugcccucuuccuuuuuuuuuuuuuuuuuuuuuggccagauuuaauuuccuguucauacaaaaaaaaguugaaauaguuucucuucacuugaacuuuaguagcaacccaugaccuaugaugucauaaugucucaaaaacaucuuuguuuaaaauguauacugaauauuccaauucaucaucaccacaguaacuuaccgauuaaguuuaaaauacagacuuaaagccacguuaaaacauuuucagcggauucaagauaaauuuuaaaagggaauagaaauauuccucuguauaguuaaauuggguagaaucuuaguuggaaucugaaaauucugcaacuuaaggaaaaaauuguggcucuuaaauuaggacugucaagucaaauagagcaaacuugaaacccuacuucuauauuucaaugcuucuaaguauagauguauaauauacugggagucauaauaugaagcaguuaguguuaauuccuaaaacuuguuauucuuuuuacauucacauauaaaaagcugauuuagaucacuucaauaccuaacuauauuauucacaaaaaauauguacagcaagucauucuucaacugcuucagaaaacugaagugaaaauauuuaacauauuuaguaagaauuuccauaucauguuuuccucaucuagacuugaaaacuagaguagcaaacaaacaaaaaacuagaguagcacaauuauaagaaaaaaacuaaucuuuuuuuauucuuuaagaaaaaacuuuggaaauucuucuaaaagaccuugaaaucacaaugcugcugcugaaaaugcaagaaaacaauuaugcgagaaauagcaaaauguaagacuuuguaggcuuuuguuuguacaauauaaauagaaugaaauuacaauaauaucauucaucccuaugaaauagggaaaaagaauuuauaagcaaaauagcuaugucuaaaaacaaaagaaaaagcuuacccaacauaaccuacuuuuuaaacuaaugcuuuuaaaacaacaaaaucaauuuacauaguacaauucaaagaaacaugaauugauauuauuaauaauaaaucuugccuggccucuacaauuaauagcagaacucuuaauuucuuuaaaaaauuaagaaacuucuuaauuucuuuaaaugcuaaauaaaauacgaucuguaauauauaaucuccugccauuauauugcucuuaaauuuuaagucaauaaacauuccuacuuugaaucauaucacugauauggcccaaauaauugaagaauuaaagacauagcagcuucuauuaauaaguuuagacuaguaucgauauaccuuaaaaaaaauuacauaaugcauacuguuaguaccuccacaggaacaucugaggaauuauucaucuaauuaucuuuggaggucuaggggcaaaucaagcaucuucugugaguaaguuaaaaauaaggaacaauaagauuuuaaauaaaaaucuuuagguuuuaaagcaauuugugacuacuauguauucauguagccuaaaguuaaggagagacuaagaggaagacauucccaaugcucaaaucuuaaaauguucaagcauuugcaaaccuaaugaauauacuuauauuucuacaacaaaacaauacuuuguuuauaaaaauauuuauaguauguaaauccuuugcacuagauauuaugccuggcaccagagcuaccaagauuauuugccauaggaucauuaacugaggaaaaggacuacuguucacuuagcuauuagcuauuuauuauuaauacauuaaaguaacaagaauuacucaccagccuucaucaaaaucaauucuuaaaaggauauucaauuacaggcaaaaagaacacuggaguaaaaauaagacucaacugcuuugucuuugagcuguucucagugagcacuguggggaugaagcacugaggaaauacacugugguugugaggcuggccugccacucuggaagucugacaccagacugacgucacaucagaacaugucauugcagccgcaaauuaaggcagcuccuccaggaagaaucuguugugauuaugcaugccuuccagccauaagaguaaaauaugauuucaauucccuuaaaauuggcauauagcauaggauaaaacacuaagauauauggaugcaaauaguuacugaagaaaacguuuacugaguauuaaaauaaacuuagcucuaaauaaaugcauauuucuuguuuaaacuguaagcaccccaacuaaaaugacucuaaaaacaguuuuuccuguuuuuuccaagaugauauauauuuguuucaaaaauucaagcaauaaaagguauacaaaaggcuaaaauugccuggaauuccaccacccagaaacgaugaugaugguugcucaguuuuauugaucacuuacuauguuaagcacuuuacaaauucaugugagccucauaacccaacaagauagauucuauaguagugaucuccauuuuacugaaguaacuaaggcacaaaguaguuaaguaauuugcccacagucacaaugcuaauaagugauuaaauaggauucaaacccagguagagugccugcgcugcccagacauuugauuaccaacguauacuaacuagcagaaaagguaagaguuguuaacaucguggugaacaucauuucaaaccagaguuuguugguauuuauucaacagaaggaaauaaaacuauauauguuuugcaacaugcuuucuuuugcucaauaauaugcuguggacagguuuccaugucagcaauuacauuccuaacuuuccuuuugugaugacugcucagauaucuuugugcuuuucuguguuuagcuauguaggauaauucucagaaguggaauggauaggucaaaacacgugcauguuuucaacauuuacacacacuauccuccaaaaagagguaacaauguauauuuguaccucagugcauuaaauuucuccuuuccccacauuucagcucauauugaauacugacaauuauuuuucuucuuugcaagaaagccauugcacuguuuuaauuguguguguguauguuuuaauuuaaagugagguuaaaccuuucuucauaugccuauucacacagaaagcaguacagcuuaaaggucaaaagcacaucagcuaugaagucagaugaccccaguucaagcccagcuccuuuucucaacaguuuucugaccacaggcagguuacuuagccuccccgugacuccauuuccuuacucagaaaauaaacauaauaauguaauacucaugagauuuuucugauuauuguaugagaaaaaccaugucaagcaauuagaacagugcuuaccacauuguaaguguuuaauuaaaugcugacugacauuuaguggcugacuguauuucuucuacaguucaugcccuuuacccaaaauggggauuuuuaacaguguaugggcaaaccauuuuacaaaacauauuguacauaccuuguuagaaugcuacugauauaaaaauuuuuagauaccucaaucugaguugucuuacaacuaaaucuagcacgcaacauaacuggugcuaaaacaaauuccuuucauaugaaacugcuguaacaaaaauuaaaaauagcaucucaaguugagaaaacaaaauuauuucaucauguaauuugaaauauagauaagcaagccaacacaguuugcuauaaccagaaggguuugcauauguuuuagagaaguagugauucaugauccuucucauuuuuuucagugaaggcuuuguuaguuucaaauauguucaaguuuaaacuccucauacaauaaaagaaaacaaauccauucucagaaacaugaaaaagaagucaaugaaacaacuuuuccacaguucuaaaagccaacgacagcccccuuuaaaaaacauaaaucagagaaacuaaaagauaauaaaaaacauaaaccauaaccuauaaauacuguaugaagauuaaaauauaguaagcuuacuauccuuacccccaaaucaauuugaucuucuauuauauaauaaagccuucacuguucucaucagacagcuguaacaaaacaccucuaaaacuuacugagaaggaauuuuguauuauccuggcagaguugguuuagguguauucacuguugcauaugcuauaagaucaccccauuugaaggcagacauuuuuguaauaaaauugcagcacaauguuugcauaaucacacagugguauggugguucugcauauggcugccaggagaaaaacaauacaucgaaucagcagggaugugucaagagacucuggaagcuuaugagggauacuaagaggcaucaagucaaccaaguguuuggcuuaugaaguuaccagcacccugcacagcuucuguagaaccugugaaggucaggcccuuuaauacagccaccguuuacagaaggacugccacagggaaaacacaguugugaagggggccauaagauaaggucccugcucucaaggcccuaacagccugaagugacaguuuaauaagaaggagaaagagcuguaaacagaucauuauaacacaaccucauuuguagagcacagaagaggaaauggcuaaaugccugggggaaucuggaaaaggcuuaacaaacugacagcugaccugacuguuucaagaggcgauuucaguuagagguagcaguaguuauaaaagcgcaaaucuaagauguaaucuaaauuuuacauuuaaaaaggaugcccuguuaaagagaaacuauucauuuaaggaaaagaauagguuacaaauagggcaauucucacaaguuccuuguaaaauucugcccaguuuuccccaaaugucacugaugacaaguuuaacuuucucaauucugcccaaaccacguuuuaggaaaagaagcugagguagacugcggaucaaugcuccacuacuucgugagagcuaauaaacgucuuuaaaucaaggggaauccuaaaucucaauuaauccugauucucuuuucacguuaucucuauacuauaggugaagaacaaugcuucauuaaaaagccacagaaaaaauccagugagggccuccaaaguacucuccaccaaauaacguuucagcacauuccucagcaauauuugugauaaugacuaaagaucuaauugugauauuuguaauuuuucagcccuuauguuacuuuacuucucagugccauuuaaaacuuugaccacucucuucuucaaagugccagccuugaccuugacuuaaccuaguuucccagcauucacucuaguaaacaggcuuauguucaaacaacuaaauccagcauugagguguucugaauaccguaaauugguaccaauuuacucaucacacauauuuaaaguaguucuuuuaacgguuaagaaacagaucuccuaccaaucucuuuuccauacaguaccuaacagugcuguacgacaugaugcaugcaaauguuucaucaguugacuacugauuuuuauugccuaggucauuuaauacaaauuguucagaucagaaaaauacuaguacgagaaaagcacaacugcacauuaaaucccaaguuuaaacagaggcaaaaauuaaggauaaugaaaaccuccuuucucacuuuuucccaaauuuccaaauucauuuauuuugguauagcacauaccauuuguucaugacuuaaaaaaagaaaaaccaaaguaacacuaauuacaaaaguaaauuuuaaaauaauuugaaaauauagugucuuucucucucucauauccucauuaucuucugcuaaaaguugguaaucagguaagggguaaaucagcuuacagaaauuaaacucucacaccuaaugauuaccugagguagguuucaaauaucccaugaacuuauggcacagguaacaacuauauaaacugaaguagaguauaagaauaaacucuaugccaccaaggaagacaaucgacauggguauggggccaacaacuucuaaacacaaugucagucuagucauccucauuugauacugacauaauaguucagauauuuuucauccacuacccaagaaauguucaaggguugcuccaugcuaucaucuugguuuucuuuuagaggugaaauuucacuacacagcaacucuuagaaacaguaacuggaagaguugaaugauuuaagaaucaaaugaauccauaaacaccugcuuaggaagagaccauuuauaaugagaaagcccuucauacacuagaaucuuccuccucagagagugacaacuucuaaaauacauuugcuuacuaaugggauucagaacuguuuaauuugaaaauaucaaguuuucaaguuaucaaugacgaguuaccccucuaaggccaguuuaauaagagacuuagacauuuuuuauucuccuuauuucuuccaaauccuuucuaaauucuuuccacuucuuguacgagauuaguagccacaaguuccuccuucugaacucugucauaacuugcauaucucacuaauuuacauuauucagguccagcucaaauguuaccuucucagagagaucuaccccaaucucccucacucagguaguuccaguacuacauauuaggaacaaucagcauaaccaacaaaauuuagagacauggguacuuccaucucaaauaaucuguuaauauaaacuaucuugcacaacagauggaaaguauguacucauggagacuggacuaacaucuaauaaguucauucauacagccaaauacaaaccaaaaugagaaauacaaucuaaaaagcagcaauuauuugagcaauaaaacuaauccuauuucuuccccguguccuuguuuucauagggcaucucagcuucugagcuauaggagaaaugugugguuauauuuauauccccuuuggcauauuuaaacucuaucuuugggugcuugaagacaauuuuucucgauggaaaaaaacagauugaguggugauucuuuuaauggaaucuuuacauuuucaucuuaaucacuacaguucuagaaaaauuuccagucagaguauauaugcaacaaauguaguauaaaaacuuaaauuuacugauuuuauaauuaaauauauaguaguaauaaaaaauuagguuuguaaaaauuugugccuuaugaaagauaaucuucaaauucuagcaugauaaauucugauucaagaacacguugaugaauaugaaaucauaaauaugaugaauauaaaauaacucaagcuuuaugaguauuuauauauauauauguguacauauauaaauauauauacauauauauguguacauauauaaauauauauacauauauauguguacauauauacaaauuuaguuguaguuuccuuaccuagguccuaaguauaaccuuuuggaugaauauacauuucuuaaaauggacaaaaauugcacauauuuaugugaauguacacuugugaaugguaguuugugacuuacacucuaacuguauauaaaaugauuuucauucuaaaggaaauaaaaucuaacucguuuucuacagagucugauuuacuaacaauaucuauuauucaaguacuaacagucaauucuacacuuguaccaucugcuuggaagauacaugguauguuuuugauguaggaauagaauuaaacauaugauaguguuaccaguuucauuaucaucaaaaaaacaggccucaaagaaacucuuacaaugguugcuuuguguguuagcuugauuuacuuauuaagaaacuccuguuuacccuuuuguagggaaggaagaaaauacccauguuuuaaaaaaaaccacaguacaggacagacuguguuauggagacucaugauuaagacacagccuuaggaccuaaaagacaauucuaucucugcaacaaacucaaugaaagguccugaaaaaguaacugacuucauaaguuguccuuuacucaccaugauauugagaggugacagugugguggcagcccucgcgugcucucagcgccuccuuggccucggcgcccacucuggccgugccugaggagcccaucagcuugccacugcacugugggagccccucucugggcuggccaaggcuggagccggcucccucugcuugcagggagggguggagggagaggugccggugggaaccggggugcacguagcgcuugugggccagcgcaaguuucaggugggcacaggcuccgcgggccgcacucagaguggccggccggcauugcuggccccaggcagugaggggcuuagcacccaggccagcagcuguggagggggcgccgggugccccagcacugccagccuacccgcaccgugcucaaauucucgccgggccucagcugcuuccccacagggcagggcucuggaccugcagcccgccaugcccgagccuccccuccgccauggguuccugcacggcccaagccuccccgacgagcaccgcccccgcucugcgacgcccggucccaucaaccacccaagggcugaggagugcgggcgcacggcaugggacuggugggcagguccgccugcggcccagugcgggauccacuaggugaagccagcugggcuccugagucuaguggggacuuggagaaccucuaugucuaccuaagggauuguaaauacaccaaucagcacugugucuagcuuaagguuuguaaauguaccaaucagcacucuguaucuuagcuaaucugguggggaccuggagaacccuuaugucuaccuaaaggauuauaaauacaccaaucagcacucugugucuagcuaagggauuguaaauacaccaaccagcacucuguaucuagcuaaucuggugcggacuuggagaaccuuuaugucuaccuaagggauuguaaauacaccaaucagcacucuguaucuagcucaagguuuguaaacacaccaaucagcacccuguaucuagcucaagguuuguaaaugcaccaaucagugcccuguggggacuuagagaacuuuugugucuagcucagggauuguaaaugcaccaaucagcacccugucaaaacggaccaaucagcucucuguaaaacagaucaaucagcucucuguaaaauggaucaaucagcaggauguggguggggccagauaagggaauaaaagcuggcugcccaagccagcaguggcaaccugcuugggucuucuuccacacuguggaagcuuuguucuuucgcucuuugcgauauaucuugcugcugcuuacucuuuggguccgcacugccucuaugagcuguaacacucacugcgaaggucuguagcuucacuccugaggccagcgagaccacaaacccaccgggaggaaugaacaacucuagacaggaggaacaaacaacuccagacaugccaccuuaagagcuguaacacucaccgcgaaggucugcagcuucacuccugaagccagugagaccaggagcccaccagaaggaagaaacuccgaacacaucugaacaucagaaggaacaaacucuggacacgccaccuuuaagaacuguaacacucaccgcaaggguccgcggcuucauucuugaagucagugacaccaagaacccaccaauuccggacacaauauugcauaacagacacagucauguggucucaugucaacaacucuaaccaagaccaucugccugccaacaucaaguuuuacugggguauggcuauuuucccuuaaaaccaaacaaaaaacaaacuaaacauuucucugcuaugagugacuuaaaaaacaaaaacaaguuuuaacuugccacacuucuacauucauauuucugauacuggagggcagauuucuuugucuguuuuuacacuucauuuguauaaauuccuuugucaacaaguuuuuucuucccuuuuaaaugaaaccacuuauccuuauuuuggaaaucuauugaaaauguuacacauacugcugucuaguguuaaaaaaaucacauaaaugguuugagauuugauuacuuggcuaauagauuuuucauuuguuuagcaaauauuuagaguguaaugcuuuuuccauaaaauaagcauuuuuucuagauccuguaggagaauuaaaaaauuaaaaagaaaaaaagagaaugucuagguguggguggguaaguggaauagauaaguacagaaguaaaauacaagugagaauauuagauaugcuacugcacaaauggacuuuggcugccuagaucagaauucuggaucaggucugaggaaaacuauuguacgucucugugccucaguucuuccuucaucucuagaaugggucuaauaacaucuuccucauauaauuguuacgaugaaacaaaugaaaacauuacaagacuuacaacaauagugucugacauauaauuagagcucauuuugcaauagcuauuguucuaaaagacauguagaucagaaaaaaacagagaaaaauauaaauaggcuuugaguuugaauccuauaaaggauagguaggaucuggagaguagaaaacaggaagucaugaugcaaauauauugggguaaaaaugaaaugguuaguuuggcuuaguuguauaaugcaauggcuuaguaagguauaugaagagcaggacugaaagguugugaguauuagacaaagggaccugguguaacauaguaggccacaaacagcuacuaaagagacaaggguuauaaucaaaggagauuuaucagcagaggaccauaagucacauggaggauuggcaaggauuuggauuuaucacaaaugcccuugagaaagcugauuuucccaugaaguaguuucacuuacugugaugcagggcuuauacuaaggacccaccacaacaauuaaaagcacuaagcugggaucuuagcgggcucccauuguccagaggugaugcagugaaugacuacagaaaugaauaugaaagaaaaugagaugugauaugaacuuaaguucacaucacaaaacaaguuugacuuagcuuauauuacuguuuagauuuugaaugaaacguucucuuauaaagguuuuugcaaaacagcugcuacugaacucuaaaccugguuaaccuucaacaacugcugcuguggcagagaucggucauugcuauccacugcccauucuuuuuuucuugcucaacuuuauucagggaaggaaugcacccugcaaaaguacuacauuuccuggcuucccuugcaacuagguacaggcauguuaauuaggcacagccaaugaggugggggaccuuaggaaauuaauucauuugcccuucugauuuuuauaccuucuggacauaaugagagccauuucagagcaugaauuaaucuugagaaaaucacucacauucuaggacaguaaagcaggaaaauggaaggaacucugauuccaacccuggaauacuuaucucugggacugcuuuacuugaaagaauaaacuacucuguguuuaaacuacucacagaagcucuucagcuuaaaccaauuacuggcauggggaacaggauuaacucuacaagaauaacuauuauuuagccccuggggcugaggaagcuuaccuucccagaggacaugagggaaaaaaaaaaaaaaaaagaaaucacuagaacaaaauugggauucuuuccaauaggaagaaaguuggaaggaagaguggauagcaauuugguaggcaccaagaauggucuaucacauucugugacccccaaaaaaguacauuuaaucaauggaaauguaauuuaaaaugaaaaagccaguucuguguauuaagaaacugaaaacauuaacaaugagcaacaaaagauuaagcugccaaaacuuuaaguucugcauaauagaaaacaucacaaaagagguauggaacugggaacuggaaggauauaaccgacuuccuuauacaguaaaauuacugucaaucaaguaaaaaaaaacuuaaaaauugcuauccagaaagauucuccaauucuaaauaaucuguauaacucuuugauuccuaaauuggcuaaauauuucaaaaauguuaccuacauauuagauauaaaagacaaaacaagaaaggaauaaggcauaauaauuuaaauaacagagcacauucaguucuuaaacacuguucuuaaaaaguauguucagaugacugaagaucagacauaaaaaauuacgacuauccaaacacaaacuuuaaaaauggaccaguuucacagcuuuucuuugaaaaauuucauaacaauauaugcuaguguuaccuaacuauaacaaaaaauuccagauuguucacaauuuaauuuggaaguccaagagucaguucaggaucucagcauaaauauuuaguguugacaggaauguaaauggugcaggugcuauggaaaacaguuuagcucaaaaaguuggacacaaaauugccauaugaccuagcaauucaacucccagguauauauacccaaauaauuaaaaacagguauucaaacaaauacuuguacauacauguucacagcaauacuauucauaauagccaaaagguggaaagaacccacauguccaaucaacaaaugaauggaaaaacaaaacguagcauuuacaaaugauggaauauuauucagccauaaaaaggaaugauguacugauacaugcuacaacaugaaucacaaaaccauuaugcuaagugaaaaaagcuagacacaaaagaucacauauuguagaauuucauuuauaagaaaugccccaaauaguaaauccauagagacagaaagcagauuaaucuuuggaacuggauagaggugaugguugcauuccauugugaaugaauguauuaaauaccaauguacuguacauuuuaaaacgguuacuuuuacacgauaugaauuuuaccacaauugaaaaauaacuaacguagcauuaauaugaaauauguaaagaucugaaggaagaugugcauuggaauuuaaucaguucuaguuaguaggauuuugacuugcuuuaaucgcacaauuuucuacaauuuuuucccaacugaauauauccugggaugaucuucauuacuuccagcccucuaagaagacuuaaaaugugagucuacauucagauuaauccccacacugcaaauggaauugccaaacugcacauccaacuuguucagaagacaaacagguuaaaaagcauucugaucuaaaccacaaaugaaggagauccuaauaauuuacaguuaugaagauccuugaggaaacuuuuugguaguuugggacccucuaacaucaccuuauaaugcuuuuguugcuucucaugagaaaaauggguuuaacagauuguuuccuacugucuuguucuucuacaaggaucagagugguccucucuagaaggcagaccauacagcauaauguaacgagggaaaauaauaagcaagaacugcaaauucuguacuaaaacuccacaaaugcuaaaacuaaaaccccauauuuucuagaauuuuacuuguuugcaaauuuucaauuaaaaaagagacagaaaauuaaaauccuacccucagauguuuuagauguaguaagcaaauucugcacugguccacaauuucugcucugaggaacguuaugaaaaggacuacaugcucugacacacgcaguaggcaaugguuuaucaucucuccccaaagauggaguaaaaaggagcaguuuuguggccgugaaauauugagacucucaccuuugggaaagcggacugaaaguagcuguaaaaggacaaguacugaugggcacuuccuacuguauggaaucaagggauugcaaaaacccuuuccacugguaucuguccuucauugucuuaaaacugccaucccguuguggcuaacagaagagauaaccccaauuuuaacagauucuuuucuccccuuuuuauggcgaugaggucuugcuauguugcccaggcuggauucacagucacaauagcacacuauagccuugaccuccuggccucaaguaauccucccacuccagccuccugucagcugagacuaaaggugcacaccaucaugccuggcuaaaacacuaauuuuuuccaaguaaaugucaaaaacauugcuuuuagaacguguauacuguaucuauauauuuaaagccauauacuuuugaaauaucacuaucauuauguaaugaaauguaauuuuuauuucauuagaacacugaaugauggucauugaaaaugcuuuaagcagagauagucacugaagcaaauugucuaaaauucuguaacuuagucauauuuauuuagaaauauuucauuaaacucuccaaaacugaaggccauuuaaacuuauuuuaugcaacaauuuuuaaaaaaauuuuucauauggcccuauuugguuguaaagaagguagguguuccuugggauaauguuuuacuaugaaaugcagaaaacugguuuauaccauguaagagcaaaacccacugauaaugggcaagugagugggaaaagaaguuaaugguagaauucugcccaggaaaaaaacaaaaacaaaaacaaaagucauucaauuaaaccagacuuccaaacuucaucauuccuggaucucauugaacuugagugccacauguacuauuaaccauacuugagaguuacuuuauuaaaaaagcaaccuagucucauccuaagcaguauccgcaaaauugcagauuuuuauucaaaaaauagcuauaguuuucuaacacacaauauuaaaaugagaaaauuucauccacauacuaccuuguuacacuguaauuaacuuuaaaacacuuuaguauaaacaguggaggaagacaguuaaucuauuaaauauccuauuaaugauucacauucaaggaaaccuagacaacaaucacacaggcacuacaaguaucacuaacuaauucuguaucagaagguucauuaauuagcauaagggauguuggaaauauuuuuucacagugagaugagugauauucaaaguauguggcugguucucuagucuuuacauaaauaagaaacaagaucccuggcuauccuggaagccaaacaacuuuggaguagcgguccagcaaagaauuuuacuuggcucuuccucccucacagugaaggauucugcugcuugaccccauuaacugagcugaucccucugccagaauauuauguuuugaguuaaucucugauguaagauacuugcuggaaugccuaaaaagaacagagagggacucuauucuuauaggaacaguuuaaaugaccauuuuuauaccuauuacaaaugcccaaauuuguuuaucucagcucacaacauaccuaaaaaucauuuuauauacuaucggugauauguauaccaugcuuugggaaaaaccaaauuaaaccuguacaaagaaaaagugaguaauuuaaauauaacaaaacaaacaaguauggcuguggauugaaagucccagauuucccagauaaguuacugguguucuaaaguauugguauaugaucucacaacgaaaacaacuauauaaacauuccuagaguacccuacuuauuuuacucuaauacuuuuuaaaaaaacaaaaacauuuuaacagcugaaauuaagaaacagcugaaauuaagaggcuucuuucauaucugauggauuuuaugaucacuguccaccagguggcaauuaugauauuguuuucauuacccauguaugcuugaauaacagagguagagaguguguuaaugucuuggcaacccuagagacaacagcagagcacacauuuccacuuaggagccacggguuguagcgggaggcacucagcaacauuuuggauacagggaucaaaauuaggcuaggccugccuaacugcaaagcuaucuggaggguaucagguuugaugucacacaacaaugaaaaaaaaaaaaaaaaaaagacaaaauuucacucacaucuauuguuucuuccuucuccauaaaacaaucaaaugcuuacuuaauaauaucccuuggauuauaugagcugauucacugcaaaaauuuaggccaaaauuaaagcaaacuggcagcuaccccccgaagugugguguucaaucgagugaaugucuuuggcaggguaagcagagacuccaccaccuccuacuauauuacacuucaccaacugcacauauuuacagcaucugcccagcucucaaaggcauuugagcuugucauuccagaauuaaagaguagcuaaaagaaaaccugaugugcugacauuucaaaaaucauuuacacaucccugugggucugacucaaacacauauuuucuccgguacugacuuuccacuuccucuuauuuauauauuauuaauugauugccuuuuuauuauaggccauuucaaaaucuucauaggaagaggcugguuaugacuaaguugcuauuucaaucaauaaucauugaguauacauugcaaaaagggauggugagugugaggcguccgcaugugugagugcacucuguaauucccaaagcugagaacgaacaaaucauuaaauuaggcucugcuuacauuugcaaagggaaacuguaccaagauuuuuacaaagcacaaaauuauuugaagcauaaaacagaaauuacagacacuaggaaaugaacauaaauauuccuaaauccaacccaucuguaacuccaaaggauuaaaaaaauguagcuuuguuugaggaucuuucuuugauaaucucaaagaaagcuggacugugggugcguguguauaaauauauauaaguauguauacaaauauacauauucauaaauauacauauauauacauacacacacauauauauuuuagagacgggggucucguuauguugcucaggcugucaggcuggucucaaauuccuaggcucaagcaauccuucuaaccucagccuccugaguagcugggacuacaggcacaugucaccaugccuggcaauauuuuuaaaaauuaacuaaagucaauuguuucuucagauucccuuagguuucacccagugcuuuuucuguuguaggauaucacauuacauuuagucaucaugucuccuuaggcuucucuuggcuaugauaguuccccagacuuucuuguuuuugaugaccuuacugaaauaaaguauguaguuuuguuugucuuucgucuuacagacuccauacacuuccaaaguuaauuaggugagcaccuuuuuugccccaugccguucagugagguugugucauacauuuguaauaggcuccuuugucauagucugcauucuaccuugggaucuccuuugacauccccaaggauuuuuugcauacggucggguuuuacuuuuuguguuguaaacuucaauggguuuugacagacagugucgcaugaacauaauuacagugucauacggaauaguuucaccaccauaaacucuccugcgcuucaccuauucaacccuuccucucacccccuaaaccccuggucuuuccacucuauaguuuugccauuuccagaacguguaugggaauaauacaguaaguagacuuuuuacauugccuucuuucacuuagcaauaugcauuuaagacccauuuaugucauuuuuguagcuugacagcccauuucuucuuacugcugaauaauauuccauuauuuggauauaccacaguuuauuuauucauucacccacugaaaaacaucuugguugcuuccaguuuuggcaacuaugaauaaagcugcuauagacauucaagugcugguuuuuguguggacauguuuucaacugauuuggggaaauaccuaggagcaugacugcagaaucauaugguaagacuauguuuaacuucaguaagagacugccaaaaugucuuccaauuuugcauuccaaccacaaugaauaagagcuccuguugauucacaaucuugccagcaguugguauggccaguuuuuugaauuuuagccauuuuaauggguguguaguaguaucucacuguuauuuaauuugcaauucccuacagacaaacguguuaagcauuuuuuuugcauguucauuugccaucuguguguuuucuuugacaaagugucuguucaaaucauuugcucauauuuuaauuggguugucuguuuucuuauugaguucagauauuuuuaaugaaggaauuacgcuuucuguuaaaauucacauaauuugcuagacaauagauuacaaauaaauuucaacaauuugucuaggucugcauuucacacaggaaccaauaauaaacgacucaacuuuucaguuuucuuuuuaaaagcagcacaaaaaauggaaucaacccaaaggucacaaucucuuauggagaagggauuaaagauauuaauguacauucauagaaauagugcacaccauagcuuuuaacaugcuaacuauaaauucuaacuacaauuuggcuuuauaaaacaucuaaaguuguauuguuuaaaaugagucaugaaugacauagcuuguccacaaccggggcucuagcauacaucuauguuucauuuucauaccucugucaaacuuaaugacgcagacugcaagcuagaugacgucaguuaacugauaacuuuucucaggaaguauugggcauuucaucuggaaauguggcuaacaacuauuuaaagacaauuaacuucauuuuauguagaaauuacaacugcauuccaugaacacauaugauugaugaaagcauuuacucaaagcuuaaaaaaaaaaagaaaagagaaaaaagcaauuggagaguuucuuggacuuucucugugugaaauuguuucuuuuucuuuuuuuggggguggggugggguggggaugggagcaguuuccagcauuuuauuaugaaaaguuucuaguuaaaaguugaauuaauuguaugguuaacaucuauacucaucauuuagguuuuguaauuacauaacauuguauuuguuuaccacacaucuaucuacaauucuucuaucaacucaucuuuugugugaaauuguuuuuuagaaagaagaaaauuguuuugaaaguauuaacuguuguuuuaugguaugcuugacaaaaccagaaagguacuucuauuguuccuacuuuuuaaaugacucccccauccauacccacaccaaaaccaauuauauaaagaucuuguaucaguuauuuuucucugaaugacaccagaaauugagccuauacauuagguacagagaauaaccuuccccucugaaaaauccaugggaaaaaaaucaauuaaagccuaagauuaaaagcaauuuaaccauauuuuaaaaauaaaggcauauguaaaauguuauauuagcaugcuuuuaaaauaauaacagguaaccuauaaguauucaauguauaguaacaaaucucuguaaauuaugauugccaauucaagggaagaacuuaaaaaaaaaaaaaagaagggaaacaggaguauuuggaauagcauacauccaaauaauucacaaaucuuuuauaauuguuucccaaaacaacacacauacacacacauauauucaaacacaaaaauaaaaaauaaauacaguccuacaagauuaaaaauagaaguguaaucaacagaauuguuacuaaaauguuugauuccaucccaaguuuggaaauauaauuuaagucuuauucacauauacagucaucccucagcaugcucgggaauucgguuucaggaccaccugccuauauccaaaucaucacccccguguaaacccaaaucagugcauaugcaaguccuugcagagcccauguaugugaaaagucagcccuuaguauaugcagauuuugcauccugagaauacuguauuuucaauccucuuuugguuagaaaaaaaauccacauauaaguggaccagcgcaguucaaaucuguguuguucaagggucaacuguaguuucuuuuucaauaaauaauaauuauuuguaaccugcacaaugugcacauguacccuaaaacuuagaguauaauaaaaaaaaaaauuaaaaaaaaaaagaaaauuaaaaaguaaaaaaaaaaauaauaauaauaauuauuuguggccuuuuuucuuuuuuaaaaauguaauaacauauagaggaaaauguaacagaacagugaucccauugcccaggauaaucugcugauauacaaaaauaaguaaacacaauauauacauauaauuagauaauucaaagcuauccaggcaaccuuucuaucaacuguuucagauauacaaauuauugaaauacuccuccauuccuuuuuacuggagaaaaaucaaucauacaacuuuagacauguuuuuuacagagaaaauauuuuauggagaaacauuuuuauucuacaggauuuuuggauauugcuacaaagaucaugaauuuauaaauacagacuaauauguucuuaucucuuauucuuguuguaucuaaugaaauuuagguuucuuucauaaaugagaauaaaauguuaucuauucaagaguuuagcauuccaaucuuuauccucuauucuugccaauuacauuaaauauauggcaucacuuuuuaaaaaaucacuggcaucuuugacuuuuuuaaauuacagggaagguuaagagcuagaaguuaggcaaaaauaacuccguuuucucauguaacacuggaggagaaaacauuuugugcaaacauuacugguaaccuguuauaacucucuguggagcaaugucucggauguaucuaaaacaaugcuauuugacaauccuaucccucucugauuaaugucccccagccacagagaagcuacugauuuuucaacuauucuuaagcuucgaacaagucccagcagauaaucuuacuuucuaauuuacugaaauaacuuaaaucaucugacgucuucucucaaccaccugugguagccagcccccaagaugguauccaacaaucuugaggcagucauccagcuaaacuguagcaauuuccugacccacagaaacauuuauuguuguuuuaaacacuguauuuugggaugauuucuuaugcagcaauagauaacuuaauguaauccauuuaacuauucugaaagcuuguaaauauuguuaaguccucaaauuuaaaaagcacacuucuucccucagcucuuucaucuuucuccuucugccaaacuccuccagagaguccacaccaaucaugcuacugaaacugcuuucuuaaaggucaaucaauauucucaucauugccacauuaaugaucucuguuucuuucucauacuguugaugucuacgcagcuuuugacgacuggaaaucuuuacauucuuggcuuccgcagcacugaauucuccuuagcucugacccagggagaauuuuccuacuuggacuaauuuuccaacuuccuucaugggcuguauuuuuauucauaccuguugaacauuuuuauucugauuugcaucccuaccuuaucccacaauuggcauagugacagcaacaaaagcaacuggcacaauuaaaauuuauuaagcauuuaugugcucaggccguaugccaagcuccuaucacauauaucauccuguacauauuuagccuuuccauuacuccuuggugccuaaauauuucugcaauucuggguaaccuacugcuuuauucaaucuuucccuuucugggaguaaacugcauuccacacguguaauucucuuguuuacuaucauaucaaucaucucccuggcauagagaauaaugcuuaacacauaguagguguuuauggagcacagaguaaaauauuuguugcaugacugaaaaaccccauguaucccuuuuaauacuguguuuuugauuauaauacguuuaaaaaucauaauuacaacauggggaugaauccuuggcguugccauucugaaggucaaaaccagucuaauauuggcuauugcauuuacuuaauuuagacaauauuguuguaaggcagucucacugcuaugacuauaaaacacaaucaaaauaacuacaucaguaauuacaguauugagaaaagaagucauggaggacuuuuucuggagagagagucaaggaaagaaggauuagaagcaucccagguuauauuuaacauauuaagagguaacaguagcaggcagacaaucaguaguagaucuggaagauaguaaucacauuuacaagaaaacaugauaggaaaaaccuaugucucaccuucauuuucucccuguccuaauaacgguucuuagcccacagccauccaggcagugaaucccuuagguagucuaggcucugcccuuaacagaacuuuuuuuuuuuuuuuugagauggauucucgcucugucacccaggcuggagugcaguggugugaucugggcucacugcaaccuccaccucccagguucaagcaauucucuugccucagccuccaaaguagaugggacuacaagugccugcuaccacgccuggcuaauuuuuguauuuuuaguagagaugggguuucggcauguuggccaggcuggucucgaacuccugaccucaaaugaucugcccaccuuggccuccuaaagugcugggauuacaggcaugagccacugugcccggccaacagaacauuuaaccacuagaaggaucacauuaguuuaggaccucuaagaaucaccuauauuaagaugaguucaauguuacucucuuagauuuuuuccaaagacagcuguaauaaaaaaccaaaggaagccugccuauuuagcugcaaaaauuuuguacagcaaauugucuauuauaccacccaguguuccuaaauaaaaacccacaugagaaauucuauucaaggaaaaacugucucuccggauaaaccaaaaugccucuucuuucugacagcaugguaacuuauauuucccuuuuacaaugggaaacggagcuaaaacugaaguucaauuacagcaauguuauugacuucuauguuuagcaagucgguauuuugugauuuucuuuacuucuaaacuuaucuauauuuuauugcuuacacuuaucuuuuaaguuuucuagaaaaaaacaauaaaaauaaauguaauucauacccaacucaauauuauacaaccuuuucuaacacaucuuauuuguaaguugggggcugacuuguuguuaaauuaccauuuuaccuuuggagacacaaauuuagucagaaagccaaaagucagugcuucuucaagcuauugauauuauauuuaccauguuggcaauuauuaagugccuauuauagcucuuguuggcuagaacaauuuuuuuaaacuugcugaauuacuugagacuaaauuuaaaacugcuaaaauuuuuaaaggggucucagaguagaacagggcucuuuauauggcuuauuuuaugaaauguucucagaagaauaugauuauaugauuucaaauauaagaaugcuuuacaauuuuuaaaaaguauaacuugaagugacaggggaugcuguuauccaaacuacuauaugcaacgccccuuaccuccacacacaugaggauaaaauguuagcuguuaacaugucagaggacauauuucccuggccauuucugcaugcuagaaagcacuaaacacucaauaaauaguuacucagcgucuggauucuauuauagcuuccauauuauuuauaacucauaacauauuuuuauauuuuacauuuaaaaaaaaacuuuuggcuagcuggcuaaccuaaaccagcuuaaacugacaaggaaguuccaaguagugcaaaagaagaaauaguuuuuaguaagcagauacauuuuagagcaauuuuuuuuuuuugagacggaaucucacucugucuuccaggauggagugcaguggcaccaucucagcucacugcaaccucugccucucagguucaagugauucuccugccucagccucuggaguagcugggauuacaggcaugcgccaccacacccagcuaauuuuuuauuuuuaguagaaacgggguuucaccauguuggccaggauggccucgaacuccugaccucaggugauccgcccaccucggccucccaaagugcugggauuacaggcaugagccaccgcacccagccaauuuuuuuuuuuuuuaaggaaagaaauaugcugcuuucaaaugaaaggcagcaucuacccaugcagauugaaugaugugaugaacaauucaugguuuucacuuucagaugggcucuuaacaccaucuggcagacaacucuuucauuugcuuucauucucccuuuagcagcuauucuaaaauuuuugucacucuccuuaagccaccauccuaaucacucccaugccccaagcaaauauuuguugcccucaaaucuuaggguaguuaaguccacccuccaucauaugucgcuggaucuguuuucuucccaacaucccuggcaccuuguccuaacaacugguucuucucuucccuccaucuucaaccuuuucucucuacuggcuccuauguaccagcugaaaaacacacuuuagucacucccauucuuugauguuguugaauuucucuuuuccuucucagucaaaaaggcuauuuguacuucucacuuccucccucccaccucuuucccuccuccauuaacuguaaucuuaauucuauucucccuauugccucagcaaaggucacugaugucucuuuaacugacaaagucaaaaggugcuucuugguccgcaucucaaaggacugauguguagcaccugagacaguuaacacuccccucuccugguuuuccuaaucucaguccucugguucuuuuaugcuaaucacuucugcuaggucugcucugcugaauuagcauuccuuuacacagcagcuagacauuuguuucuuuuaugguucuaccuccaaaccuacuucauuuuacacacuccauccuuaagugguucaauccauuccuuauuaaccuuaucauucaauaacaauauugauguuuuaacuaaaccuuuacauucuaaaucuauugcucugauaauauuaguauuaucauaauuauuauuauuuuguuguguacagcccuauauccaauuuuugcuucucaacaaaaagaauauccuaucuacauuucaaacuuaaaagguccaaucuucauucccaguuaaaccuguuuuuccccugaaaaugucucaucucaaacacaauucaaaugccagagagaacaguucucccucucacauucgcuaccugccaucccaguucaucaaaccuaacauuccaucuccuuaacuuacguuguauugaucuaucucuauuuccacugccacaguuuaaaauccuugucccauuuucaacuguacuauuucaaacauuaaggaaucuaugcccuaucuccuccuccuucaauuuguccuccacacugcugcaaguuucucuaauaugcaauuuguccuguucugcuccccuacugaaacccuuaaaaaugacccucaccaaagccugcaggauugucuaugcuccuuagcauggcauacaaggcuuuucagaucugccuuccucaucugccugugcucccugcccccaagcaccucacauugaauacucuagcagcacugaaggaccuguuccuugaagacaucuauaaucuuuuggucuugcuguucacucuugucuagagugccacacaucccugcuuuucugcuuagcaauuuuuuuuuuucaaagaaaccaugcuuagcaaaugccuauucauccuucaaaacccaacacagacauaaucugcucugagaagccacccacacccucauauccuugggcagaagaaaucguuccccauccaugccgcugcacacaauacacauacuucucucucacuguacgcagcaccugcuccaaagggaucagucaccuucuuugaagauuuaggucaccugggucuggaauguguaaauaaucucauguuuguuucacuaucugacauaaaugauauucuuauagacccuauuuccccuaugugguagauuaggaguugucugaauucuuggaaaucuaguauagguacuggaacaagacugaaaacaauucuucaguuuagagauuaagaauuuuggaguuacauagaucugggcuuaaauucuaacucugccacuuacagucuccgggagccugaaauuaaaaaaaaaaaaaaaacaacaaaaaaaaacccacucucaucauguuuuccucuuucugaaaugggaaugauaucuucccuguagaugcugugaggauauguuugaugaauuuaugaacauacuggucaugcaacauuucaaaaguuauaaauauuuaagauuaaagcuaaacuaaugagcauggauuaauuuuucuuuuucuuuuuuucuuuuauucgagacaggguuuugcccugucugccuccuggguucaagcaauucuugugucuccgccuccggaguagcugggauuacaggcacccgccaccaugccuggcuaauuuuuguauuuuaagcagagaugagauaucaccauguuggccagacuggucuugaacuccuggccucaggugaucagcccgccucggccucugaguguugggauuacaggcgugggccaccacacgcagccaauuaauuuuucaaaaccugcuuacauuuacuugaaaguaauguuuuaacagaugccuuauauuuuuguuucucuuuugacuuugguugauagcugccccauguuuaaauuuaagauggaaucucgcucugucucccaggcuggagggcaguggccgucgccucagcucacugcaaccuucaccuccuggguucaagcgauuauuccacgugaucccaacugugacaaagacuuagcagaugugacugaauuaccaaagucaccaauguugugguaauuuguuacaguagucauuggaaacuaauacaagccuccguuaaauaaaauuuauagaaguucauugguuuggacugagcuccugcacuaggcucaacagaccaaaccaaaauggaguuacucaugcugaaguucacaccaccaagccaaaaccaaguuguuuaucugaccuuccaagaaaucgggagaggaauggagauaacagccaaauccccaagcaggccaauuuuagcuggcaugauaaggcaguaccuccugcuuuaaacuuuaaaaaagguaaguaacuuuaaaacaaccaaacugcuuuuuguucucuguuucggcuuucuucagcccuuuucugucaauaaaaccaaccuccucugcucagcucaucacaacacucauucuguuuuauaggaugaggucucaucugauucuagaauugcaaauaaaagccaauuaagaucuuuaaaauaaauuuuuuuugugacuaggucauuugauaucuucuauugacuuaaaauagaaauuuauuuucuuucagcucuagaggccagaauucaugccaaaaucaguuuuaaugggcagauauuaagguguugagagggauuccauaggccguaaaggagaauaaguucauggucgccucuuccagcuucugcaugccuuggcuuguggucccaucacuccaucucugccucaggagucacgcugcucucugaaauuucccucugcccaccuccccuucuaaggacacuugugacugcauucgccaccgcccuccccaccaagaucaaggaaaaccucaucucaaaguccuuaauuuaaucacaucugcuaaguauuugccacagaaaguagccuucacagguucugggaucagaauauuaucaguacacacucugaagugggggaguauuauucaacuuggugggggcaggguauguguuauaaaaccaaagaacaaaguguaggggcaacucucuaucuuauucauaucuuugguauaucuguaauuuuuuacauuaauuauuucauaauuuuuaaguauuaaaaacaagaaaaagaauauaauguaauaguccuccauaaacccuagacaauaccuccuuaagccuuaaaauacacggcuaaguuucauguuaaugucuagauuuacagcaguaacucuauugaaugucauuguuaaaauuuauaaauagaucaacucuucaaauauaaaaaaaaaaauuguuuccuuaucaacucuuuagaaaguggagaaaaggcagugaaaaugacaaugucucugaccaaucaggaaacauauacacugauuaagucucccaacauucacauccuuugcucuauaauuucuacuucuuauuaaccuuaguaauccaucucccagauaaauuuugcuggcuagauauuaacugcugcacuucuuccuuuccugccucugacaaugugaccucaaagggaaaauauguuucugauauauacuuaaaaaucauacuuucuuauugacuuaaacuauaauuucagauauuuauucucaaggaaaauguauagcuccaaaaaauuaugcauaaaaaaucauagcucaucuggaauggaaaauaacccaaagaugugugcuagacagcagacaagcuguacaccagacaucaagaagaaugggagaagauuccaauuccuaaaauccagaacucuuccaccggaaaucauucauguuaaaugacaacuaaugggaaaaguuccauuuguauuaauaagucacagguccucuguucuggauuuacagucuuuguuaccuuuacaaaguagauuuugaacuuauacuuuuaaaaaugucagaaauaaaaaucucugaauauuuguaacauuuuacuaagauguaucaggggacuucaaaacgucuguggaaaaaugaaagaaaagauaaauauuauaaacuaauccuuaacaaaaacuccauuaagguuaaaacacuuucguaaaugagaauaucagccauuuaguccaucccuaaauaacugagagcccuaagaauuuaaccaugucaauguagucuuuuucacguuauuaacugaauacaaauggacauccguuaaagauuuuuuuaacauuaggaaacaagaagucagaagaagccaaaacaggaugaugagauguaugccccaugacuucccacagaaacucucacaaaauuccuuuguuugaugagaggaaugagcaggagcauuguugugguggagaggaacucugugaagaugacuucccagacauuucuacuaaagcuuugacuaacuuucucaaaacucucauaagcagauguuauuguuccuuggcccuugagaaagucaacaaggaaaaugccuugagcaucuuucaaaaucguugcugugaucuuuggucuuggccaguucacuuuugcuuugacuaaaccacuuccaccucuugguagccacugcuuugauuguacuuuguuuucaggaccauacugguaaagccauauuucaucuucugcuacaauucuucaaagaaaugcuucaggaucuugaucccacuuguuuaaaauuuccacuggaagcucugcucuucucuggagcuaaucugggugcaacaguuuuggcacucacugaguggaaaguuugcucaacuaauuuuucagucagauuuguguauacugaaucaaucaagcggucuaugguggugccuccuauuucugcuguuaacugucagucuucaauuagggcaugaacaagauuuauuuuuuccuugaaaacugauguggauagucuguuggugcaagcuucaucucuaacauugucuugucccuuccuaaaaugaguuauccauuuguaaacugcugauuucuuuggaguguuguccccauaaacuuuuugugaaucaucaaugauuucaccauccuuccacccaagcuuuaccauaaauuugauguuuauucuuccuucaauuuuagcagaauucauguugcucugauaggaguucuuuucaagcugaugucuuauccuucuuagugccucaaacuagguccuguucagacuugcuauaacacauucauacaggcuuauuuugguguaaaaaaauuuauuaaauccaugcauaguuuuaucacaauauccauuuuccaugaauuuuugaaguccccucauauuuuucacuauuucucucugaauugcauauucaauuucuaguacuuuauuuugagaaaaauauggcuacuaaacuaccaaaauaucaauuuuacacuaaucuuaauggaaacucaaucuaucuccauucucagggacaaucauauugaugucaaauauuugaggccaacauucgaucugcagaguacccugggaucaagcaacuagcccaucucaggcucuuaaguagcuaagaauaggaagucuugccccuagaucuguuaauauuuguauccucucuuuuuagaauaaacaaugauuugagaacauguauuagucauuagguuacagcaaagaaaacugcuauuuaaauuagguuucaaauuucacaggagugccaaaaaaugagagcuuagcuggaaaccaaauccaacuaucaauuuuucaaaauacaauuuaagaaaaaguccccuaaaguagguggcugggccaauggagcagacaacagguauucuacguccaugaguaugauguguuucaaugaagaggcagaagguuuaaauucgagugaaaaaaugaacuuuuuuuuuuuuuugagacagaguuuuugcucuguugcccaggcuggggugcaauggcaugauaucgguucacugcaaccuccgacuccuggguucaagcgauucuccuccucagccuccugaguagcugggauuauaggcgccuuccaccaugccagcuaauuuuuguauuuuuuaguagagacaggguuucaccauguuggccaggcuggucucgaacucuugaccucaggugauccacccaucuaggccucccaaagugcuaggauuacaggugugagccaccacaccuggccuagauaaacauuuauugaaugccuacuuugugacuaacaccaugcuagguucuuuagaguaugagaguagguucucuagaguagagaaugagucgaaacuugugagaauuaucaaagucuuuacuugguuacuauuuuauuauaaauauuucauguaguagucauugacuacacuccuaguggcuuucaaaaaugccauuuuaacuuauauaacuauuacaaucaccuuaucuacuaauuauacauuuuacuucucauuaccguguaauucuaagauuacaaaauagaagauaaaaagcaaacugacaauuuuuccuucacuuauccagauauuuuaauauagaaauucauaguuacaauuacugaaaugcuugccaaauguuuaauauuauauauuacaguuuuuccuuuuaaaaguaaaccauaugccagaaaaaauuaaguuccaggguaagguucugaauaagauauuaaagggcaagaaguucugcuaugaacaauccuuuauggucuauuauuccccaaacguacuugaccacaaaacccauuuucaucuaccacuacuuaggaucuuuaagcacuacugagauucaucaaaauuaaggaaauaaguguuccuuaauggguagauguuaaguuaaaugagcagaugaauguaaugauuuggaaaucaauaagauagauagguauaugcuuaauaucuagaaaccuggcaaagacacccuugccauugguaauuuuucuuucuguauucuucuuucauuuucccaguauuucuccacacuuuucuuucauagaucuucuauucauuauuucucuucuauugaucuaugaagacuuaugauuagagguaucugggacuaaaaaaauaagagaaaauaguauaaaauaguauaauaauacaaucuugccaugaaaauuuugugaucaucaaguuuacagugaauaugagaaagaaguuaaaaccacaucugucaccauuacauaauacacauagaauauguauuucugagauuaguuucaaagacuacagaggacuuuauagauuuuauacacuugaaauauuuuaguugaaaaaaauuuaauagaauucggaaaagcaauacuuguuuguuuucuucccacaauggcuauuagcgaaugacuuauccccucaugaaucuuugucacagucugugaaauaauuuuauugcuuuagaaacuauaaaugaaccacuuuauugccaugguaaaguauuacacuaaaaguaaguagaaauaaacaagguaugcaucaugugcaaggucaaacaagugagucaguauaaagaagugggaauagauuucuugaguccugucacccaguccucaucucuaaacgcuaacccucccuuuucaugaauauauaaacuuaaguauacacccaccuccuucauaugugccaauccuggaaaauggcauagugggggaaguucacaaaauaaagauauuucaggaaagccucacauaauugccuggcauuugaagguacuaagcuuucaguagucucuuccuaucguucccaccccccacaucauuuuucuagaccucuuuaaagcaccuuauagccucaaauucccuaccugacauuuauguguacuaacaaacaugauuuuccccgaaggaaauaaauaugguaauuuuaugcuuuuucuucaaaucaucaaaacauauaaugguuuaucucuagcagaguaaugcuauuuuaaucuccaggagaagacucugaauauuugguugccaaguucaccuauuauaaauacauaaucaaaauuguguucaucaugaaaauaacaauguauagauuuuaaauauuacauaauauuauaagagcauaauauggagaaaacgcauaaaaauaucgcccuuuaacuucaugguaaaacaugaacacuuuggauuuaaaaaaaaaucacaaaacauuuaaauaagauuaucuuccuauugaucaccauaauaugagcucagagaaaguaacagccuaaacuggcaaaacuauuaucaugcaacucuucuguagcuaaucaguaaauaaagauagaauucuaaauaugaauacagaauaacuguaacaccuuuuauuuuacaaaauguugucaauuucauuuuauuuuagaauaguuuauaugaucaacuguauuacacagcaaacuuucauuuuuaaacgaccuuuuuaauaauauguguacauauuacuguaauauacccuaucauuuucuuuaaagaauuuuugaucuuaugcaaacugggucuuaccuauuacuuugguagauacaauauagaaaugugaaagcaaaaauuguaauuucauuaagauguaagaacaaaaaugcuauacuguccaaaaaaacaaauccugaaguaucucggcacauaauuccgccagcauuauucaaaacaagucagcaagaaaauuuguggagaacaugagaaaguaucaucauagcaauuuaugaacuugucaccucagaaauguacuggaaauauuucagaagaauaagauuuagacugcagaaacaauuuucuccccaucucggcuaaguugcuugcuacauaaagcuucagcacaguacaaaaaagcagcagauauaaguaaauacauagacuagcuaggaauaacugaccgauuagagcaaaauagaacaaaacagccaauuaacucaccaaauagccuuuugcuaaaaaucuguguucuuuucuuugucucaggcuucugguuucuaaagacaaauuacaugcuuccugacagaacgaugacaaaggggcacaccgugaucucuuuucugcucuuuccacuauaagaaaacugaaccacaccgcagucuccaagaguaaguacuucauaugagcaugcucaguaucuaauuuaaaugacuugguauuucaucucagcauaugaugaccuacaugcaaauaaacugagaaagcugcaaauuuaauaaagaucauuaacugacaauaaacuauacagaacuaccaaaugauaacugauuuguuuuuaacuucauaaucuuugugguucauuuaacuggaaaugauuauuucuacaaguuuauuaaauaacaaguccuuagguuucaauauagaauuaacuaugucaacauaagaaucccaaaaugcuagaaugaauuggaaguugcaaaacauccaagaugugaucccaaaauguaaaugggaccagugauaaauuaaacaaacuauaaacuauccuuauuucacuuuucaaucucuuauucuguucucuugccuguucaccaaguaaaacaaucugaaaacuaugcagugguauuuuaacuucuccuuuggaaauauuaauaaagacuaauaaacugaaauguucaauguauuuauuaaaauguuugcuaucuucaaacuacagugauaggauuuuucuuaucuguuguuuacauauuaaauaauugauuuauagaucauacaucacccaaauauugacaaaccuauacaaaaauuuuuaaauaauguugcaaguuugagaaaaaguuuuauaaaaauggcacaaaaaucagcaaaauauucuguguaugcauguuuaugccaucaaauacauaauucaccuaguuuguuaaguaaauugcugcaauggccauuagucugggaugaugaaaauauggucaagaaguuuucuccucugcuccauuuuaauuuuccuccauaaauccagaucuaguacagccccacuaaaaccagccagacaacucuuucauaucuacuuuccacuuucaccuuggguagaugagcaaaaauaggaaguguuugaacacuugacaugcaccaagcucacgacagcaagucacugacagaguggggcugacccaucuuuaaauguacccauaugcuaauuagugcuuuucccuucuucccaacccuuccuggucaccucuauuacuucccuauuguaaaucacccuucuauauaaaugucucauuuuugagaacaguagccucacaauccucuacccuccugccucuuaacauggagggugugggaagguaagaagacauaggaaauagccaucccauggaaacagcuaagauaaggcccuuccugggacaagguuaucaaaaggucgcaaaaauuaaaaugugucaauacgcauauguuuugugucucuaaguacuguauguaugggggugcgguaguucuguagaaagaguaaguuaccuacaguacucaaagaaagcucuaugauuccuaaaugagaaagugaaaauucuucacuaaaaagaaacaaauaaaaaaucuaacugugaucucuaaguauuauuugagaacagguuauauaugagucacgguacgcugcaauacacaauggaaacaaaaaugaguacaacuaucucugcuuuuaaaagaguucaacugauaggaaagacuaggcaagaguacauauacauauaacuaaucuaaguauuacagcaaaagacaggugcuuuaguguucuugagaguuuagagaaaagagagaaagcauuugaaggaaggcaauuaguagucuuugugagaggggugaacuuucugaaaugcccaggugaauacuaaggaucuagacuagacaggagagagaaagaggaggaaacagccaggucaaggcugagauauggcacaguggaggaccugggaacuggugguguggagacuggagaacuuguauugacaaugcgaauacuagaaagugacggcugucaacaaugggaagaaagaaagagauaaaaacuaauuauucugggauggaaucuggaagcagauggcaagaaguguucuauacccuggauaauggaagagugagggagucaacucuaagagacagacagaaaaacagguaaaugaggacagguaaagaggugguaauuccagucacaccggcauaguacuuacucauuucaaauucacuuuaugaauuccuccauaccacuaaauugcucucuaacaugcauuuccugucuccuauacauccaacuuaaguguucugauuuaaaauugagaucaucuuguaauuacauauauccuuuaaacuugaggccuucuuuuuuaaauccuuauauaucacuuauucuuuaacuuacugauuuacccuuucucuaccagcaaaaccugauacaauguuucccaaauacuaccccaguaagaaugaauguuuaaaaacucaaccaaagauauaacucacuucuaugacaacugaauauccucugaagacuuuauacaguuuuagugcauuuguccuaacgcagguaggacagugcauuuguaacugauacaugaggauggguggaucucgcucaugacuuaaacguaucugccuuccaucugauaccuaaccaaagggagggaaugagaggagcaagacuggaaaugaauacaugagccuuauacggcaauuaucauuaucacaucauuaucacccagagaccacaguuuguuaggguucacaauuggaguuuguuaggguucacaauuggcguuuguacauucuacgggcugagucuuaacacugcaaucuguuguuguuuuguuuaccauuggguuauagcagaaccauuugugaagcuggagaacacacacacacauacucucaggguccagaaaccuuucaaccugaccugucaguggagccagucuguaaaaccucccuaaauuuugaguuugcucugauuaagaaccacugcucuagaugcucaccaguucacagccuuucaacuuaugagucuuguuuuaaggugaugaaugacagcuagcacuuacggaaugucucauauauaugauuucauuuaauauucacaaauccucacauaauagaucuuauuaauauucuaccugguaaacaaaucuggacacagagacucagaggcuucuccagugucacacagauaagugaauagaguugaaauuuggacccagauuuuggaauuuuuuugugguaauagaaacccaaggucuaaaugugaccuaaaaggcagugaacucagcaggcaaaacuacugaaaauaauuuucaagaguaaagaaauauggaaaaagguaggggaagaguggggaguaacugugaagggaauaauuaagaacgaacaaaaaguaaugaacccaaggcaagugguacuaacucagcuuuuauuuaguuuuauugcaguguaauucacauuucauuaaacccaccuaugguuaaguguacaguucagugacuuuuagugaauuuacagaguugugcaacuauuaccacaucuaguuuuauaacauuucuaucaccacaaaaaaauucccucaugucccauuuacagucaaucuccacguccaccaccagcccuaggcaaccacugauuuguuuugucucuauaauuugccuuucugggaaauucauaaaaauggaauuauacaauguguagucugugucuggcucuuuuaggcagcaucaagguuuuaaaguucagucaucguauaccauuuaucagucaauuauuucuuuuuauugcuggguaguuuuauuguauuaauaaacacauuuugucucuccauucacaguaguugacagacauuugcacuguuaggcuguuaugaauaaugcuaucaacauuuuaguacagaucuuugugugcacacguuuucauucuuaacauacuuacguaguaaaauugcuuggucaaauuuacaauuaauuuuuuccagaaacugccaaucucuuuccaaagugguucuaacauuuuauauuucuauuacuaguguaacagaguuugaguuucuccacauucuccgcaauacuugauacugaucgucuuugauuauagccauuccuaguggguuccucagugugguuuuaauuugcaauuugcuaaugucuaaugaugcugaacaucuuuucaugugcucacuggcuauuugaguauauucucaugugaaauauauuuaaauuuuucccucauuuaaaaaauugagcuguuugucuuguuauuauugaguuguaaaaguucuuuaaaaauucuggauaugaguuauuugacaaauaugugauuugccuguacuuucucccagucugugacuugucuuuucauucucuucaguauccuacacagauaaagcaaaauuucuaaauuuugaugaagucuaauuuaucaauuuuuucuuuuguaaaucuuuaaucgcaucuaagaaaucuuugccagacccaaugucacaaauaaucucuuuuuucuaaaaguuuuauacuuuuuguuuuuacauuuaaaucaauaauccacuuaauuuuugugcaugauaugauaauaagggccuaagguuuuaaaaauuuuuuaugcuuacauauagcuaucuaucuaauuaucauaacaucauuuauugaaucauucauuuucccccagugaauuccuuggguaccucugucaaaauuccuuccuugguuuuggaaagcagaaauagcaagcaaggaaaggguuaagaaaaaugaaugaagauacagacagauuuggauugaagaggaagaaaaagcuaaugaaguucaggccugauaguuucuacuuucuucuccaagguaugaucuacuaggaaugaggaaaagaggagugagacaagcauucugaggugaguaaucaaagauuuggaacauuuguuauggagaauaggaaagcuacuggauaacgaagacaaucaguuuagaauaugcuguuuugucaacuaguauuagucaccaagaagugaagcuagucauaggccugcauacagauacuggaacuuccauuacaucuucuauucccaggaagaaugaaaaggaaaucuauucagcuggaaggauaaaggauaaaaaaaauuguuuuaauguuuaaauuuuuuuuuauugguacauaauaucuauacauauuuaagggggaugggugauacuuuuguugcugcauggaaaguguaaugaucaaguuagguuauuugaggggauccaucaccucaaguacuaaucauuuuucuguguugggaacauuuuaggucuucuagcuauuuauucagaaaugcauuuaauacauugcuguuaacuauagucacccuacucugcuauccaacauuugagcuucuuccuuccaucuaacuguauguuuguacccacuaaccaaccuuucuccagcuccccuucccccuauacugucaucauuccacugucgaccuccaugauauucauuuuuuuagcuuccacuuaagaaugugaacaugugcuguuugucuuucugugccuggcuuauuucacuuaaugaccuccaguuccauccauguugcugcaaaagacaugauuucauucucuuuuagugacccuuuucaaaaaguuugagauuucaccuuagagaauaaaauauagaaucagcuacacacagcuucagaaaaaaagcucaagucguagaaugugcuuuuccuccauggcuucuguggucuucagguuuaaugcuacuuuuugcugggacuugguaucucaacaaagaguaucuugcaguacaaauauuuacaucaaacuuucuaagugugguuggcuacugagcaacugcaagcuccuaagaucacacugccauguauucaugaaacaagucugaauuuuaaccaaccacuggggagaaaaaccaguggcaacaggaucuugaaaaugagaaauaaaccacaaguuagaaacagaugcugccaucacugccaccacuucauucuuugggacaaaccagugacacuccucaguacaacacacugacaaucagucaugaaguaaugacacuacauguuguugauaaaagauuuuuauuuauauuuuauugcuuucucacccagauauaucuacagaaggcauuuuuucaaaaaaagaaaacaaguauuuugauuuuuaaauauucaaucuuuaggaagaucucuaccaaaucaggagcuuauauuugcaagagucuuaggcagagguauaaauucugcauaauaauuuguuacugucuuacaaaaaagaauuguaaauuuuaaaacauauuuccauaaaauaacuguaaugauccagugacuuuuacugcagugauaaauccuuagcaucuacuuagcauauggcaagauaaugaauagaccuaauuauacauuauuuuggcauucaagcugucuuuugcuauagacaauguuuagacuauaagaaaaucugucauguuuugcuagaaaaacaaaaaaacaaaaccauacaugaaauaauuuugcugcugaguaauggucuuauagaaaaauuuuuaaaaaauauuucacuauguaaauaaaaaaauggggauaacuauuccugcauucugcuaaaagacagaaaaauaaauauuucuuagcgcuccuuuccccaaaaucagaauagucacuuuuuuucccacucugccuaaggauauuguuaaucagauaguuaauaucuuaaguauuaaaaauuuguaauuaaaaaaaucugcucccuuuguucauucacacaaucauucauuccacaaauaucuacuaagcauuaacuauguaccagacacuguucuauguauuacacauaacagcaguaaaaaggucuaugcucucauggagcauauauucucaugggggaugaaacucaauaaacaaaagacuacaugagauaguggaaaaggguuaugcaaagaacuaagacagguucagugacucagagaauggauugucaggaaaagccccgagggccaacaguuaagcacugacuuaaugucacaaaaaggggaaaagaaauccggauagagagaguggacaguuaguuuaaaggcucuaagccuggcauaucugagaugaaagaaggccucugugacuagaguaugguagggugagaggaaaacagcuguagaaguagaaaagucaacuaggguuagacuuacaagucagauaaugaacuuuggauuuuauucuaagugcuauggaaagccacuggaagacauugacaagaucugaauuacauuuuuauauuuuaagaaaaugaaucuagcuaguguggagaauggauuguaaagggucaagagcggagaagcaggggaaaagcaaagaggcugccacaguugucugagugaaagaugaugguggcaaagacgagagguguggcagagauggagagaagugagcagauuugggauacguuuuggaggggaggaagugucaacagggcucacugaugacagacuggaggggagguggggugauguuaacugaaggaaagagaaaaauugagaauggcugcaaggcagcaaaguuguuuucucugacuguauauuagacacuauaugaagaggucagugaauguggagaugaggaaagagguggagaugaagauuuauggcugacuggcauacgguguaaaaagagccuuggaagugaacgaggcgacuuaaacacacacacacacacacacacacacacacacacacacacacacacacacacacacagcaccggauagacucugugacuucaacaaugccaacugugugccuaguccuaugcucgguguaucuuugggaaaaacagaucuuugucuucagggagcuucuaucagagaagacaagugcaaacacaauaaacgauguaguacauuagaaagugguaagugcuaugaaagaaaaagcagaguguggcucaggagugugguuaccguagugaaauuaaagaggagucaggauaagcaucauucaaaaggugagacgugagcaaaaagggaacaaaaagacaggcagaggaaaaggucaguguuaagacccugaggcaggaauacauaacauuuuccaaaauaaguauuggugacauauuugaaaaauagccagaacaguaugagagacuggucugaaugggagaccagcaggauugcagcagugagaaaagggccagaaaaggaauggucaugaaagcagcaugaaacccagaaggguaugaugucauagaagucaggagaaaaggguguuaaggcucaacgaugcugaacgcugccaggaagugaaguaagaucugaacagagaggucccuaguguuggaagugcaguguggagucaguggggaagagagcuaccucuacagaagggcaggggaggaaguacagauggcaggagguauauucacuucuaaagguaauaggacagguuggcucuugggauuuaacuaaauucuuacucuaucacagccagugaacaggauuugaaaauuuuaauuaugucaacauggucaaucagugcuggaauccaaaaaacucauuuuauuuucucauucaauuauaaaccaugaaaagaaaaaucacuauuucucuaaaaaaaaaaaaaaaagaaaaaaaaaagaaaaaacaaguuaaaaacucauaagccagaguagcagcuuuggcagcaacacgauagcagccaccauuuauugagauccacucuggguguuguggauacauuaauaaucuuuuguuuguacaggaauauugucacagagguuuuacuauucauacuguguaugaggaaagguaaaacaggguuucucugcuaggaaauggcaggaagggauuagaaggagcuuaugcuuuuucuacuuugccagugucccucuuuuauucacaccugcucagaacaagagaucacauagggguagguuuucuucuugcuuuguaagagacacucuugcuagcuagauaugauauuuuuuauucuuuauaacaccaggaauuauguuaguuaccuuaaugcucuauuggaaaaauuacaaauuacuuguugacaguuugugguucaaauuuuuucacuauaugcauuuaacaauauacaagauuuuacagucuaaagaccuaugaaaaaucuacuauuaaauugucuuuauguguuaauugaaaacauuugauugaaauaguuaauccuuaaaaaaugcuuaaucaguacugacauauaaaauauaaucuuuguugacaacugagaaaggaagaugauagauuuuucaaaaaguuuagaaaagacucaugagagcucacauuguagaaauaaaauauuauucaagaaaucagacucaauaaaauacuguucaaugucauggaaaaaaacauaacuauugcuuuuugaaaauugaaacuagauacacuucaaucaucucaauuaguguagguaaggcaaacaccagaugcucauuaaacaaaguuauuuaauugcaacaaagagaaagaugccaaaguaaacagaauagucaauagagaauggcuucacaaauugaaguucaucuguaguauggaacacaucaugcagcugucaaaaauaauagguagaagugugugcacugccauggaagauaucuaugauauacauacauuauuuuuguauguauguguauauauauauaucucauagauauauaccuaaaaggcagguaaccgaaugguauauguuaauagccuaaauacaggcuacuuucacuuuuuuuuuuuuuuuuuuuuuuuugagacagggucucucucucucacccaggcuggagugcaauggcgcaaucucagcgcacugcugcagcuuccaccuccugggcucaaucaaucuucccaccucagcccucagaguagcugagacuacaggugugugccagcacgcccggcuaaauuuuuguauuuuuuuguagagacaggguuucaccauguugcccaggcuggucucgaacucuggacucaagugaucugccugccuuggccuuccaaagugcuaggauuacagggaugagcuaucacucacccguacuuuauauccuuuugugcuauaucaauuguucugauaagcauguauuaguuauguaauuaacaauuaaaaagaaagaaaagaaauggggggaaaaagggguugugggaggaagggaaaggaaauaaaaagggaaauaacaggagccaggaauaagaugacaggcacaugugcuagcagugugguauggagagaucuggagugugaugguucagguucaaguccuaguccuguuacuaacuuugcgcaaguugaacuccaagguucagagguuucguuuacugaauagucuuacuacgguaagacuauuucucacccuacagaauuauugugaacauuaccaugagaacauuuuugaaaugugacaaacacagugucugguacaguauaaaugcccaauagacgguagcuauuuuauguuuugaaauuaaaaugcuaaagaaaacagcuuuaccuauaauuugauuuuuauaccuuaaaguauauuugauauaaacccuuuucauuaguuuuaauaaguagguauuaaugaugaucacaaagccaauucaguagaauauaugcuggugguacuacuagaaauguauuucaucugagauuuccaauuccagcuuugcaagucccuagagcacuuguccuuguucauacaacuuugaauccuaaaaucugugccucuuaugcagaaauuucaauauucaauuugucuguauaaugaaacuuguaaauaccuguaccccuugaagucauucugcaguagagagguaaaagggggauacuaaugaggggcauuucuccagaccauucuuucauauuuaaaaaaaucacuugguagggauguaaauuuguacaaccucuauggaaaucaguaugaagauuucucaauaaaccagaaauagaacuaccaggugaucuagcaaucccacuacuggauaucuacccaaaggaaaagaauucauuauaucauaaagauacaugcacuuguauguuuauuguagcaccauucacaauagcaaagauacggaaucaaucuaacuguccaucaguggaggacuggauaaaguaaaugugcauauacacaguggaauacuauucggccaugaaaaaauaauaaaaucauuucuuucgcagcaacauggauggaacugaaggucauuaucuuaagugaaacaacucagacacaggaaagauaaauacugcagcucucacuuauaagugggaacuaaauaacguguacacauggaagcagaguauggaaugaaggacaauggcgacugacaugauuuggauauuuguucugccccagucucaugcugaaaugcaauccccaauguuggaggugaggccuggugggagguguuugggucauggcgguggaucccucauggcuuggugcuguaguagcaauacugagugaguucucaugagaucugguuguuaaaagugugaggcaccucucucccuaccauucuuucuuuuaaagcuccugcucuggcucugugacaugccugcucccacuuucccuucugccauaaguaaaagcuccccaaggccuccccagaagcagaguaaaugccagcaccauccuugcacagccuugcagaaccaugagccaauuaaauuucuuuucuuuauaaauuauccagccucagauauuucuuuauagcaaugcaagaauggccuaauacagggacucagagggaugggaggguaggagaaggguggaugauaggagguugcuucguagguacgaugugcugggaggcucucugguagguacaacgugcauugcuccagugauagaugcacacugaaggcccugauuuuaccacaaugcaauauauaucaauguaguaaaacugcacuuguacccuaugauuauauacaaauuaaaaaaaucaaaacucuaaaucagaauaaacguccaaguauaaaauucauaucuaacuuuccauuugaaguaagaaauugauuaaaaauuuaaacugccuucucacaagaaccuaauuuaaccaacauuauuugcuuuuaaaauauuggcuucauguguucccaacauggggucuacugaaagcucauaaauuaucuuaauaaacaaagucuuaccuaaugaagcaucauucuugugaaucuuacuauauucugccccucuucuaaguauuaagacuuuccuucuuaaaaaaucaaaaccacauuaacauugcacccucuuauguuuaaaguugacucacaugcuacuguccuuggauuuaugcaccucauaaacacuccaaaaccuaaucuacaauguaaaagucuaaaaucugaaacaggggucaacaaauuuauucuguacaggaccagauaguaaauauuucaggccuuguggacccaacagucugucaaaacuaucaacuuugcuauagugagaaaguagccauagacauuacauaaaugaguauggcugcauuccaacaaagcuuuauuuacaaaaacaggcagcaggcuggauuugguccacagccacaguuacuaaccccuaaucgaaaguauuaguuaaguagaaugucuaugauagucucaucacuccuuaaaagcuuaguaccacaugccucugaucaauuauuuacuagaucaauuucacuuauuaaugauuagguuuacuaauuuuaguaagaauaaauucuuuucuuuuuuauuuuuugagacauagggucugacucuguggcccacgcugcacugcagaggugccaucugggcucaaugaaaccgcuuccaccucccagguucaagcaauucuccugccucagccacccgaguggcugggacuagaggcgaaugccaccacgcccggcuaaauuuuuuuuguauuuugaguagagacgggguuucaaccauguuggccaggcuggucuugaacuccugacuucaagugaucugcccgccucggccucccaaagugcugggauuauaggugugagccacugugccaggccaagaguaaauuauuuucuauucuuauaauuucauuaggguucuccuuaauauuuaauuuuucauaauuccacauuucauuaacuaaagugaacuuaaucagucuuuccucaugaaucucauuuucuaaaauuuguccuuuuuacaccuuugacuucucuccaaguuuccuaugaaaaguagaaaugucagcacuucucuguaauuaacugcuuuuauaaaauugaaaaauaaagcaagcauuuacauguuuacuuuuuccuucauuaaaauuaaaaauaaaaauacuaaaauuuuuuuuaaauucaagucaauuguuaauaaagauauccuuuuaaaguaugguagcaagccucuaagaugacccucagugauccccagccuauacacggacuauacaaggguauacacaccuuuguauaguccccuccugcaaugaaucaaggcuggccuuuuucaccaauaaaauaugacaaaagugacacccaaagcuaagucauaauggcagugcggcuucuaccuuacucucuuaggcuuggucacuauggacaaagccaaccaccaugucaugggucacgcagccuuaugcagagaaaccaacuacccaccaucaacuugccagacacgugauccuccagcaugagcuuucaagcuugcagagacuaaagccuuaagcucauaaggcucauccaaccucguaagagaaccugagccagaacuacccaaccaagcagcuugagaauuccugacucacaggaacagggaauguuaauaaaugauuauugcauuauguuuagaggugauuugagaaaacagcugauauaccuguaucuaauuagguuacaacguaucuuauuuuguauaacugaauauuuugguucuuggcagcagcaguugaaaaacaaucaucuguacugcaauaagaugaguuuaggggacaagacugacaacaacaacaaccaauuaggccgcaugguagugauggaugcuaggcuguucauucaacaacacucaacauuaacucaaagcauucagugugggaagcugugugucaggguauuaaaguauuaacaguuugauuucuacauacuggucuaugacccacaguuacaugcaagaaauaaucccuacuucacucccauucuugcccauguaaaucucacuguuucacagggcacuguguuuuuaaaucuuggucugacccauuaguagauaaugaaaugcaguuaacaggauguuugcuaccaguacuuuaaaauaacaaaacagaagagaagguauaggugguaaagggaagaaaguauuuucauuuuaguauuauauaaaguggacagugggucauccaauaauauuuauuucuuauugcgagucauggucaaaaaaaauuaaaauaaaugacauaaaauaccaaauauguuuacaucauaggaaacuaauuagucaccacacucguccaguuagcugccagcucauguuccuuuuccaacuucucuuuugcaugcccuuuaaauagcuaggcuucacugcucauuuuguuuucacacugauauuuuuaaauuccugugaaaauuggcucuggcucaguugcuuuuuuccuaaucucaguucugcuuaucuugagagggcugagaauaggaaagucucuucuccuuugggacaacccauuuaaaacacaccuaauaguugucucacaagaguaaggcaagcaaaaagaggaagaucagauagggaacuugcaauaacacugagauaacugaaauuucuggcuaaaugaaucaucuucaguucuccaacaugcuagaaaugauuagauaugcugggcuuucaagguuaauuuuuaagucuagaauguccaagcaauaacuauauuuccuacuaagacuuuuagauuguuaucacucaugcgcagcauguaaagcucucugauuucaugaugagggccacacauguaguacacaucuugaaugcaaucaguuaucucucagccuucucucuugcagcaccuggcacagugcuuugcauuaaccugaauaaaugaguauuuuuuaaaagaaauuauuuggggaauugaaagaccaaaaaaggaaauauuuauccaacugauaauucauuuacuuguuugcaaugcuucaagagaaaggcauuauuauccauaaggaaguuuuccuagcuuuaaaccaguauuucuaucccugaaaauauaauuaccaguaaauauaacaaaauauuuccuaaaacuuuuuaacaagauaaaggaggauuucaagauuggguuuuuucuuucaaaaggugaagugaagcugacacuaagaguaagaguucaaagaguaagacucagcugaauaauaacuuuuaaaauauacgacacaaggaggaaaugaagaagcgcacguuguaagcagauuuuaacaauuaauaaagaaacaaauuaaugucuuuggaaaagcacagaaaagcaaguaaccaaauuccacuagaaugagaucaagaauagaaagugggggcauuaaaucacaaaagcucuaaugaaaggaaaauucuggcuguucucaaaagagcccuuuucuaagcaacauucucauuuuuauuaguuuuucagaaaggaguuauuuaugucaauaaaauuuuagcaguuaugucacccuaguccuuaucauuggucuacacaagacuugagagcagucuguuuaauggucugaauagcaugaauauguugauaugagucaaauuuauuuuccuaacccauuccugaguugcagacugguauaccaaacuuccugccugaaauuuccauuggcuuucccacaaccaucucaaacuuaaccuaccaaaaacgaaucucuuguugaucucccaccuucaauccacaacuccucccugacccccugcccuuucccccaaaagaacaaauauuuuuucccauuucuaagcaugaacucuccacucagcugcaugaaucacagggcugcaauuuauuccucucuucuaacccaagaaauccuauguagucuaucugcaaaaucuccacuucaaauggucuaccuuccuccaucucugcugacacuuucuucaucuauuuaccaucuuucuucauuuagacaaacgcaauagcuucuuaacuauucuccuuguuucuacucuaauucucacaucauuuaauucuccaaaaacugccaagacuucaaugaagcuacuugguccugcacaguguggccccggucccccucaccagccauggcuaggggaccccaucuugcuugccuaguuccaggcacacuggguucuuuuagacccugugagugucuucagccuagaagauucuucucugguaaacuaaauauauguccagucucagguucaacccauuuaaacacacuuuauugaccuguguaaaaacuugacuaaugucuaucuuugcucuauguugacagcugcaagaauucagggacagugccuguuuuauucaucacuguaaccccaaaaguuaccagaggucuugguguauaauaaaagcucaguaaacauuggucauugaaaggcuuucuuuuacaucgaaucccauuuaccauuaaguauauauaaugccuuuacacauaaauuauaaaugcaaacagacaaugacaagguaaaauaaaaaaugaauuuaauuugaaaaaggaauagaaucuaaaucaacauaauauguauuauaaaucuguucuuuugucuuuagggauuacaaguuuauuaauacaguacuuucauaaguugaaucugcaaaauaagaccuuaaagguaaacaagcaucauggucugauacaguuauuccguugaaauauuuacucuaaguuggccauugccagaagcaucaauaaaauuucagaaccagaaacaucauuucuaaucuaauaugauugaaaucuuuauaugaaagacagauuaaugaaauuuuaauguuuuaaauucuuaucuuccuauauuuuucuuucucauacauucauuacacuagaaguauaauuuuugucuuuucaaagugaaaauaacaugcugaucugaaaacagauuuuauuuaugaaaaaaauguauuaagguaggaugaaagaaagaggagggaaauaacaauuuugggggaagguaggagcagagaggauugguaacuuuaaauugccucucuaauucuacuucaaaguccuuauguccuuaauguuaaaguaaaauucuagucuggacacuucuuuacacucaacucuauuuguaccugcucuugacaaccuaguaauguucaaaccugcauaugugugaaguggccacacuuuccuuaccacccaauugacuucauuuuuuucuauuuuucauaaugaccuugaugagaauggcaauguucugacagguggcagaccaaaaaugguuuucauugcuugaagaaaaaaacacaaauauguaaguaauuugucaaagaaucuuagcaaacaaguagucguuucugugaagcuuggucagccaccacuuacuaggcacucuaucagaagaaauguuucucacccaacugggaaagaaacauaaauugaaacagaucacauuuaaaaaauauuaaaauggucuaguuucauuuucauaaaaauauguucuuguauguuaccuuuauggguucuacaccucaguaagguagagacacucauucaucucaauuaccauucuuuuccuacuucucuaaguguuccauuuaaaaucaucagauaggaauacagaacuuaucuauauucugguccccuuccacacuaaaaagaucugacuuuuauauccaguaggauauugcagaaauggcaaaacuugaccucugagcuaggucacugaagcccuuguggcuucucuuugcuuucucuugcaucacuaacuagggguaaagccaagcaccaugacugacgaacugaagccaccugcuaacaaccuggaucaaccuggaaacaguuccucuagccccagacaagccugcaucuuaacuguaauuaagacuaacaucuuaacuauaaucuccuaagagaaccugagccagaaccacccagcuaagucacuuacauaauuccugacucacagaaacugagauauuaaauacuuacuguugacuaagacacaauauuuccucaguuuucauucaccauguguacuaccaauuaaguucaguguaucuagaaauuuuagauuuagauaggaaaacacuuugcaauccaaaccuggagugcaaaaagucagaucuagacauagcaaaagcgggcuuuuggaacuucauuuguaagaccucacauauguuaacuuguuucuaauggccagaaugcuacuagacaaggcacuuuagaguacugauaaagacauucauauagaagaugcucauuacaugcuugauacaucagugaaccaauaaaugcagguggaauaaaagaaacuauaaugccauaggugguuagagucauaggacacacaucuuuguaauuacuuauuuacaacaucucuuucaaccaccagagggcagaaacagcauauuguuauuccucgaccuucugauuuaacaaagcauuuagaaggaauaaaauauaaauucugcccaaagagaaaggaauguuucuuaauaaauaggaagcuauuaaauucugcauacaaugcccaaaaaagcuuauagaugaaagcucaguuagaauauaggacuucaagggguggauacgaaccauaaaugguauucuaaaaaaggaagaaagcaaaaaacaagagguugagagcuuugggucaguuucaaaaaaacaugaccagagggaauguagacuggacucaauuucaaucuaaacuuuuuacucuuacuccauuucuucuagcuacuaauuagaaaguaguuggcauuauucuauagaagaaaguaaauuugguauacuaaauucgagcuuauuuucaguuauucacguuauuaccauccaacuuucuuguucuauuucaucaaaacgaacaucauugugaaccugccaggagcuacaucuacugccaagugcagugaccagaaagaaacaaucacccucacuguggccaaccuaacuuagaacuauuaucugacugcagaugugacaauguccuuugauauuuuauuauauaucaaguacuucccaacugcucuguuauuuuuaaugguaccacccaucaaacaguuuauugaauuauauuucuauauaucgucauuuucuacugaacugaaagcuuacuccuaacaaaauuagcacagccauuuuccuuuuuucuucaaguuaccuaacuaagcuagagccagggacaacuagccuuauuauuaguauuuuaugggaccucuggcaaauuacguuguaucuauggguuuauggucugaguccuaagacauguaugugguuggcaaguauauuuauaagccuagagagacagauaacaaaugaaaugcaauccaaauauuucacaaaggauauucuuaugaaagagacugaagaagauaaauguguuaauucuugauuaauccaaaaggcauuaauaaaaauaucccauccccucaacuacaauaaauaacaagauuuuauauguauguguguguuauuaauuaguuaauggcuauccuuggaacaacuugaucuucauuacuuuuuguuucauugggccccuacagauauggagacucccgaaucauuugcauucuuuaagauauguuaaguacacaggcauucuucaugggaaugggacucuuccagccucaaauaacagaaaauccaauucaaauuagcuuaaacaaaaggagggaauguauugguucaauuaauuuaaaaguucaggaguagauucaggaauggcuagauccagagacucaacuaauaugauaaaguguguaucuaucugucuccguucuuuaccuccuacucuucucucuccuccucccaggccaucccuaccccuccucucucugucuuucucucuguuauugccccaugaggacagcucuaggcugacaucuuuacagcuucaaauccaacauaagacauucucguucuccagagcuuaaggaaagucccaggaucuaguauuacugguccagcuuacauaaugugcacacccuggucaaugacaggaucaggagguauggaacaaauacugaccagaccugaguauaauaacaaguacugaauaaggaguuuuucuccaagguaaaugugaguuagauucucagaagaaacagaggauggacagggcacaaaagaaauguacgccaucucuguaucacaguuucaaagagguccauuaaucuccucuccaaagugaagaaccaauguuaaaagaaaaaaaaaaaagguauagagaagaaguacauuucuaaaaugucgauuuaaaucuaacccugcacuauauugcucacaaguaacugauaccuuaaucaaauacagugccuuacucugcuuccucaacuuguaagcacugcauuugccuccaccgacuauauaacaaucacuucuugaaguacuguuuugucuucugacuguggcuuccaggaccugcauuagcggaguucuaccucucugauuuuuauagguauuccccaguguccucuccucuuuuucuaucuuaucacuucuauucaaguaacucucaaauauucauuuccaggcuaaaaauucuuugaaaaauuccauucccgcauuuuuaaaaaccaaauguagaucucaaaaccuauagccacacccaaaauauucaaaacaaacaucacuuauucucuucaacaaaauuagccuuuccuaccucucaaucuaucugugaaaugaucugaucauucagacauucugucuuccaugaagacuuccuuccccucucucuucacaagacagggguaugcuuucacagcacccuacucaccggcacaguacuuaucccauuucauugugaugacuagcuuacuuacugagcucuuacacgagaauauaaacucacuagcaagggcauagcuguaucucacauguacauccuacauccaaguacaaauagccaguacauaaaaaguccccagcaaauguuuaaugagaaaggggcagagggauucauuuuuauuaaagaucugucagccauaaaaccagauuuuuggggguuuacuauucaaauagacuauggcuugauaaauaaggucuaggcaacaagacugcuaccaaaauuuauacagcaaaaagucagggaauagaaugaaaauuuaaaaaucacuacuuucuucuuaucuuuuucauagccauuccccgaggauuuuuaaaauuacuuuuaaaauaauaauaauagauauuaaacacuaggaaacuuuguuccuccaaaggacuaaaaacaacaguccauccauaggcaccagacgugguuucuguagaggccuuaacaaauuuuuccuuauaagaccaggcacaguggcucaugccuguaaucccagcacuuugggaggcuaaggcagguggauaaucugaggucaggaguucgagaccagccuggccaacauggugaaacccugucucuacaaaaaaacacaaaaauuagcugggcgugguggugcacaccuguagucccaccuacucgggaggcugaggcaggagaaucguuugaaccuggcaggcagagggugcggugagccaagaucacgccacugugcuccagccugggcaauagagcaagacuccaucucaaaaaauaaaaaaagaaagaaaauaaaaaaauuuucccuuguaaguaucaagcaauccagcugcuguuccuugaaacaccaagagauggccuuuuggggcagagcagacugagaacaacuaacucaaucauugaaacccaaaccacuugcuucucagugacaugccucuuaacauuaaagugucguuacaaucugaauuuugguuugagaaauucauuauuaucgguuucugugacacuaaacauacuacuuaauauucuacauuuucucaccuguaaaaugauaauacuaauaauuaucccacaggguuguugauaauaagugaacauguaggaaaaguaccuaaagcacauuuggugcucaugaaagagaauaugauaacaguggcucucuggcacucagaggaaacuaagguuugcuggcuucacuaagcugacaccucuuuccagagucagcugauaaugauaacagcuuucuuuaaucuauacaagggagauacuauuuauacucaucuaucuaucuauguaaaauacaauaauauuuccuuuucaugacuccuuaaguuguauauaauuuuaaacaaacuugcacauugaauucauccuugcuguuucccccacucuccuuuuaaucuccuuuaaguuaaccauguuuugguguuuauuuucacuagugguuuuuaaacuuuaauuagcaacagcucuguuucauugcucuucagaaauuuaacuuucaaaaaacauaaacuuguuuuguucaucugugacgaaaugacaacagcuuuguuuugugggacguuuaaacauuauucucuuugauuuucuucuuaagacuguucacacugacaccaaauaguugcagucuguguuguuuuaguacauuacacauaaccuuagaaaccuuauccuauucagucuggcauuugacagcaaauaagaaaguuaaauaugcuguauuucuaauauuauacuuguuggguucaguacuuauacuuauuuuuguuuauuucuaagcagcagacaaaauguuucugguauuuuauuucuucuccauuacuucuguauaauucugacggcaauaaugcaaggcaacauuaauucaauguaaagcaggcacuagaaauaugguaagggagaagaggagggucuagucaaugcuacuucgucuugcuauuguuagaguacucaaauuaaaaguacauuucaacuuccauuauuaacuauaagcaaaauuacaaauaacauggacauuuuccuaaaaccaccuugguuccauuaaauuuugucauucauuuuaaaguucccauauacaacaccuuugcaagaaacugaagcuuuuccuuuaggaaaggauugauggaaaggauuaaucuaugagaauacagcacaaucaaaacaucaaaaaugccaaaacugucucacuggcaauaauaaaagaaagaaagaaaucgcuuggaugcgaaaaaacaaucugcuucacagcucaaauucuagaaauguaaagaaaaagugcccucaucuggccaaacaaaaaacuuaaaauuuuaggagcauguguuaacucuugcucaagacuaauuuucugggcuuuaauugguauauaaauaagucuuaaaaaguaaaaauaaauaauaacccaacaacauaaauuuuugcugccuuuaaaaaacauaacuguuugcugcuaaaaauaacuacugaaaccauaagauagaaagcaaauuauguaauauauaaucucuugagagcaaggacuauguagcaguaaucaucuuugagcucacccagaucuagacacauaauccucaguuuuauuucugaugaagcuaaugaauguagucgaauugcaguugaauacaaauugucccaaucagcaaaaacauccuugacauuacccauuaccuuaccuuaguugucuuagauuaauaauuuguucucuaaggggcuuuuuuugagucagagucucacucuguuuguuacccaggcugaagugcaguggcgcgaucucggcucacuguaaccucugccucccagguucaagcacuucucgagucucagccucccgagcagcugggauuacaggcgccugcaaccacacccggcuaauuuuuuguauuuuuaguagagacgggguuucaccauguuggccaggcuggucucaaacuccugaccucaagugauccacccgccuaggccucccaaauugcugagauuacaggcguuagccaccaugcccagcccuaaagggcuuuuuaaaauaucaaaauaaccaauacagccacauuaauguuuuuucagcaucaccuuuuacuauauugaguuagugguauaguaagacuucaaaaucuuuauuucaaugcuauacaauuauugugcuuuauucaacaagagauuucaaaaacuuuaaaagauaacacauuuuagguacuguuguucuacuucauuuaaucacauuauuuuccuuuaauaaucuuaucuuagugcuaaauuuaaguuccuuuacaaucuaagcagaauucaauucuaauucauaccaguacuggucuguggcuauccaaugugcuauagucuuccauuucguuauaccuaguucaggucaucucaaguaaauagugaaauauuacuauagaguucuuuuuaaucugauauuuuccauuauauuagagaaucaaaauugauuuuuuuuuuuuuuuacaauuucaacuaucugccuauccaugugaaacauauaaaacuuuagaauggugguucugaaugcugacugugcacuguggaguucuuuaaaaacagauccccaggcuccacaccagaggugucugacuugggucucgggugagcuuaggcuugaagcuguggcugauguuuuuuaggagccguaggugcauauaaagcacagucucaggaaucggcuuuggaauacaguuuaaaaaaaaaaaaacacuauauuuuucaaagauauauauuuuuuaaauauuuauauuacuucuauaacaaacaauucaguuuuaaaaacucauaugaccaacauauuuuaaaucaccauuguauugcaugggucuuuagaaauauaauugcaacaaucacugucaauuuuuuuggccaaauaauuagucaucauauuggugaauuucuaaaauaugcuugcagauguaaaauuauuugugcaucaaaaauaauaacaaggugccuuuuaaauaccauuaauccacaguaucugacaaaauuguucccuaucugcuuauugccaauuuagaacuuccuggauucaaccacaaggcaaaucccccuacauuuuuauuauuuuucugugugaaguaccccagauuucauaugccucagcccugaggaugacuccccucauggguuaaauagagggguuuucugcugggccugcaaaacagucuugagaaugaaaauacccuugauuacugucaaaugaccuagucuuucagaguaaaaauuuaaaucccaacagugauuuaaagucuauauucagcuguuaaucccuuuauagacucaaagagcagacacgcacaauaaaccucuaagcugacaguuugagauuugcuuacuaccgcuggcauuuccgugcucuaaaaaauaaucaccagcauacugcaccuugauacaagguacaaaaacuaaguaucauuaaucauguguguguuuugagagcagccugaaagacuuuuguuuacaagucuuuucauauaaauuuauccuguuagccaggcgugguggugcauggcacaugccuguaguccuagauacucaggaagcugagacaggaggauaucuugagucuaggaguugaaguccggccugggaaauauagcgagacccuuucucuuuaaaaaauauuuuucuaauuuuuuuucagugucucuaauuuuuagcuaaaaaagguuauuauugugugucuuuacaaaugagaggcuaacuuucagcuacuuaauuaacucaccuguaauuacugcaauaaacccaccucucccccauauaccagggaaaaauuuacgcucuaaacauuuauauuuaacuaacacuucacuguuuuaguuuuuucuuuuuugagacggaguuuaucuccuguugcccaggcuggaguccaacggugcagucuuggcucaccgcagccucugccucccggguucaagcgauucuccugccucagccucccgaguagcugagauuacagguaugugccaccacgccaggcuaauuuuguuauuuguuaguaaagacgggcuuucgcuccauguugguaaggcuggucucaaacuccugaccucaggugaucugccugccucagccucccaaagugcugggauuacaggugugagccaccacgcccggccaacacuucauucuuuuguucaauuguuuuuucagguuccccuccaguccuuagccuuaugcauaaauucauaaaacugagaucacagugugacacaacuguuucuucuguuucaauauaaauaauacauacuguuaaacagaggcccuaacaacaaccuaugggaucaaaaauggaauaauaaaaagagcauuaaacaauuguuauauaaagcagccaauuucacauuuuaaaaaacugcaacugaaaaacuuauuucccagugcaaaggaauuaaaugucucgcauaaaaacauaauguaaucauguaugacucaggaauuucugaaagagguaaugugcaucugcaaugaaaauaaaacaaaugcagaaucucuccuccuuuacccuaagcacuugguuucuaaucccaaguagaauaaaccaacuaggacauacaugauuucuagguuucaacaaauuagacugauauauccaacagcacuccaccagccacuauaaauauuucuacuucuacuacuuuguguuuugagaguuguuuguuuuuuauuuuuguuguuguuuuaaagaaaucaauccacagacaucacugcauauuagcccacaacuccucuguagagauuaaggaaacuaacgcccaguaaggcagacuaaggacacaauaaaagcaaugaagucaugagccgaaucucaguuuugccauuuucugcccaggacagaucucuaucaaccagaaaaauccuggaucucucacuagaaagagguaagcagguucucaaaagcuacggaguauuaucauucuacauuuucccaacacugucauauuuuaacuuauuucauuuuaucaauguuauuacuucaaucaugaaaacuaaggauaaaauuaacuaccuacuuggaaaacugcacgcuccacuucguguagcugcaaugcugcaccugucucucuaacuugugacuucuuuuauuuucuacaaaauuaugcuggcauaaucccugaauaugcuacugucuuuaaugaugggaucaguuugauguuucagcgaugucuccugcauuuaccuagggaauaaugaauucugaacaaaauauaauguacaagagaaaaaucaaaccaauuucuguguuguacucauuuauaaauauguggcuugcuaccagugaaugcauccucaguuuuuuucacgucacagcacacaaaggaaaugacaauacuugggcagcacacuggaauaauagaccaaggagauuucugaaacgugggugggggugagugcucaaugguuccagaaaccuaaucacagcacaccaggagccguggaaguugugugcaggaguaugaagaugaugacacuaacaucacagccuuaacugccauaaggaacaguaugcucaauuucaaagcuagaguuuacauuuccacagugaacucacagagcuauccaauuagucacacagaagcugaucaucagcacuggcuacaucacagaaaaguaaucauggcagaaaauauuccuaccacuagaaagccaaaucaaguauuuuugaguagggaaaucaccucuuacugauccguagaauuaaaaaugcaccuauaaauuauaacuuauugaaguaaauaaauacauagcacaggccugauuauccucaacuauaaacuggaaauggggcauaaaggaaaccacuacuugggcaugccauaguucaaacaggcuccaggucaacucuuggugugcuuuaaaauuauuaugaucauuugagcaacauuaccaaaagaagagcacaaaacuucuucccgaaggacaacacggcacuguggguguauuagauguguugcagugggaacugauccaaaggcuuugacccuuucaaaaugaaacucgucugcauaacaacugcuuagccucccucauccuuaguuucccuaucuaucaaaugaaauaucaucuuccuuauauguucuguuaugaggauuacagauaauacaugaaaucugguuucuaccacgugucugguagucauaugcacucaaaaagaauaauuguaaucacuaguacuauuuuguacuguauuuuuaacacaucauuaauuaucacaucucuauguucaauauuuuuaaaagcuacauaaauaacaauguaucguauucuuggaaacugauaagagacauuuuagguguucuuaccacaaaaacaaaagauaaauaugugggcccugcgugguggcucacaccuguaauuccaguacuuugggaggccaagauggguagaucacgaggucaggagaucaagaccauccuggccaacauggugaaacccugucuccacuaaaaauacaaaaauuagcugggugugguggugcgugccuguaaucccagcuacucaggaggccgaggcgggagagagacucgcuugaaccagggagucagagguuccagugagccaagaucgugccacuccacuccagccuggcgacagagugagacucugucucaaaagaaaaaaagauaaauaugugagguaaugcauaugcuaaugagauugaucuggccauuccacaguguauacauauuucaaaacauuauguagcauaugauauauauauuauuugucaauuuaaguaaauacagaaaguuaaaaaaaaugccuuaugucucaaaauaagaaggugauuuccucuucaguuuucuuuccuauaccuaagcuucuaucaaggaaaacacuucaguuugguacaagacuuaauaccuuuacaacacuugcuaaucucuguuaaugaagagaaaggcaggcaugguggcucacgccuauagucccagcuacuuaggaagcugaagcuggaggacugcuugaguccaaaaguuccgggcugcagcaugcuaugcugauagcguguccguacuaaguucagcaucaauaugcugaacuccugggagcgggagaccaccagauugcuuaaggaguggugaacuggcccagacuggaaacagagcaggucaaaacuccugugcugaucugaucacuagagggauugugcccgcgaacagcacuacacuccagccucggcauauaauaaggcuccaucuuaaaaaaaaaaaaaauuacuuaucuacuuuauuuauuuuaaauaauagagacagagggagggaggaagacagagggagggaggaaggugggggggggacagagagagagagagagagugucuggagaacucccuccaaagcuauacaacauuguaucuuguuaucucaugguuuaauaaaauaagucaauuguuagacauuuguguuauauucacuucucacuauuuugaagguuauuuaauuuuuuuuaacaucuagacccagaaacagaauuacagaauucaaaagggauuaccuucuggcuuuuaauacguauuucuuaggcaaaccuaucuuccugaaugaauacugaggugugggguacaacccgggcagaauccuauugauugugaaacuuuguugguugacucccaauauacuuuaauuguaucuugguacuaaauauguuuguuuaagagaauuuaaauuauaaagaaaucaagaacaaacuuuucaaaauuauuucaaaauaagggaaagauuucuucagucacaguuacuaagcaaaagaguuucaacaauguuauguacacuuuacuguuucaaauuuucuuaacaaagcuaacacauguguauagugcacauauaaauuuuuuucccacaaccuacaaaggauuuaaaguguaaaagaaaaucucuuccacugcauccacaucaaaacccaauaaaaccuggaaguaauuauugcuaacauuuucuuuuguguccuaccagaauuuuuauauagaaaagcauaaauaaaaacuuuauuaguauauaacaugcuuuaaaacuugcuuuuuuucucuuaauaucagauguuagcacauacaaaucuauugcuacauauauucuacuguuccauaauuuauaaaacugaaaaaagucugguuaauuucuauuuuugcuauuuuguauguguuggguguauaaacaacauuucaauggccauccuuaaaaacaauaugcaaguucaacucaauaucaauacuguacuauuaaauuugcaggauaaaucuccagguauagaacugaugaaugagcauuuuauauuugacuauuuucacaguuuacacucgaucaguaguaaaagagaguuaacuauuucccucugccuucacuaacauagggauauucccacauugaaaucuuugccaauuugauacaggaauaagauaccucauuccagcugucuucuaaaaaauuggccauuuauguuucuuuuugucugacuuucacuguucccauuuuuuauucacauuucuuauuagcuugaucauuauuuucuuaaugggaaucaacuauguuaaaaugcuacauaugcaaauaaaauuucucucacuacaaaacaauuuugaagacuggcuguaguuucccuguguuguaugaacugcuuguuuagauucuugaacuuauucaucuaaauccaacagagaugacugcauggagauuuauguuuacauacauaaaucuauuguacagauaaaaauacaaccaaguggcccucuaguauggaagaggcuaacaaagacacagcaucauguaaauaauaaaaggcuuaggguaaaucuaauucuggucucggcucugcuacaauaagcugaauaaccuaggugucaccuuagcccucaaaguaucagcucaucggucaguaaaaugaaaaaguugggcagaacggucccuacgccugcuuccaaguguaaaucccacgccucuaagagcucgcaauguuuuucuuagagcaugaaacaccuauaggacaaaaugaaauaacugguuauuaugaaguaaaaaacaaauaacauuuaaguauauguuaaaaauaaaacucaaaucauauuauaacaagauuagcaacaugauacuacccauguuugcuuuuuuaaguucucagaauauuagaaacuuggggaaauauacacauagagcgaauauauucaaagaauuaacaccuccagugcgauuuucugauaaucauuuuaagagcaguuuagcaggaagaacaacaaaaaacgaaaccuauuuaagagcccacugcucuuaaaagcuccuuguugccagaauaguaccaugccccuuacaggcauuuacauuguuuuaauuuuucaauccuuguauuaaagaaauaucuuaaaauaaaauuagauuuguaguuggguuuucaugguucuacucaugauauuauuaaaaacaaaucacuuuucucccaucugaagaauuauuucugugcugugaugccuacgcuuauucauuuuauaguuuuaaaaauguauuuaagaaagaauugucucaaacacaaauuauguagguggaaaaucauuucuauagcaacaguagcuucagucuaugaguccugaaagguaaaaaccuccuaauuccaauacuuaaaaccuaauguuugauuuuugaugguggcuccuaauuuuuuaucacuacuaacaugaacuaucuagaccacuaucauccgcaugagaccuggccaaauucaaaaaguauaaaaauacaugaugccuuuuuaaaugauaaaguuaauuacaagaaaucaaacaugacaccuuaagcuauccccuaggcuguauuccucuucuuuguccuguucccuggagccaaagggauucgugggauaaugacagcuucaaauagugagugauuugagaaucuuugaggucuuacugcuaauaaaaaguauuaguaccaugucauuacuguuaccugggggaaaaaaguaaaaagcacugcucccagcuagcacugguuucguccccacacucaacugugucuggcuccgauaauggagcacauuuuuuuuuuuggagaauccuuucuuuacuauucugaugggcagagauugaaaacuggcaauaaaaagaaauuaaagcuguacuuuuucauaaacagauggcaaaauuuuauguguauggguguaugcauacaagaaagggaaaucaagggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccaggaaguggagcuugcagugagccgagauugcgccacugcaguccgcaguccggccugggcgacagagcgagacuccgucucaaaaaaaaaaaaaaaaaaaaaaaaaaaaagaaagggaaaucaguagcaauuuucuuuaaaaaaaaaaaaacaacuuuuuucccauucuauugcucagaugcaaaacauacccgagacacgaggagaaugaucaccaccacuacuuuaacaccccaaaagcacaggacacacugaauaugguggagcaauaaauacaguguucaugaaauucuguguuauuuuccuggcucugccauuuucuagccaugugacuguagccaauuugauuuaucugugcuucagguguaucaucugaaaauaagaauaaugauggugcucucuuaaggguuacugcaaagauccaaugaguucguauauauaagagaacugugccugguaaaugauaagcacuuaaucaagcaaacaguugucuccauuguuuuguuuugaaccauucuaacagguaugcgauguauauaacugugauuuuaauuugcauuucccuaaugacuacugauguugcgcagauuuucaaguauguauuugcaaucuguauaucuucuugaggaagugacugcucaaaucuuuugcccccccgggucguuuguuuucuuauuggugaguuuugggaguucuuuauguuacuuggauaugauuucuuugccagauauaugaacugcaaauauagucaugaaccacauaaugacauuuuggucaacaacagacagcauagauaacaguaguccccuaagauuauaauggggcggacaaauuccuaccaccugguuaaguuguagccaucauaauaucauaccacaaugcauuacucaacuguuuguagugaugcugauguaaacaaaccuccugugcugccaaucauauaaaaguauauaacacauacaauuauguauaguacauaauauuggguaaugauaaaugacuguuaauggcuuauguauuuaccaaacuuuucuuuuuauuguuauuuuagaguguacuccuucuacuuauuaaaagaagcuaacuguaaacagccucaggcagguccuuagggagguauuccggaagcaaggcauuguuaucacaagagaugacagcuccaugaguguuacugccccugaagaucuuacagugggacaagauguggugguagaauacagugauacugaugauccugacccuguguagccccaggcuaauguguguguuugugccuuaguucuuaacaaaaaaguuuaaaaagcuaacaaaaaaguuuaauauaaaaaagcauacagaauaaggauauaaagaaaacauuuuuguguaguugugcaacguguuuguguuuuaagcuaauuguuauuacaagagucaagaauuuuuaaaaauugcaagaauuuuaaaacauuuuaaagggccaggcaugguggcucaugccuguaauuccagcacucugggaggcuaaggugggcugauuauuugaggucaguaguucaagaccagccuggccaacaugguaaaaucccugucucugccgagguaccgccacugcaccccagccugggcaacaaagcaaaacuccaucucaaaaaaguuaaaauuguauaucaauauaaauaaauccacauaaauuuuagaauagcuaaaucaagcuuucuuaagcuugguaaaucuauauuuacagguagcuauuuuuuuacaggguaugagugucucuucauuuuuauauuaaaagaaacauuaaaaucuucccagaggcagaugaagaaacugauuaucuucaucuuccucaguccuuucaucaaagucuugucacagaauguaaaugcucacucccucucucaauugauuucuucuuaacaaucacagucuuuucaggaauaacuggacaucacaauccucaagcuauuaauaaaguagucucucuauagagccccuuuauaagucaagucaaggugucugggguuuuucucugaaauaggggaugggaaaaagcaaggagaaauaucucuaucacaauuaauuacuauucucauuuuacauaccaaacugcagaaaaguuuucacuugauuaaagauuuuauaaacuucuugcaauugucuuauuagucaaacaccaaaagacacaaugguaacagacuacaacuauaaacaagaguuuuacaacugugguuuaauaaauguagggucuguggcacagucauccucccaaguaauucaacuacccugcccucucagccaggaaggcugcuuacuuugaaccaaaguauguaagaaaagacagcaaguuucaaaaaaguaugucgucuccagaaaugaagaaugauaagucaguuaaauauaaaauuauuagagaggcugggcacgguggcucacgccuguaaucccaacacuuugggaggccaaggcaggcggaucacgaggucaagagaucgagacuauccuggccaacauggugaaaccucgucucuacuaaaaauacaaaaauuaguugggcgugguggcaggugccuguaaucacagcuacuccggaggcaggaguauugcuuaaacccaggaggcagagguugcaggaguggaaauugugccgcugcacuccagccugggcaacagagggagacucugucuccaaaaaaaaaaaaaaagucuucugaauuguuacgcucacaagucucccucauacaauuaaaaguuuucaccucacccauuccuacacuuucaauucuuauuauuuauacacaaaauaucugcggaaacaucaguacucaaguauaguuauuguacaagguuuuuuaacucaaagaaaaaaaacauuccauauaagccauccacauauuuuuagucauucagcaaaggccagacauuuugauuuuaucaacgaaugaaaauagguaagagaggcauuuccagauacugggauugggguuucuaccugaucucauuucauaccuuauuuccugguuuauauguaggcugcuuccuaaaaaugguuaacucagggcuagagguuaccaggcagcucuaggacaguuagacuacacauaauuaacaacagauaauaaguacugacuaaauaugaauuuguuucucuuauauauugccuuuucucuacagauagugauuaacauucauuucuuagcgcacaccauugagucgggaaucagaagaaaaugacagaaacaguuuacaaaaaaacaguggagaaaaguuacacaaaguagaugagaaagaacugcaaguuaucgguaauggcccagaaagaugcucaauccaaguccaagagacuguggcccaauuaaaucuugaccugguuuuuacccgggccauuucccaaaagccaaugaugguuugcaggauaaagaaggaagacaagguuuaggaagaccuuaauugaaucaacacauacaaggucugaaaagacuuguauggguucuuccaaucacauauuuccugaauuuaucuauuuuguuuaacauuuuaaugcauuugaaauuuggcucauuuuagauucaaugugugcauuuaaugugguagcuuguucucauagacaagaugguauuaaaucacugguagauguuucaaucagugugucaggaggcaauauuagaaacaagccuaccacuggugggcagagccaacuuagcacugcccuauaagugaagaccagaagaugcuggaggcucugccaguacuaggcagggagaaagggcucagauuccuuucacugucagcggaagccaccuaggcaagcaacacuaacuuaauuuaucuauguuggcuuuaguuuacaacccucuuuuuuuuuuuuuuaacuugacaaccuuuaaauagcaauuaacagaccuuuacuuaaauucaaauauuaaaacucaacauuguuccuuaaguuagccaccugggucuaaacuaacuacaauauuaguaaagcugcuaagccaauugcugauuuuuccauuuuucuuuaagaguaaaaauaaggaaaauaugccacguuuucuaggacuacaaacagaauaaaucaguaauuuguuuucuuugauaaauuauuugaauauccaucaugugccaguagcuuaaagaauauuauucuaauccugcauggcaggugauuaagcucacuuuacagaaaaagagacagaaacucaaagagguuauauggcuagaaucagggcuggaauucaaagcuaagccuggcugauuccaaugcccagcucuuuucacuucacccaguuaccuccagcauauugacucauuauuucaccauuauucauuuaccaccuuuuacuguguuucugaccauaacacauucuuagaaggaaucuuauaauucaguauuauccauuauuauuacacucauuugaagagcccuuucuuauugcuguuauuauuuguaguaaagcauuaugaaaaucagaaugugcacauauguauguugcagguguauauaugggaggggggaaugcauaggaaggugcagaauuuuaagugaauuuaauauucaaacacaggcaaaaauacuacuaaucguaucaaauuuuauuucuccuacugaguuuuuuuguuuuuuguuuuuuuuuuaaaucacugcaauaaacugccuucaauuuggggucuugugguuuccacccauguauuggccacaaaugauuuguuucaucuguggcacaaauaagauauaauucacuuugguuauacaaacucugaagcuuuauuuuguauuagaauagucuauuuauacauaaaacauaauauuuuuuccaccaacugaauccaaauacacaauuucaauagaaucucaaaaacuguaaaguccaccaaagagaauaccucaaaagaaauacagcaaaauggcagccagaaggugauuccuuccgauuaucuaagaauagcuuaaauccuaaagccaagcugaaguuuaucucuauuuaaaacccaugacuuuaugacuugaaaucuuauguuuugaaaguaaucaagaacuccuucugggacaggauggggauaggaacaaauagaagcucucaaccaguaugaaguaguuuuagucucuccacuaaccgauauacauaucauacuuucagacuagaacaguaaugcaggcugugauuaaauauggaauuaucaacuaacagaaacuagacugauucacauacuaccaggggugacuuauggaaggcugagggaacuaugaaaaccuccagccacccaaugacaaguagaagaggaaaauaucaaguggugugucacuuuccccagcagacaucuuaugacacugcauucuucuccuucaccaagcugaucauaguuguaauuuuauguuuauuuauaugacaacuguuuaaugacuaccugccccaguaaaaugaagacuccauaaguacaacgaccaugucuauguucacucacaacaagaaagcccaguaaagaacacaucaccuagugcacaguagaggccaaauaaucaucuuugggcugagugaaugaaauuaaugaaauaaaugagauaaaaaaauguggauaacacagguuaaaccaacagggaagagacaggauuucaaaaccugaaagcugucagcauaacuaagaaucacgcacacacaaaauuaucccagcucugcccacaaccaugcuuccaaagcaaaaaaaaaaaaaaaaaaaaaaaaaaaaauuaagccucagaagacuugcagaguguuguuagcaaguaugaugccaacauuaaaaucaaggccucuuccugcauagguuccuaaaucaaacaagcgauugcaucugaugucacuuuuauauaucauauaaguaggcuauguucaguaucccuuuugaaacugacauucuuuuuaccucucuggcucuauucuucuuagcucccagaacaaucugagaucagauuacugcuccaagguuacucuggagauugcuuucuucacuuuucuauacaaagcauggauugcaaaaagggaaacaauccuuaacagauacaacagguaaauaaugagguggggaagguggggcaugggugugugaagaguauuaguuugcuaaugaaguguuaagucuacagggaguaguuaucaucugucucgaauauauguuuagugacuucuuuaauuguuuauguuuuugguagcaaaaagauaauacuuuguaguuuuaaaaccaauggcuuauuuggaauuugauaacuuaauuuaaacaaauauaagguggacuauacauuaauaggagucacaaagauugacaaaucaaaggucagaugauucacguaguuagggaaaaauaaauuuauguugccauggucauuacuacuuucaaagagaagguggaaaaagugaaauauauaggguuuucuuuaaaguucaguuuaucauuaucuacauuauuauaguuacaaacauggaaaguugauacuuaacuaguaaauugcagagaguagagaaaucaugaucuggaacuuagagcuggcagccacugaucuuugcauaggugccagggaggaaaguuccuggaucacagccacuagucagguaagguauaaaaggacaaauuugggauguggcagaucacucaggcgugauaaucaauaaugugugaaagaugaguacgggcgcaaaaaacccgcaggaaaagacagccacagacacucaaauaaaaagaggcaaaagcagggauaacgagguaacacuguuaucuuuggccauuuaguuauauaacauuagaugcaagacauuuagaaccacgacacguuuaaauaacuacaguauguuucgaugacgucaauauuacauggaaaaagucagauaaaauucagucaaauguuaaguuuaaguugaacuuucuucaacccugcucuaauuuaaaacuuuuuuccccuuuuauauaaagaacuguuacuauuuuagaagcccacacacaguuuauugaaaaaaagaacauuaugagaggcagcauaauguuacugaagaacagggacuugggagccagaucccaacucugccacuuacugccugucugaccuugggcaguuacugccuucuuuuugccucaguugccaucuauaaaaugaaaugaaguacaauaaaaccauuuuuuucaucaaccucguaacaaaaugacaaggaggaaaacaagguucaaggacuugcugaauguccuuuugcuuaaaguugaaguuucuaagaaccuacugacaacauuaagugaggauguacuguacuuucccuuuugcgaaccuucuucaaaacugcucauuguguaacuaugaugaaauugcacccccaaaguggucuggccauuugauaguuagaccaaaauacagagguuuuagagcguaaaugacaguacaaacuacuaaguguaggaaguucccccaagugaauccuacagagaaacuucccagucuugguuaaagcacagguugaacagguauuacagguuucuaguuuaacucuucuguacuucagaccucaccucugaaugucaaagagccuaucacugccaauuuaaaacugauuaaauaaacacucucuaaaaaccuguaaaaugaugucuaggaggccauaacauaaaaaguuccuacccagaaauaagauucuuuugauccaaaauguaauucauaaauuaaaaaaaaaaaaaauagaguacacagaaaagaggugagguacucauauccucgguuucuaaaucaaaaaacaaauguuuacugagcaucaggcauguauuagcugcaaagaugcacguguguaagcuugacauaaauagugcugugaucaugggauagacaguguguguuucuuacaaagccauuuauagacuacuaaacaggaaaaccaaacaucauguagcacuucuuugaagaccugcaauauauccacuggugggaucgucaucuccaccccaucaagaaaagaaauuuucagcagcuccaaaacucuaacucuuaaggucuucuauauaauuugagugggugagugucccagagacuggggucuucaugaaggacagaacgggguauuuuugcuguugcuguuuuauuuuggggagguuaguugguuuggugagcuuuguccagguuaguugguugcuugcuuugaggagaaaaaauagagggaaaacagaggaguugagguggggaaaaacggcagggaggaagaauguguuuacuuuggaauaucuucaauugauaagucugugacauccgcaaguagaaauggaaaaaaaggguuugaagcuggggaaagaagacagccagagauaaaauuuuaugagguaucaacuguggcuguggaugauacauauugaaagaauaaggccacucagggagaacagauaucgagaauaagcacacauuaaggauauaagcaagcaaggccaccagcauuuaagguagaagaugagccaagggacaagacugaguugucuucagagaagcacagagauguuccacugagagcagugcugagccagguaaagaaggggauuuuaaggggugggcaauagugccaagaaagaaagauuaacaucauagccacauucaaaaggugucaaugaaucuggcuauuaaaaaaauaaucuggaaaggccaggagcaguggcucacgccuguaaucccagcacuuugggaggcugaggugaguggaucacuuggggucaggaguuugagaccaguuuggccaacauggugaaacuccgucucuacuaaaaauacaaaaauuagcuguggugacacacgccuguaaucccagcuacuugggagguugaggcaggagaaucgcuugaacccgggaggcggaaguuacagugagcagaguuugcaccacugcacuccacccugggcaacagagagagacuccaucucaaaaaaaaaaaaaaaaaaacaaaaacaucuggagagcaagaaguggggaaaauaucaagaaugagggcaaguuaaaagaagccuuuucagaaaggggguggcuuaagcaaguuuucugauuugaagaaauaaaacaaagugaaaagaguguuacccaaguaacauccuaaagagccuuggucaggggguggaaauccauagcaaaagggcaagaaaaauuucuugagagagaagaauaaugguuaccccuucaaacagaaagaauggaaguaaaaauggaagaaaauucugaguuugguugcuagaaggaaaaauuuggauaaagaacauucuugucagccaacuuuucucuauugagagagaagggugugguuguguaaccucuacagaggugguuaggagguuaggggccauuuaaagagccacugaguguuuacugaggacucaggugaaaucuggaaauuagaaauuuguaauggucccaaaugaguuauuuuauuuuucccaagagaacaggaaagagauagauagauagauagauagauaggaagaccacacugaaaaacuaguaauaaaaucacaaacaagaaguuaaacauaguuuuccaggacacugaaacacaucagugauggacagcggggauaacauuugaagguacauaaccuucaucucagacaaaauagacucucagggccuccacaguauggcggaaaagagcaaaugaaagugaauucaggcugggcgcggugggugugagccacccauaaucccagcacuuugguaggccgaggugggcggaucacgaggucaggagauugagaccauccuggcuaacacagugaaaucccgucucuacuaaaaauacaaaaaaauaagccaggcguuguggcuggcgccuguagucccagcuacuagggaggcugaggcaggagaauggcgugaacccaggagguggaguuugcagugagccgagauugugccacugcacuccagccugggcgauagagugagacuccaucucaaaaaaaaaaaaaaagugaauucaaauucuggauccugguuaacuagccaugauguuggacuggcuacuuuuuugugucuuaaguuucucaucugcuuaaaagggagaagggacaauuuacaauaccuaccuuugucaaauuauuuuaaguauuaaaggagacaauauauaaaaagagccagcaauguuucuuaacacuuaaaaggcacuaaauaaauauuagguuuuuuucucugcauaaaaugaagacacuagacuagucuagaguccuagccuccuauaaaauucugucuuagauuuaguuguguuagccacaccucacacacuuuaaauauugugaguuacuuucuaccaccaccaucaccgcccauaauuauaccacuuuacuuucauugucucauuaguccugagaacaacacucuuagguagacagggcacuuagcugccagagccuaugagcaaacugagaggcagggagauugaaugacuuguuccauaucaauuuaauguucauuagguuaucuuuguucaauaaaguugcugaaguucauuaaaaagaaagauggccugucucuguagcagacaacaggcucucugcccccaacucuuuuuuuuuuuuuuaaagcuaacuuacuucugauuucauuuauaucuuauuuucauugugcuuuaauuugucaaucauuucacaugucuuuuuuaaaggguacaagguaaaugcuauccauaaaauagagaauaucuaaaauuaauguauguaaaauuagccagaucaguaccuagcauaaaaagcacccaauaaauauuuaucgaugugcaaaacagcuucugacugaacccuaaaaauuguuaauaauuuaauacuuauuacaaucuuugccugccuucuauguuuacaugaauauuucauugggggaaggcacauuauuucaguguuaucucuacuauccacugaaauaaauaauuuuuagaugaagacagccccuaacauacauaaaccuaguauuccauggaauccagggaaucaaaggggucuagagaugaauucagaaaacccacuaaguuggguagaaaauaaauuuuccuuuauuuucacuauucucuaacuaaaauuuagcauuuccuuccauuauggaugcaugcaacaagccacacuuguauuagcaguaucucugauuugucaccaauagaauuuagauauuucauaucaaauuacaguuauugcagauacccgcuuuaaaaagagacaucuaauaugaauauaaucaagauuauacuucuuuccccugaaggaaagaauauucgcaguucuguuuugaaguuggcauccacauacucaaucuugguuaaucucccagaacacguacguuauaguaaauccucuucuuucaaugccaaaaaguuuuugcuccuagaaaugguuuuacugguaucuucucaaucuauaucucaauaucugcuaauccuggagagcaagaauggccaacacacuuuagaaaguuaaaguccuauuuuaaaucuauagacguuugguuuuuacuuugagcaaaauuuuaucauuacaucaguuuaaaacggugguucgcacccuugguuggcugcacacugggaucaccugagaagcuguaaauuauaauggaauucugugggaugcccacaaauaugagggguggagacacggagauggggugggagaggggugcugauugugcguuuuaauaagcagcuaaccgguaagucuguuaguuuuuaacacccaaaggguuuucuuauaaguuagauauuaauauuuuuggagaacguauuuucuccaauucagauagaaguuuuaugacauucacugaaguguuuuuccagugaagaaccaaugauuaacucaaauaagcuguggggggaagggagaacaagcacuugggagcacaagugagggcaauuggcacauuucauuuucucuuccuuuaaaauaauggaaguaaagaguggggaaaaaaaauacaugaaguuuuccuacucccuuucuucagagaauuguucuaaugccuuuauucagagaaugaucugaauauuucuaacuuaaaauauuaauauagcucuacuaagaagggacaugaacuucuaaaaacucagauuuacuaaacaaaacaguguuggacauuucaauaaaagauuaaaagacuaguguuucuauaauaaauccuuugauuaaaaugaaaacaaaaccuuacucuuuuguuucauacauguacgcuuuuacuauuacuaauacuguuauuauugauucuauuuccauguuuauccauaaaauccuugaauaacaaaaauucuuaggacaauauugagauuauaagccucuacaccccuacaaauuaaaauuuaauauuaaaaugucaaaaaucuaaaacauacauugacccagcacuguuuauuauuauauaaaaaaguuucaucaguagcugacaaaagaaggcugaaaaggcaggggaauuaucaucaauacauauagcuuuucuaauaauaacuaaaaagauguacaucaauauuuaauaguaaauacucaagacacauuaagugaaucaaguuaugaaugugugaacuauaaucccaauucucuuauuauauaaauguauaggaaggaaacugaaagaauacaugucaauaguuacauauacagugguagaguacagguauuaacauuuuuuggugugauauucuacguuucccaacagaagcacauauuccuuucuauucagaaaaaacauuuuuucaaggaguauauuguuguuaugucccauuugguugcaauauaacaacuuaaaguuaaaaagcuuuugguuuaaaaagaaugaaaggaguaauuuaugacccaagguauaauuucauacuauaagacagaugaugaugaugaugaagaaaaugauaggaaugggaugagaugacugucaguguucaauaacaugaacuuuaucuuaaaaauaagaacacuggaauucuaugacuacaugucauaauaaaucauuuuaagagaaauaaaagaaaaaacuaaaacauaaaguuauuuacuuaauacauacuaaaaaauagauuuaacaguguaaaaauaaguccauggaugacagauaaauaacaauauguuaacuaaaaugagagcuauaugggggcccaucaacaaauaaaucacagaagccaacuaugcucuaccacaagaucaucuuaauuccaccauccacaaaauugucaucugaaggacccacaucaacuuacuauaauaaacagcuuacuauugccaauuauauauaauuaugcaugaccaugcauuccuguauauacauaaaaaaugaauucacugaugcauuccuaaaggccuugccugucucuacgggcuucaaauacuuuugaguauuuauuucaauuuuucaaauuaaaguuuuuauuuaccuauaccugacauucuuugaacugaaaccugcagaccuaugcuaauuuguauagcauaaauggcuuuaugagaauuuaaacauuuaaucagucuagaaaagacauuuaaaaguuuaaaauguauguuauucauacaugaaaguaauauuauuuuggaacuaagugaacugugcacaauuuuaaaugaaacauuuaauaacagaauaaacagaauaacagaacagcagaaguuaaaacuauaagucuguagauggguaagaaaauguuauagcaaucaucugagaaaagcagacuacugaaugguaucuauauuauggguaaacuauaugaaaauguuugauggugagauuguggguaacuacuuuuaaaaauauuuaagacuaugaauacaucauuguuucaagugaaaagggcaauaaaaauuacagauaaggcaacuuuucuaagccuaaaugcccaauuuacuucuuuugggauccagauuuuaaguaaaggaauaaagaauaaaauggaaugcacagcuguuugcuucuaggaauacaaacaggaggaaauaaacagagggaggcuaaugucuuugagacugggcuaacuacuucauucccagcuguguuuuaaucugucuuaccaaacaauaacaaacucuuuuuuuaugacagaggcugagaaauuccauuugugcccagcaaaaguuaaaagcacauuaggaaauauuugaaaugucagauucaguaauuuguccggucuuauguuccaaguugcauaacaucaguugaauuuuucaggaguuaaacaauuuuaauuuuaauucagagaugaugauagagaugucugaucacuuacaaguuaaaauauacauauacaaaauauguauacuuaaaguauacauauacaaagaaugaacaaguuaaaaucacacccaauuuacuacaguaagaaaauuaagucacuaauaaagcaagcugguauauccugaggucagcuuaugccacuggaucauaacuacaaacaggucuguucucaaaacuucaaaacuacacaaacuucaaaaacuccacaaacuccacaagacuucuacuauagccacagaaaucaggaaaggcagggauacagucagauggcagugagguaauaccaaagcaggugaaaugucuuuuacagcaaauuuuagguacuagugcuuuuuuguuccuuuaaauggaaaaccacagucaguggaagcucagaaccugaaaaaaaagaaaaaucaagaagaggacauccacggaauguacugaaaguacacauucuucaagcuaccaguuuucaaugccaccagcauaccacagccaccuuuacacaggacgcuugauuguaggacauagucuaaguuuaaaucuaaguuuauaaacuuaaauuuuuuuuuuugagucggagucucacucugucgcccaggcuggagugcaguggugcgaucucggcucacugcaagcuccaccuccuggguucacgucauucuccuaccucagccuccugaguagcugggaccacaggcacccgccaccacgcccggcuaauuuuuuguauuuucaguagagauggggguuucacuguguuagcuagaauggucucgaucuccugaccucgugauccauccaccucggccucccaaagugcuagcauuacaggcaugaguaauccuguaaucccagcacccgccaaacuuaaauuuuuaaaacuugauuauaaacuugauccaaguuuauggcaauagcuguauuaguugacaugaguagagguuuuuuaaaaagcugucauaauagauaccauauauguuacacaaaaugaugacuaauuauuccagaguucggcaucacuuaaaucuuccauugccucuuuuucaaucuggugaauuuuuaauaaucugaugaccuauuguuuauauuguacauggcaguuuuaucauaaagcacaauugauaaaaaaucuuuuuggguagaaugcugacccaccugauucaaacuugaaucccagcucugccagcccuguaagguuuaggguccucauuugcaagauuaaaugguugcacagugacagguacauaaaugcucaauaacugacggguagauugguaugguguaugcaauaaaugacauaugcauauaaaagacccagcagagugcuuggaacauauaguuaaguguuccauaaacagaagauaauacacaaaacaaguggacaaaaauuuaaaaccaguaaaaauaguuucggauuuaaauaacuuuucuuaaaaucuaaaaaaaaaaacccacuuauuagcaugcaguauguuaucucuaccaucuagcaccagaccuacaaaaugguagauauuagagaaauuuuguugcauuacuaaauaaugaccaucaacaaaauaaaucaugaaguucaugaagaguuuguagacugcuuauuuccucuucguauccccagugccuggcagauuaucugacauaaaguauuuguuuaauuucaucuuuucccacucaaccaaaaaguacauuuauuugaauuuuuaaaacuuuuucuuuguaauuuuaaacucagcaugaggguuuugugauuacacuauaacauauacgaggguaagcuguauaacauauacagcuccguguguguguguguguguguguguguguguauguacauauagauauaaaaaccauauauaugguuuuuuuuggagacagauucucacucugucaccaggcuacggugcaguggcucaaucucaggucacugcacucuggcucccggguucaagcgauucuccugccucagccccccaaguagcugggauuacaggagugccaccaugcccagcuaauuuuuuuuuuuuuuuugguauuuuuuguuaguagagauuuguuuuuaccauguuggccaggcuggucucuaacuccugaucucaagugacccaccugcccuggccucccaaagugcagggacuacaggcgugagccaccgugcuggaccuguacaguuuuuuuuaacuacauuuccaauauauagucaaugcuuaaccuaaaugcaugcauuuuuucauguucuguaaaagagggaaauucuuaugauaucaacaucauaaucucuuaucagaguucauaccaaauacaugcacgaugaggccauauaaugaaaaauugcugcuggggagcucuauuuuaagaaacagucucagaugugacaaguagaagcagcagcagaguaaggugaucacaguaaagggacuaacaucaauguuauuuuggauccuagaaacauuuagucuaaguggcauacugaacuuuugccuccuuucuuacuaaaaauaaaacaugaaaaaaaaaucagucucucauauguauauaauuuuaccaauaauacauggguuucaccugagaaauacuccauaaaaucaguuuucuaaaguaaaaaaccaaauuuucacacugcuccauaaaaaacucuuuaauuauuuccucuugugucucacagaagaagaaaugacuggcuugcucacucccugaggagaaaaaaaaaaacaaaaaaaggaaaaaaaacaaaucaaggaagugcuccuaaccuuuugaccacccccaacaauucaagaacauacuccagggcggucccugcaauaagaacuuugcgcgauaacugauauaggaaagcucaaaaagcaagauuauaaaacggaaacuacuuuuuaacacaaauaauucucucaaaaagcaaacaaaaauaacauguagcaauuauaaaaauuaccuucucugaacuucuggguuugccugcuuaaucuaucacagagaaaggggcuacucaacguauacuuuacaggaaugucucugaagaaaaagauguucaaccacagaugaguuauuuucagagucagugauauaaguuauuucuagggguaugcguacauucaggacaguaagguauuaucauauucaaguuccacagaauccugaaauggucacucuucuuccccauguguuugauuuauuaugaggauuaugagaaaaacauuauaucuauaguaagaaccuugucaccuaagugaaggcccuuguaaucuuagugcaaaguaguaacaaauucaagauaaagacuaauaauauuuuauguccaagacuaugguuaacacuuuaaaacuguuaccuucaauugcagaggaaaacagauuccauuugauucaaaauaggucacauuuaaagcccuaauaccgaugauuccuaggcuuauauaaaaauucacagguccucaaacugcacuagaaauggcugacuaaagacuaagcaaaaugcacacauacaaaaaaaggacgugaagaaaaaacaagguuucgggacuuaauagaaaaaucuagcuuucuuccauucccagcaggcuccuucuuacuaaauaaauggacuugaguucaugauucagaagcauauaauaggaguguuuugauguaaccucauggucaaaacagguuuaggauugucugaauuugcuucuugccagguaaagcaguugauauuauaaaaacauauuuauuuuacauagagcuugugaggucuuccuagugauaaugaccuuccugaugaagacuaagaauuccuauguacguuuuuugaauaaucugcuucaagacaggcaacugaaggaacuugugaguggcacucuacuccacaugcacaacuccuguaguauuccuuccuacguuucugacucccuuauagcuucucaccccuuuccucauuuucuuucugaugccugagccccaccaguguaaauccagagguuugaccuaauacugacacauacagaaagguuucucaaucuuaucuggcuuuaacuuaacaucauuagacauugcuggggcauaugaaauccuucagggcaaagcuugucauuucucuguacucacaagacucacagacuguaauuagaaggcacucaguguggucugaugccguuauaaaagauaacauuauauuuuaaaucacaaaaaggccaauauaaauauguuacuaguagauuccaguuuuuaaaucuaaaagacacaccaaacauucugcuuccaucaaugaauacaaacaaguaaacacaaaaagugaaaggcauuuaauuagcauauuuaaccauucucacuaauaagagaugagucaccuuuauuccaauuacuucuuccaaaauuaugaaggccuuuuauugggcauuuucccgaauaauuucucacucaauuuguaguacauacugaaaucuauuccaguuucuugaaagucaaagauugagaggaaaauugauuauccauugcugaguaucuugguuguacacaauuuuaaaacuauauaccuuuuaaauaaccaacaagaaaacaaggaagagaagaaagaacaaaauaagguauaaauaaaccuaaauauaccaacaaucauaaguugacuauaaguuaaaaaaaaguuuauaaaacuggaaaaagauucauuauauacuauuuuaaaaagauacacccaaauauacggauaaacagauauuuuaaaagggugaaaaaaaauuagaguagguaaugcuaaauaaaagaaaguuuauauaucaaaaucagacaaaacagauaaaggcacaaguacuaccggagguggagguccccucaugauaaaaauguuggcuucauucugauggcauauucuacacuuaacagaacauaacaauucuauacuuaaaugcaucugauaauauaaacucaaaauaaaaggacagaguacacagagaaaacaagaagucacugcaacauuugaaaacuauaauaucccuuucuccaugacugauucuaaccucauacaaacucuuccagaguacaaaaaaguggaacaccuuccaacucauuuucugaggcuagaccaaccuugcuaucaaagccagacaaugacaguacaagagaagaaaauuacagggcaauuucacuuuguuaucauaaauaucaaagucuuaaaugaaguaucaacaaacccaacagaacaauguacagaugauuuuaggggggugaaacuauucuguaugauacugugaugguggauacaugucauuuacauuugucaaaacucaaugaacacacaacaccaagagugaauccuaagguaaacuaugaacuuugggugauaaugaugugacaauguagguacaauuguaacaacuguaucacuguggugcaagauguccacagugggggaggggguaaagguuuguguguguguacgcguaacagagaacuuuauacauuuucuacuaaauuuugccaugaaccuaaaagugcucuaaaaaauacaaacuuuauuaacuuggaaaaaagaguacuucaugaccaaguuggguugaucccaacaauguaagauuuaccauuaaugguuuagcauuaacaagaguauuaaugcaauucauggaauucacugaauaagcaaacuaaaagaaaaaaaaucuuaaugaaugcagaacaaauaguugauaaaauucaauacuuaaacucauaauaaaaguucuuacuaaaguagaaauagagaauuuccuucaccuggaaaugauaccuuccaaaaaucuucaucagauaucauucuuagugguaaaaauuagaauccuucauuuuuacaucagagcuguaguugcuucuaucacuguacuggcaauacuagccagcaauauaaagaaauguaaggacuggaauggaaaaagauuaaaguacuggaaaggaauuaaaaacaacaaaaaaaaaaacaaaaaaccuguguuaauuuacagaagacugacauaauuuuauuaaaauuaagaacucuguucgucaaaagaucucuuggaaugugaagguaagcuacaauguaggagaguaaauuugccacacauauuauggauaaaagauuauaauaaagaaauucccaaaaucaaaugcauguacuuuacaacuucaauuacacuccuauuuacagauccuagagaagcucuuugacauaaaaaaaauguucuuauuuuaagcugaguaucaugugcagugcuuauucaucuuauuuucccuuaugucugacaaauguuauauucauuuggcauuuaauuaaauugucauaauuaaagaaauaaaacauacucaaagauuuuaauuauuaccaucauauauaaguaguauauaaaaaauaucauuggaccccaaguucguacuacugcuaccugcauaaaacaaacugaccugcauugcaugggcaauuuauauuauacagauuauuuuaaccugccuugcucuuuucaaagaaacaaaucugacgaaagacuaaagacaagaaaguaauugcuauuaauuauucuucauguacagucucuaucuaugagccuagagucaaaagcuuuuccuaaauuauuuccagguguuucugagaauuuguaaaaucuuccacuguuguccugcuuacuuuguugccuauuaggcaacuuugugguuuaaagauuaugaaguuuuggucugguucaucacacaguuugaacuuucaaaaugacuaacagcaaaaaagauuaaauauuuacauuaaaauaucuacugcuaauaccaauguaaaaaaaauguggccgggcgcgguggcucacgccuguaaucccagcacuuugggaggccaaggaggguggaucacgacgucaggagaucgagaccauccuggcuaacaugcugaaacccugucucuacuaaaaguacaaaaaauuagccgggcgugguggcaggcgccuguagucccagcuacucgggaggcugaggcaggagaauggcaugaacucuggagguggagcuugcagugagccgagaucgugucacuacacuccagccugggugacagugcaagacccugucucaaaaaaaaaaaaaaaaaaaaguaugaccaaaaaauagaaaaugcuaaccugaaaaucuugauccuugaauuuuuuuuuuaaguccagguuccaggcuuagaucuuugaauuuuacacuugacaacaguauuacuuaaauuaaaucacuguccuuuaguauuugcauauaucauuaauguuuuccaucucuaaagaguuuacauuuggaaaaugucauuucuaauaaaaaaauacuuaaaauauucugaaaaaccauagugaaaauauggaagcugcuaaugacuauguaucugcuuaguauguaagcuauuaagaguucacaaucuaccuacccaaauacccuuuaaggagcacaggcagaacccacaaauuccugggcugaccaccacucuuggccaaaugagucacggccucuguaagucccagggucaccuuucucuaggagucuacugaaacuaaauucagcaaaccucucaaugcccaaauuaacuuuaucuccaauuccucucucaauccaucuacugaccuggcauuaacccuacaaggcuuuguuuuuuccaucccugaccuagucuacaguccaccuucuaucuuacaaauuuaacuaccuauggaaauggugcuccauaauuagcaaacuccucuauacccucaaccucuuuucaaagcauuaccucaguaccuuggcuguuaaggacuuucucccaucagcuguccuacugcauucucucaaagaacagauauuuauuccccauucccccaagguccuucaacuaccugagccauccauucucuuaaucccagaaccuugucauacccauaaccuggcacaucuaaaaucaugacuucaaugaucacacugcaacaccaaaucuccaaccuugcaguauacauguuuaacuacuucccugugggaguucucuggucuuggaagaaucucuaucccaaucuaucagaucacuuuuugcucuacuucccuccuucccagccugaagucuaacaguucaacauuucaacaaaucuaucauacccuaacucuccugcucaucugucuuucacuggauuaaucuagaaaaacccuuuguggcuucaagcuuucauucuccuugagcuccuacugaccacggcccucccucaagauuccauaaauacccaacaagugucugcaaugcaccagugacauagcauuuaaacacacuguauuuuaacaaacugcugacuuguuuauuacaaaauauuuauuacaaauguucaacagauauuuauugagcauuuccuaagaacagaaaggcacuauucuuaacugugagaauuuagcagcaaagagggucagaggagguccccacucuugugaggcucauaucacaaggcagaaaaagaaaacacguaagugaauaagaauuuuaaccagugauaagugccacagggaaaacaaaacaggguaacaugacagcaagugcuuggucaguggguuuugggugugggcagaacaggggaggucaucuacuugaaagacuucucagaagcacacugagaccuaagauaccuuccuccaucccccaaaacagaaucagucagaucuauuuuggaccuuaaacugacacagccccagugaaaguaccaaaccaacuaaacagggcaucaaaagaaaaaaacauaauaacucuauucuacaggaguuaggaauuaacaguuuuaauaaagagggucaucccacacauguccacauagauuucuauauaaucuaaggaguacauauaugaucagcaguguguucaggaucaaguguaaucccauauuucagacugaagaaccuaaacuuuagcuggguucaguaauuuuuucagcauguaccuuacauggauuacaaaaaugccuccaucuuccaccucuccuuguaucuacaaccuuguacaauguuagucugcaacuccuccuauccaaagauggaguccauuucuccacuuuuugaaucugaacugaccuugugacugccuuuagccaacagaaagcaguaaaagugacacugucccaguucugaaucuaggccucaagagacccuuaggugcuucugcucacucggguggaugccugucuucaucaaucacagcaagccugggccuagcagaugaagccggaaccuauuagaggaagagucauucccaucauccuggauaaggccaugcuagaccugccaagaucagcaaagccucuuaccugacuaggugaucucagauaagagcaggccccacagaaacuagagaaagaaacaaacgggagaaacugcccagcaaacccaugaaaaguaugcacaauaauauauaguuauuguuuuaagccacugaguuuuuuuuucuuuucuuuuuuuuuuuuuuuuuuuugagauggagucucgcucugucgcccaggcuggaguacagaggcgcucucucggcucacugcaagcuccgccucccggguucacgccauucuccugccucagccuccugaguagcugggaccucaggcacccaccaccacauccagcuaauguuuuuugcauuuuuaguagagaugggguuucaccgugcuagccaggauggucucgaucucccgaccucgugauccguccacgcuggccuccccaaagugcugggauuacaggcaagccacugaguuuuugaaugguuugucauagagcaauaacugauacagcaagauuauaaugauuuaccucuauucaacucugauaauauauuaauugucuccauuaauguuuuugaggaacugaaaccaauaauugugaaauauuucaauuucagggucaucuucuguaaugaggcuuaaauagcaggucagaaaggaaguguuauauacaguaaagacucacaaccccaaaggacuuuacuucuacuaccaauaauaauguuuguuuccuuucuagagcuucuuuuagagaaccugcugagaaaggaauagcagccagacuuucauaagaauaauggaggggaggggcugacuugauauuguaaaaauccagaugacuaggugugaaagagccugagauuauucuguuaacaacaaaauaacuagcugauuuccuuuuauuuucauccuucuuuucugauacacaauuuuuucagugaacuauuucugagaaaugcaucuacuuuuccaaauucucaaaagaauuucuuuuuugaagucuuccaccuucuucaagaguuuaaguaauuaaguuuuugaaaguagauaauauacauguuaccuccucuucucauucaucuggguaagcauaaaaaguuuacuaacuugaaucgaaccaggccuguccuguuuccuacucugugggguuguccugagaaucaaaugagaagaagagaggguucagaaggaaugugaccugcuaggcccgucgcccacacguaguguguucaggggcuacuacuggucaggggcucugccugugucagccagcaguacgugccugagcaugccuaaucuccagcaccuuugcagagccugaguauuaauacauuuaaaauaacuucacggacaugguggcuuacaccuguaaucccagcacuuugggaggccaaggcggguggaucacuugaggucaggaauucaagaccagccuggccaacauagugaaacccugucucuacuaaaaauacaaaaauuagucaggcgugguggcaggugccugaaaugccagcuacucaggaggcuaaggcaggagaauugcuugaaccugggaggcggagguugcagugagcugagauccugccacugcacuccagcccgggcaacagaacgagacuccgucucaaaaaauaaauaaauaaauaaaauaaaauacuucaaaagcuaggugcagcugcucaaugccuauaaucuuaacacuuugggaggccaaggcaagagaauggcgugggcccaggaguucgagaucaaccugggcaacauagugagaccccaucucuaaaaaaaaauagauaaauuagcuaggugugguggcacacgccuuggucccagcuacucgggaggcugaggcagaaggaucacuugaagccaggaauucaaagcugaggugagcucugaucaugccacugcacuccagccuugggcaacagagugagacccugucucuaaaaauaaaauacaauauuucaaaccuguuuaauuauacaguugcaaucccaauuugaggcauaaguuucuuuuacuucucucuccaccaucccccuuuacugguaauaauucauucugcaguuaaauucauucauuugccaaaaaaaaaaaaaaagaaaaaagaaacuacaaaauaucuuuuucaaacagcagcaacaccuucauucaaaguugucuuuucauagucacuccuggguauccuauaccacauacugccuuuaguauugccuccucacacuucaguuccacucaccuauguaagugucccuaacguuacaacaccuugaauucuucauuccuguagaauauauucaagcuaaguccugccuuuuaugugcagcccuaaacuuucucuuuaaggaaagcucuccuuaguaccacugucuaggcauuucacaaagaaacugauuucuaauuccuaagucacaaggcuuucuuaaauagaaaaaagaaauacguauauuauuaagugaacacuacacuaucaacaaauacucauugacuuauguguaacaguuccuacuuucaagagguguaaaaucuauauaagaggaagacuaaaugaucacauuucuaaaccacucugagcaggccaugcauuuuaaguuguuuuucagcauaaaugauauugaggcauauucucuuagaaccccaauggcauaaacuuggaaaacauauacccacguacuuuaucucuuuauguaauguuucacaguuuuucaaaguuuguucauauaaauuaacucacaacaucauaagccuauuaaaaugggcaagacaagaauuauccucuccacuuuacaugagagaaaacugguauauaacaguaucaauuuuaucaaaguaauacagcuaacuaagguaagagagucaaggucuaacacauugcuacuuuccacuucaccacaauucuuggugcccacaggcuuaugaagaugcacacuguggucacaaaacagagagcauauuccuguuggcaacucuaacuggucuaagguauauuauguucugaacuccuaacugccuaagugggugcacacugggcuuuccacuggguugcaggagaaaauauuuaguaccucuauuuacacuuauuuuuaaauaauaagaaaaaacagcuuuacuaauauguaagacacagauugacagcauuacauguauauacuuuuuaaauaaauacauguauaauguucguacuugaggguauauacucaaaaacuuuuuauuuguaggggugcacaaccaaaauauuuucgagaugucuacuaagcuaacuggccuagauaucaaaaauacaaauaaauaccuaacauaaaucacuaagaaaaauaacucaauagaaaaacacagaaaauaugugaaacaggaaauuuacagaagagauucaaaugggcaauaaauauugaaaaagaugccaugcauggcugaaaucaggagcauguaaauucaaacaagaagauaccauuuuugcccauuggccuagccaaaacuuaaguacaguaacaccaagugcuggcaaggauauaaguaaggauaaauaauuaagacuuuuuggaagaaagcugucuaacaguaaaccaaauaggaaaaccagaaauuaaucugaaugugauuggcaaaugucuccaaugauuuggccaacccuaauucucagaggaguuuaagaagugaauguauuguuaucauuuggggcuuuuugaaucauuaugcagucaguuuugcacaaugugucauauuauuacuuuuguaaguuuuuuuguagcuccacagacuuauuaaaaaguauuauuuuucaauauuaugauugcacauuuaagcauuuccaauuuuuugaacucuacuuacgggguuuagcaggaucuuacuacaacuuaccaaagcucaacuacgaauacagccuauuucagcaauuccacaucuaaauaguuguuuuauaaaacaacuguuuuauaaaaauauuugcaugugaccacaaagauucuguuuaaauugguucacuaucauacuucuagcaauugggcagggggcgggggaaauaggaaaaaaccucgauguccaacaacaggaguauaacaaaaccaucaagacauguuuuacaguuauugaaagaacgauauugaccuuuaaccaguacuaugaaaagaccuaagauauuuauuaaauaaaaaguuaaagaauaguaccuacaggacaaucccauuuuuguuaaaauauuuauguauauauaaguauguacaugcaaagaaagaacaguagaaaaauggacccuaaaccacugauacuuauaacuucuuggggagcagaguaugggguagaagggaaaaaucauaaaagaggacuuuacugcaucaggaggaguaggaacaucuuccuacaaguccucuuggaaggcagagggcuauagugcuacuccuauucaaauacugccacugauaauaacuacuaacgaucauagaguuaguccaaaggucaaaucgacaguucagucaagcacauaaaaucucugucucucucucucucacacacacacacuccccucacacaaacacauaugugagauaucugucuacacacucauauaacccaaggcacuacuaucuugauuacuagcauagguacuuugauccucauguuugaacucugcuacagcugugucauuuaucagugggaaacagcagcccugguguaaaauaauuguauugugcaaaguaaucuagccuuaagauaccaauuauuuauaucuuuuacuaccaaguguauuaacugucaaugugaaacuggaauaaacuaaagaucaagacuaaauuuacucagguauucaaauguuuuuaaaauauuugggcuuacauucaaguucaugacuuacuuugauuuucuaagucucugacuuuaugauaaaaauuaacagauauugaauuaguacugguaaacacaccaguauauccacuuccucaccuaaauccuugcguacaucacuagcuuaucacaauaugcuuucccacugauccagaaguuggucuccaaauucuuuugaauacauugcuucaaacaguuaucgcuaaacagaguugcaaugcuggcugaaacuuauuuaucaucucuggcuguccauuacauuacgucccacacuccuuguauuugcacuccuauguagcucuccucccacaucugacuuugacuuacaucaaccaggaccacaugggaaagcaugauauaagcagaaguuuuauaagugucuaaaacuguggucuguucuccuaggauaauuccucuuagaagccaacugccacgcuacaaagaaaacuugagacagacuaacugaugagaggccacgaggagagacgcugguguuuguuccagacucaugaccucaguuauaccgcauggaacugaagaccagcacagcugagccuagucaacuuaaagaaaagugagaaauuagaaaucaucguuuuaagccacugaguucugggguaguuguuuauguagacauacauaacugaaggacuaaucuguguuucaaaccaucugaaucucuaguaauaauccauacagacucucuaucaguuaccuuucaaauuucaucuauucaaucagaagcacuuauugcaguuauggagaaaugaaggcacuuucauacauucuuauauguucucaagugagaacauaaaucugcacaaauuuucuaaagggcaauuuggcaaauguuaagugaugaaccaucuaaaaagcucauguauuuucucaauuccaauucuacaaaaaacagacaugcauacaagaguauucauauaaacauuuuucucacagcaaaaacucacaaacaacaaaguuaccuggaaguagaggaauaaauaccauauauucauaagacagaacaucauaguuauuaaaaaccuucuacugaauaaauauauaacgauauaaggauacuaauacagcuaaugaaaauaggauuugacacaguauuaucaauagcaauaagacucaaaucuuuaaaaauauauauacauauuaacugucaaugugaaacauuauaaaugcauaauauaugcauaugugccgcauacauaauugugcauaauugcacauauaauuacauauaauacaugcaucuaugcugcauauauaauuauguguuauauaugcauaauauaugcauauaauuguacacaauaauuauauuaguagaaauucucucugcacaacaggacugugaaugauuuuuauuuucuccaucuuuauacuccuuaguauuuuccaaauguucuacaauaaaaaugaauugcuucuauaagaaaaaaacacuuaacauuauaaaacagguuaaaaagaagcauauacacuaaacguacacuuuuauuauuugauuuggaaucauucugugguauuucuuuacuaacuuuaaaaaaaugccaucaagcaagugccugcaaggugcagaaaaaaggaaauccuugcacauuguugguaggaaaauaaauuagugcagccauuauggaaaacaguauggagguuccucaagaaauuaaaaauagaacuaccauauaugaucuacaaucccaccucuggguguauacccaaaagaaaugaauugccaccucauaggaacaucugugcucccauguucacugcagcauuacugacaauagccaaaauaaggaaauaacccacauguccaucaagagaugaauggauaaagaaaauaugauggaauauuauucaucauauucuuauaaaaaaugagaccuugccuuuugugacaacauagauagaacuggaggacauuaugcuaagugaaauaaaccagacaaaaagaaaaauacugcaugaucuuaaauguggaagcuaaaagaaguuuguaaaguaaaauacauaaaaauagaauagaaauggggggaugggaauaugcagaucaaagugaguauagaguuacacuuauagaagaugaauaaauuuagagacuacaguagaggacugagauaauguauuguauacuggaaauuugcugaucaaguagauuauagguggauaugugaauuugauugacuacuguaacgauuucauuacguacaucaaacauguacaccuuacacuuauacacuaaaaagcuauuguuaucagacuacaucuauauugugauagaacagaauugauuuuucaaaauaaauacagauguguuuuccacagagaaaaaauucacacuaauuuuaccauguuauauaauuucuuuguauugugaaaauugggcaaggaguuauuucuuuucaaaauuuugucaucauguccuauuuuacugaguuuuauauuuuauguugaauagcuuuuaaaaaaauuuuuuuagagauggggucucgcucaguugcccaggcugaagugcaguggcaugaucauagcucaccucagcuuugaguuccugggcucaagcaauccuucugccucagccuccuggguaaccaggacuauagggguacaccaccaugaccagcuaauuaaaaaaacaauuuuuuuuuguagagauugggggucacacuauguuguguaggcuggucuugaacuccuggcuucaaagaauccuccugccucggccucccaaaguguugggauuacaggcgugagccacagcaccuggccuuaacauuuaauaauaugcaacuucaaccacuuuagcgaaaguuggaauuuucaccuuagaggcaaacuuuuuuagagcaugucuauccaaagaaacaauauauguaaauaauccaaguuauuuggaagggauagggaacaaaaaccacuccccauguagacagcaucauagcaagcaagcauuggcaauauuacucaagcacugacacuguuugggaauuacucuucaaguggccaguaauuucagaagcaccgaagagaaucccuggccucaccuagcagggugagguuuccaccacagugaaguucuacugccacuugugcuaaaucaguuucuucaaacucacuugcucaggacagccaaucuaggacuggcuucuacucauucuuccucaaaauucagcacuuucucuucauccucccugguccuggccugaaccaucccgaauaacuucaacuauuacuucugcaacacaaggcaaaaagcuucccugaauaucacugguaccauuacuucuuuucucagaaguuuacagaugcucaggucucccuggccuuuaggcauuuugcacuauauuauaagaagaccucugaucucuagucuuucacaucuugacuuccaaugaugaacugggccuuccucucuaacuguauguuucuggauggcuugccaauguuagugccuuggcucuagcuaaggacagacaaugacugaagacuagcaggccaaugucugcucuaggaacaggcaugugauccaagguagucaaaaguccuuguccgagauuuuuuuaauuugcaacuagagaagaaaacuuacauuuuagguuaaaaagcuaaacggguguaauuuggggcugcacguaaccauuuuuucugguuaaagagaagcuuucuguugggggggagggguggaaagcaggugaggaagagccuugaagaauuuacuugcaucacucuugaaaucagugugaaguguuuccuggcugggcacgguggcucaugccuauaaucccagcacuuuggaaggccaaggcagguggaugaccugaggucaggaguuggaaaccagccuggccaaacauggugaaacucccauaucuacuaaaaauacaaaaaaauuagccgggcguaguggcgggccaccuguaaucccagcuacucaggaggcugaagcaggagaaucacuugaacccaggaggcagagguugcagugaaccgagacugagucacuguacuccagccuaggcaacagagcgagacucugucuccaaaaagaaaauaguuuccuuuuugcuuauacuaguuggcuuugggccagugacuuuuacaacaacaaggguugugacuagaugacaaaugagaagaaaaaaaugcccugggauguucagauuuagguaaagaggcuugcuuuucuuacaauuuguuuuagggcuucauuucaaacaccuaauugucuauuacaugccaggcacuggaagcauaaagguggcuacaguauaagacuaucucugccuucugagaccuaauaguccaaaagauucucuugguguggguggcuuacuggucacuucagagcauaauuccuaaguaguucagaggacacuccuuaguggccaagauguucccccaguggcucugaaaugucuaucaucuguaccucaugaggaccucuuuauuucuuuuggguuucuacuggacccacugauuucaguauuuuaaaauuuagucuacauucacuucuuccauacuaaucacgauaguacagacuucaguaauauauuuccuuguuuucuugaaaccaaaguagacuuaaaaaguagacuuuuugcuuagaggauuuauguguagucuaacauacuauaaaauguacuuauuuauuguuuacuuugacauucucucccccaucaucccacuccccagacgggcagaauuuuuugguuuauuucauuuacugauguacacuaaucacuaaggcacacaacuaugaguucaaaauguauucaagagaauuggaagaacacaugagugagugacuaauuggaagaccuugccacugggacugagauaaucauuaaaaucaguuggcuaaacauuguuaucuauuggaugauaaagagcagcuucugcagcagcuuucuccuuuucauaaauugccauaccauaccaaccccaucccccaagucuuucuuuauauauagcaaugcuuucacucagguugugguccaaucucaagaccaggaggcuauuuauucuucaucuuuccagugacuuuacacugcucuauucugauccacucugcagggguuuggagcuuaacugugagaaaugccucucccagcaacccccacaacgggcuaaggccuuucaauauacguagucaaaacauuagauauucuucauagcauuuaucacagucuaucuuacauauuugcaugauuauuuuauuacuggcucccccacuaauucaacuauaaaguucuuaagaguaguguccaugucuguuucauucauaaagcuuaaagcacuuggcacacaguaaauauucaauaagcauuuguugaaugaauaauuagauggaugaauaugaaauucccagccugaaucuauaaauagcuagauagucauuuagguagcugagauaggauaggggaguggguuguguuugcuuuuugaggggaguaaaaagauaaugucaggaguccuuugugaaagucggauuuuagccaccugaaaugcuauguccucucaagcagcucaaaaaccaaaccaccauuaauauguccaccuggggcucccccucccacaccuacuccuuuauuccggucaagggucucaucaucauucuuguagacacucagacacaaaggcuuugaggagcuuuugaccucuuuuuuucugucaaccuccuugcucagcaagacuccuaaggccugucagcucgucuuuaacaucuuugaucaauggccuuuccuuuccauucccgcugccacaaacuuaguucaaguaacuacccaauuauggcaacagacucagaaauggucuccuugauucccacuuugcuccuguccaauccaugcugccuguauugaaaucucccuaaaaccuucauguugcauaauuaacgcuauacuaaaaaacaucugcaaaggcuugcccggaaaauaaaaaccucagccugacauucaaagaccggacacaguaugguuccaaacagcauuccuagacucaccucccaucauccuagcauuuucuacagaaccaucacuaacaagccuaguuaguauuacucaucacacauauucacauauuauacguguucccagccccaugaauguauccucccagucuuaucaacucaucugaaagugaaucccaucuauacccucaggccuagcucaacucccaccucuucaagucguuccagggcagcccagccuaggcugccucuuccuccucugaauucuuaugacucaaacuagcaucuucuuuuuuuuuuuuuuuugagacagagucuuacucugucacccaggcuggagugcaguggcgugaucucggcccacugcaaccucucccuccuggguucaagcgauucuccugccucagccucccgaguagcugggacuacaggagcccgccaccacacccggcuaauuuuuguauuuuuaguagagacaggguuuuaccauguuagccagguuggucucaaacuccugacuucaagugauccgccugccucagccucccaaggugcuaggauuacaggcaugagccaccaugccgugccauuuuuuuacaccauuaacucuaacuuacacauacacauauacacauaacuuuucacccuuaauuucaucuuauauuuaucuguuauuuaaaaaaaugaaacagucacaagaaaagagcaucugcuaacaaauucaaagaaauuccauccuguauaggacagacagguccuauguaaggcccugucuccaggucaucgacucuucaacucuuccaauacuuuuuguguuuuuguauugaccacuuccucccccuuccuaaauauaggccagcuuugagaauaagaagaaacgaaggggucuauccagauuagggaagaaaaagucccuugacaaauccagaaaguguucuuaaaaugcaaccacuugaguuguggggacuauucuuuccccaucuugauuaacuccuuaaauaacuaggagccagcaucaucaucaucacagauaccacuucuuuagaggcugacuagaugcugggcaucacaggaaauacaaggaggauauugagcaaaccuggcccuaagcagugguccuggggcuaaaaauaaaagaauuccacaacaaagucuacugaggcugguaguccuggcacaccaacuugaaaacgaaagagacaacaacaacaaaaaggcuauugugaggauuauaggaguuuaaugcuaugcugaagugccuagcacuaaauaagucuauguuccccaaaccaucucccuguuuuaauauacugcauauuuaucucuacacuacaaacuccuugaaagcugagaucauaguucguaguuguuuuguaacuaaugaauuagcauaaagugcuuuaucaauguaaggaaucacauauuaacaguccaaaacucuuguuauaaauauggaaaagaaauauaaugcccacaaaguguucuaaagaauuauauagcucuaguaaucaaaauuugguuauauuauuauagaaaguauaaaacaguuuuuggccagggguggugguaaucccagcacuuugggacgccgaggugggcggaucaccugaggucaggaguuugagaccagccuggccaacguggcgaaaccccuucucuacuaaaaauacaaaaaauuagccaggcguggugguggugggcaccuguaaucucaacuacuugggagacugaggcaggagaacugcuugaacccgggagguggacguugcgugagcugagaucaugccagccugggcaacaagagugaaacuccgucucaaagaaaaaaaaaaaguaaaguauaaaacaacuuuaaauaucaaauacauaguuaauauauucuaauguuuuuuauggcacuuguuagauuccccaucuucauucauauuuugaauugugaaaaucugaagaaacagauuuuucuccuuacuugcaacgcuaguuuugguaaguuuggaauuagcauacauuagauccagcuauugcagauauugaaacaaaaccucauacucuauuugccuauguaagaaaaaguucaauuuucagaacuuagaauuuuaaguuaaaaaaagcaguaugaaaacauaaccuuaaaaaauuugcauacuauuuuacccccgcaaauauuguuuugauacccaguccugcaaugaccuuuaaauaaucagaauaaaguuucucacuauucagagagccuuaagauuuacuuggcacucuaaguuaaccaucuuaaagcuuugaagcacaaaggaauaguaaaugacacauccauuuuaaguuaccauggccugucauuacagaaucauuaagcaauauuuucaaggagcaagcagaaagcuuuauaacucaaacguauaagauuuucuucugugcuuuaugggcuaaguuauuugcguucucauaagaauacggaauauuuaaagccacacuuuacaaguuauaaaauucacuuauuuucagcauucuucauaaagauaacagcauaaauuaaguuauaaaaacaauaugaaaauucaauaaucaaacucaaacucuguguaauguauuuacacacacaaacacauaguaacauaauuaagaggcuggcuagcuuagggcacauagaaaaauuauucagaaaaaaaguauuaaauaucuuuaaagauaaagauuuuuggccaggcaccauggcucaugccuauaaucccccauuuucggggaccaaggcaggaggauugcgugagccuaggaguucaagaucaggcugggcaacauaggaagacccugucucucucaaucaaucaaucaaucaaauuagccaggcauggugguacacacuuguggucccagcuacucguaaggcugaggugggaggaucgcuuaagcccaggaggucaaggcugcaguguguugugauagagccacugcacuccagccugggugacacagugaaaccccccucaaaaaaaaaaaaaaaaacaaaguaagauuuuucauauuuuacuguuuuuuggccaaauggaugugaaggaaaauacauucucuauauuacauauuuuuuuaaucuagcugcaaacuuguauuaaagaaccaauuucaaaguguauaaaauaaacugauuaacucaaaccuauacaacucuuacgcugaucagguccuuuguuuacauuagcaguacuaucuguuuacaugaagauauguauacaaacauuuuacaaggaaacguaagcacaaaaagcagcaaaagaaaguacacacaacccuggcacuacauacaucauacuuaucugugauugucuauccaaagcuuaaagagggaggauaaaauaguuaagaaggauagaaaagcuagcuuuccauauuucccgcaucaucucugcuuggcauugugaguuccuuguuuuccagaauauuauaaaucccagaacaguacaaaauucaaagaaauuuagaaauggaauuuagagguugccuuuuccagguaaccuaauuuaaagacgugaagacugagcuccaaagucauuaaggucaagaccacauuucaguuccuaugacuuccccacuacaauccucuccucuuaccaccuacagagaugcaagugucaauaccaaaauauaauuaagagauaaauucuuucugguaaccugccauuuuuaacaccaaccaacauuuguccaggagaggaauaauuuaagaguuauauauauuucacuucacaauggaagcagaaacaacugaaauucuuuaggucucccuucuugcagugagaacuuuccagaacacaggauuaggaauagucaaagggcugacaugucuuuuauuggcauuccuaucuuuccacuucccaugugaacaaaauccaccccgauaacccuguaaccuccuuuacauacaauuugaucaauaaccaccuuucuucaucugagaaagaaaugacaaugaaaaacuauagccaccaacacgaaucacuuuccuacuucagacuccuaucuuuuccuccacucugaauauucuaaauauaguuuauguuccugggguuucucauccugcugucuuugcaaacuguaaguuccaaaggcauguuucugcuguuuuauuaugugugugacaaugggaguaguaacucugacuacuucaugaaugaauaauguaugugaagguacucuaaauuguaaaguuuaagauaaaaguagugccccuauccuauuagaaugauaaauaacaauacaaacaaguaaaaaguuucuaggaaauuacagugcacauuagggauuuaacuaaccuuaaaagaaauuagucuucugacauuacccagaagauaaagcaguagcaccuaacauucaguacaucauauauuuaucaaugguuaguuuuuuuaaaaguuuaaugagugauaugcaacacuaugcucaauuuuaggagaaauuacuuccauaauauuauaaguuauuuauugcuacuuuuggacacaauuacuggcuaugaauaccaaaaugauuaaaaccuacaaguuuaaaaaugucuuuaaaguaaaauuauuauagcuuucuuaauauugucuuaauuuuccagagaaaccuacuuaggcauuagacauggcacucaaauaaaauucuaauuuguuuaaguaaacauaaaagaaaaccuaaucaaaauggcucguaaaacaaaagaaacucacucaaugucuuccuaacagcuuaguucuaaauuaaaacauacauacucagcccacacagaauaagauuuuguacuaucaaauaaacauucauccaagaaugcacgcaaagaaauuaaaauguuauugaaaauugaaauguuaccucuguuuuuauaagaugagcuaggcuuaauguacaguagucaaaauuacauugaauaaaugaccugaaaugaaaaaacuguuuuucuucacauauaccauacuacuagcuugacaagaaaagaaguaucccuuuucguggcaauaucaacucacuuuaauuuaggauggaaauaaccaauagaaaaacauuugaugacugcauuucacucaaguauuuuuuuaggccaucuaauaauguauaguauaaucuccaaagaaaagauuucacccaaaaauauucacagaaagaccauaccaugaaacuauuccauuccuguaucuucugcuuucucuauuucuacauccaaaagcaagcauuccuaauacuuauaaaaaagcccuugacguuuuaucuaaguaucuuucuaaaagauuaaagaaccauacagguaauuauaauuuacuggaaguauaacaugaucuuaaaaaugucacaguaaaaauaacuuucuaggcucaaugaaauaaagguaacuuuagcuagguaucuguuauuguuuauaaacuacugaagucuuaacccaguuuggcauuucagcauucucuuucaugucucaguuuauuaaaauuaaagaacaaauaagguuaaacaauaaaaacaaacucuuagguaaauaguuucuaauauaaaaauaaaaagacaaaaccacccauauuuuucguugggggauuaaaauuuuuccuacaugauguugaccuccagcuuuguauuugucuccaaguaguacuaaguuauuaaguuugaacauaaauuaguuuaauauucuaaagaacugguuuuaagauugggacugacuggucaucuuuucucucaagcucuacuaaaagccuuuuuuaaacaaacauaucaauaaaacaucuugacuuagacauauuuaaauaaacugaggcaaaaauacaaacaaugcuccaauauaugcucaugaaauauucaguaacuauuucuauuuuuacucccugaccgucauuguuuaucaaauugugccuagcuuuacaucacuuuugcuaccuauaaacagcccuggucaaaauauacaugaacaagguucacuaaaaaaaaaaaaaaaaaaaagauguucacguaacucagauuuuuuuuuguuuguuaucucucagcacagauaaucaaagaucaaaacuuuaaguaccacauagcuaaugaccaauaauccucuauuacccaggaauauacacagaagcaccaaaaaaaaaaaaaaaaaaagguaauuguggucauauucugaugaagcuggacgauuccaaaagaaaaaaacgaagauacaaaauuauuuuuaaaaguggccauaaaugaucuaauuuccaaaucaaugaaucgaugaauauuccaggcaaauaacauuagaaaaguaagagugccauuuucuucucucaaaauucugacacuauacaaaauaaagaauacagucaccauuauaugauaaacuucagaaaaucaugaucaagacuggacauacaacuauucagcugaggaguaaucacagcauucuaauuacgaaggaaaaaaaugaaagucaaaaaacucacuuuauauaguaucuugcaccuucaaaaguauaugcuucuucccagccaguaggcaaaucuaaaacaauacauauauuacaauuaguauuacuucaaugauagcaaaauaagucucaauccauuuuaauuauccauuuucauuuauuagcuguuuuaauuaaguagauuacuaacaaaaaaaguguugagcuggcaauacaacagauaucauuuuuugaaaaacagcaauucaaauuuagagccaccagaaaaguaaccauaauauuagagauuaucugaccugagcacacacuguaauauauuaggguggagaggaacuauguucuggcacccaagaaagcaaagggaagccuucucaucccagguggaacacucaugaaugacuagcaaaaaaaaaagcuggguauaacaggcaacgccugccucuucuuggguauauugugucuauuuaagaccguauuuuucagcuacacaaaugaauccaucuaggaagugucaccaaaaagaaggcagaacuuccuaacuacuuaauuaauggaaaagaaaugacaccgaauacuuccguguguguuucuaaaaauuugacuaagagacgugaaguuucaaguaguaaaguuggggaugauucaggugaacaauggucauuaugugcuacauauuauuauuaaugacaaguuguuuggauuucaucaaaaugccucuuggaaguaaaaacaaccgauguguguacaaaaccagaguccaagcaaaguaaaaccaaaccagaaaaaaaaaaaagugaaaucacauaaaagaauaaaauuuuucuguggcgugaauguuaccaaaucugugggguuaacuaggacacuuauuuauaucacucauaauuccauaggauaauuagucuaaauaauuuaaaugucauaucgucuuucaugaaauaaaucuaucauuauccauaaaagcaaagaggccaucaaaguuggaauaugcguguaaaacaccagaaagguauauugaagcaaaagccugcaccggggaauugagaaacaugauaguguauuagucagaaaugccuuaaaaauguaagcucaucaugcuugcuacaccagccuuuccuuucuuccuccaccuuuuugcaaauuuggagacauuagucacuucagugaacuccagcauuucacagagaggcagguuuguucaauauccuggcaacuuuaacagauucacggaaugucagaguccgagagaauguaccccagaggccagcucugaggacugcugaaacuggccucgccuucgacccaaacugcucucaagccuuuccaaucaccaggacuagaggcaggccaguaagagaacacauguuacauuucaaagacaaacaagucacgaauguaaacaaagaaugauaaaagaaacccagaccaguacagaaacuacgaggagccuuuuccagcuccacucacacuuagcauucaaacaagcucccaaagccacccgagagagccgcuuccccacggacucccuccaaacagggcccgggugcccccauacgggacacccccucgcacgcccaccgccuccuggcagucugugcaaccuccgugcggcuggcggggacuuuagauccggaucgccagcaacugaggcugcgaacgccuccuccggcuccggcugcuccucccguggcaggagggaacgcgccaagcguuucccgagccguucccugucacagagaggaucgcagcacccccgaacuccucuccuccuccuccuccuccuucaucagccaccuacccacaagucccaccuaggaggaggaagcugcacggcaggaggcagcgcuccugggaggagggggaggaugugguuacguuaucccggcgggcgaucgggguccggggcugcagggaggggaguggguaaggacugccugaagauugcuggggggcaagacggcagcugggggucaccggggagugaguagcggccgcggaggaaaaacucaggacuccagguuucagggaggggagcgucgccacucuagggucgcgagggucgucuaggcugggauggggggagaaggcgcaggaagagggcgccgucuccaagugcugaugaaaggcugaggagaaagaggcgccccgagacuggagagaacucccggcggcggaguccccguggccccucuaccugcggccgcucccgcccggccuccgccccgccucgccgccucccggggcccgcggcgcggggcagguugcggggagccgggcggcccgggcucugccgccuccuccaggcggagcccaacuccguuugggcccggcguuaccugugcucugccgccgguguccggugaccaccgccucgccggugacggggugcagccagguggugcucuuggccuccucgcugcaggggugagagaaggggcagacacggagcgugagaggggacgcgggggcgagccgaggggcugcaggagcacagacccgggcucucccccgugucgccagccgcccgccuccugcccucccgcccccgcgggcccccgugccguccccggcucuuuacuugaugaagaagacucggccgccccuggugaucccguaaguccaggaccggggcagggagauccacuccagguucagauccgccgccaugucugaucccuagccgccgccgccgccuucuccugcugccgccgcggcugccgagggaggagggaacgagcgagcgaagggagcgcggagcgagcgcgccuccccggc

SEQ ID NO: 191705 - RNA, 139436 nt, Homo sapiens
aaucuuccaacucaauuuauuuguuucagcucacgaacuuuucagaaucccuaguggcuuagugacaaagaccuuuggagagaaugaucauggguuuugaucaacacugucgcgauugcauacagacauagcuagagaacaagcccagugauuauucuacagaccauaggaagcaucuacaccucagcugucggccguuugguuacagaaaugcgauccugcaaguugucaccacuauacauaaagucaggcuaugauagcauauuucacuuaaaaauaaauuaucacaauauaaggcacauauguauauggaaucagauucaugauuugaaaaauaugcuuaaaucacacugaaucagcuuagcagaaaaauaauuauaaaauuugaaauauccccuuuucuuuuuguuuuguacuaaaucaauguagaaaacacacuuucuacccugaaggaaacugcugucuuaucugauaaauuauauaagcuccaguaaauguaugucaucacccucaggaaugacaggucucucuuucucacgcuugugggaauugagcguugacacuguaagaacacuugacuaauaaccuuugccuagaccuuccaaacucugcgcguaacuucuugagagaucugaauaaaggccaauauuuucacagguugacagggucuggagaagugggucaccgagcacucugacauuuuuaaguucaguuuacaguaacucuuugcaaaacuucagguuuugcuguacuucaaaucauuugggcaaauuauaagaaaaugaauacaaaaugugugacccuuggguaauucugcacuuggcuuuguucucccuuggugcuuuugaggacaauuucugcaaggccugguuuggcuaaaagggacacuucauugaagaucucuaggccuuuuacuuuuuaaagugucuuuuauucuaaagcuaguuaaccacauauagaaguaugguguuuaucagugauguagauccauuaugacaaugaaugggaagagguaaucuacuccccccauucugugcaaaucucaaacgacaaagcuaaguuuuacuacagauaaauccauaaccaggggaaggaagaauuuuuaaaugcccauuuuuuucuuguccaaauguuugaaaaagaaacauauugaaucucuauccaguggugugguuucuggucuuucuggugugcucaauucucucugugucauuuugguguaaaaauacuauccuacauuuacuucccuugaccagaaaccuugagacaucauaaaaauguuaauuuagcauuauuacuucaugcauucaacaaugcugauuucaugaaaccacacaaacaggauucuuuuguuuuauugauaacagaaacugugcauaauuacagauuugaugaggaaucugcaaauaauaaagaaugugucuauugccagcaaaauacaauuauuccaugcccucucaacauacaaauauagaguucuucacaccagauggcucugguguaacaaagccauuuuagauguuuaauugugcuucuacaaaaccuucagagcaugagguaguuuccuuuaccuacgauauuuuccacauuuccauuauuacacuuuuagugagcuaaaauccuuuuaacauagccugcggaugaucuuucacaaaagccaagccucauuuacaaaggguuuauuucuuucuacucaauuuuucuuaaaaagaauuucaagaaucacuacacagcuaagauaucugagacuugcaauggcuggagucuaucaguacaauaguaauugcaaucagauucagauacaagagaacagguucuaacaauuucauaauuaaguugauauucuguuucuaucuauaagcucacauuuaaaaacuacuuccucgaacuacuuauuuuuccucagccacaaguaagcgcaaauccuuaaaaacaguggguugagccccagcuccauguauuagguagcuagguauauugugggauuauuccuuguuaagucaccccaggaaacauuugcagaauuuagaaaugcauccagauuugugaguuuauuuuuaagaccugacuaaaaaucugcacucuucaaaaacuuauugaugaaguacaaauugaggcagaaauuuacauuccuuucuuaacccugagaaugaguuuaaugaucauaggaaacuaguuugaggaaacugcaauguguuauugcacauuuuaguuaaaaacuaauagucaaccaauuuccaauucaguaaaccuuccaccuaucaggauaggagauaguaaauaguaucucuaagggaaaaaagucacaaucuacuucuugucuaaacuuauuauuuuauuuggccucaagaagcuucauggaucuuagaauaaaaugguugaagaaaugacacaauagauauuacuuacuaugcuauuauaaaauaaagccuaguccaaguugauaauaaucuaaagugguuucuauguaacacaaccuucagauuauaaccucaauagugugaccuaauucuaauaucugaugaaguguuugcuauauuuagucacuaccuaguagcauuauuuguauuuagcaacuacauugaaagcugaagaagaucucaaugcuugacagaauaaggaaaaagcuccuuuggauaacacaaaaauauguuuuguuuuuuuccccuccucuaucauuccuuucuucucuaccuccacuuauucuuccucugauaucaucuuucauuaaauuuuucuccagaauccaauagugagcaacaggaaaccuagccauugugauaguggauauguagagaaaagccagugaaacuauauuuuaauucauucuuacaccacagccuacaucaauucuuaccaucccaacaguagauuacauaaacugaacaucaugcaacucaaguuauacgucuuguugauugggucuauuguagaaugaaaaauacacuuucagacagaauaagaugacuuaaaacuucaauacuuguauccagcagauuugaaagggcacuucaaauuuguucuucuuuuucucccccaucacccccauuucaauuuuuaagacugauuucaugccuuuaucauuuugaagcaaauauguuuauauaugucugaccccaggaaauuauuuacccacaaacacuacuauaacuacuauacucuguugauauguuucauuaucaaccuccccaaauuaaacaucugacaagucuuuuauauauguaugcugaagagaaaaaauaaaucacuuucuuccaccuuugaaucuuuaaaagggguuugugguaaugauaaaaaauuuaucucuuuccacacauuuaagaccucauacugugcaaaaucaugguuauaugaaaguuauuuucugaauagcuggauccaucaccuucaagcuaauacuuuaaacagcaugguucauaauagauauuuucuagaaaaauucacucuaggaucauuuucuuuguuuauuuccaucuaaucuggcuuugcugagaaaaucagcaaggaugcuguaaucugugguguuaauuuauuaggugcaccaugauaacucaacauuguuugaaaagaauucagucaacacauguacuagguugguaguaaauaguaaagaaagagaagguaauucacaccagaugaggaauggugugaacacuaaccuaaacaccaaccuuauuaaguaguuuugcacuagaagaaaggaaggaauuaaagaaggauaaaguugcuuuaaaaaugagauaaacuauucauugauuucuugauaagagauguguucuggccuucuuugcuuaugaucuaacuauucagcuaucuaacuaugcuuuuauagcuacaaucaguucaaguaguagaauacaaacuccaugaggguaaugucuauaugccauugauuucuuaaaacuaacuuccuaaucucuauuguugguuaugucaacauuuaucaaaugaacuauuaauagagucuucaucaucuuugccaaguaauagguaaugcucauugaaaagcugguacccuuugccuccuuuuguggggagauaucuggaaaauagcugaacaaacucuacauguggcgaaacaaagugacaguuguuauaaaaugucuacuaaaauuaccugcuagcauuacuacguauaacugaaguuuuugcauauccgcauaagaagaaauccacauuacaaggaaaaguacuuugauaauuuuagagucaagacaugaaauaagggauuucucuaacccuuaacucuucugccggcuuacuugguaccucugaugaauauuuauugcucuaaauguuuuagaaacuaucacucuuugaaagugaacaaacaauguuuucugcugaaaauucaucuuucccaaucauaaggggaaaccaaauaugcaacuugaaaaaaaaaaaggaaacagaauauagugacugagcacugagugggauugaagaaaauaaaugagcuuauuuuggcagcugcuuucauagcacaauuccccaaaagcagaacugaaacuguagcuuuaauaaaaagcuccaacaauucuuuugacuaagauauacucauuaauugccuccaaguguucaagacugcuuggauuugaggcaagcaagaccacuugcuuagguaaauuuuaugaagcaacaaaacuaauauggugaagaauuuuaacccaagguguaacuuagguuucccaugucuucaagagagcugacauugcauguuaccaucuagcugauguuacgcucugcuuucuugcuacugccugccucugccucuguuuguuuuuuuuuuuuuuuuuugucuuacauuuuuucuuacagcaaucuuuugagaaaagaauagagaauguuuaccagguagaaaaaaccugauuccuuaacaagacuucucagucacuuguuucucuuucccuuucacuuuuccuuugugcuuuugaaaacaaaggcuaaagcagguguuauaaauuuauucauuccugugcuagagagcauggaacacaucucugaagucaacucuucuuuugguguaucacgaguugaauccuuaauaaaugacugccacaaagaaaauuucuaacagcaaaucuuuuuaggaacugcucagguuuugccuuugucuugacacuucauuuuaaaaucuugguuucuacugauguguuuucaaaaaagcugacaagcucggucugaaauguagaaacugaaaaaagugaaaggaagagaacaugcaauauaaguuaaucauuaucauuuuaagugccaccaguucuguuuauauuaaugcacuugugaauugcugaaucucauuugaucaacccaauuaaacauuaaauaauugcagccaauuaugcaaauaucagcaacaauauuaauuuguugaucuuuuugagcagauuagcuucacauguuccuaaugcuagaccaucuuaugccuuaaacgaucaauuagugugacaauaacuaagucuugaagaauggauaauugccuaguuauaauguggcacucuugcuguauuaauccacugcaauuaaacaaauagugcacaaggaaaaaagaugugcagauguuccuguuaaaucuauuuaacaagaaagcgucaaggucaauuuccugucuuauuacuuaaaugacaaugguggauuguguucuccuuaucaggagaccuccaguuuuuaaacaucuauccuuaguuuucacugggucugaugaaaagggcuuaaaaaugcucuugagguuuuaugaaagaaaugauacaaacauaauguucucuaacuuucacaauggacaagucucgccacaauaaauuuggagaugcaaaguauaaaauguguugauggcaaauaaauaauucucauuucucauaggaauagaaauuuaguuacuauguaccacuagacaguuuaaauuaccugcaacuuuuuccuagacuacuauaugaagaaugaggucaaaggaguuagccaaggcgaaagcacacccuuagaauguugcucgggguacacagugcgcaggcgacagucaagagcaccucaggccugaaaagaacagcuucucccaagauuucagaucaccaauuaaaagcccccuaaaagauauuuuuaucauuccuuuucaucuuauauuucucaauuuucauuuuacuaucccugucuauaaaagacccuauggcuaaaaguuuuggaaaagaaucaaagcccauuuucuauguguugcuaaaugccucaaggaaauuuuuccaaugcaucaaacuuuuagaauccuuuuuauuuuccuucucugaaaagagaauaaaauauguucagcaagaaggaaguuaugaggacugagggaaaccaaaauacaaugucugagaguugaccuuccaaggaaaaauguuuucugucaagauuugacuuuccuuagauaaaccacaaaggauacaauuuuaacucacagcuccuaaacaaggaaaauaucacccauaguagcucucccugcauccuaaccacuugcucaucaaaucuccauucaaagaaaagagcaccugcaaaaacagaguauaaaaaucagaguaugccucuuuguuuucuaccaaaaaaaaaaaaaaaagauuuauuucugcaauuaacacuugacauaaaacauuugucauuuccauuugguugguaugauaucaugaccucucucuagagcagugguccccaacauuuuuggcaccagggaccaguuuuguggaagacaauuuuuccacagacugcagggugaagggugguuucaggaugaaacuguuacaccucaggucaucaagcauuagauucucauaaggagcgcauagccuagaucccuugcaugcagaguucacaauaggauuugugcuccuaugagaaucuaaugcugccacugagcugacaagagguggaguucaggugguaauucgagugaugggaaguagccauaaauacagaugaagcuccucaauggcccaccacucaccucuuccugcuguguggcccauggccuggggguugggguccccugcucuagggauauaucuucaauuccaagauaauucuaauacaaucaauaugaagugauuuccuaaacuaacuaugcuucagaguaucucuaaugacuuaguagcucauggaaaauaaagacaauauaagguaaaucuauacacugucagaaucaaucacaaauucuaauaaagagguuucauaauauagaaacaaagaagguacacuucuauagaagcaaaauguucacugauucauuauaaaaccauuuacugaguaccuacuauaugucagccaugggggauacaaagaucuauaaggcacaagacccucagucuuguagucgccugacagccagccagcuacaacauaauguggaaaggacaauggugggaaaugcacucaggucuuccuaaugcacagaguaugcucaggcugugacaucaggaagaaaacagauauuuaccuuaacacggacuuggaggaccuucaaaaaacagugaugggaggaaauccaguuuuaaaagucuugauuuaaaaaaaagaaaacacuuucuguggauaaagauaggcugcaggaaauguaaccuaugaaauuuucucaaauuagcuuucaaacacacacaaaaaauugcauuuguuugaggagcagaauguaacuuauauuaaagaauaaacuacuauuuaguaucugagugaaguacaaaaggaggcacuaaaaucauugaggaaaaucccauguuauauggcuuacauuaauguuuuucuagguaagguaagguaaguuacuacuaccaaguuaugaaacaccauuugaugauugcaauucauuuucucuggcaugaagaaacaaucacucuuguaacacauugauacuacaaacuacauuaugcacagguagccaaagaaaucuaucacaauucaaaugcaacagucugucccaguagcauacaguugguauccucuauuuuccauuguauccucuauuuuccauucaggauagcacaauuguccagucgcucucuucucuuccauacugcaacaaaagcaagaaaacguguuucaguacagaagcuaacagggcagaaauagcuuacaaacaaacuuaauaccgccaagguuacacaaaagguucgcuucugcuuugaacaacauuuucacauuaaacauguucacauuaaaaacuggauuagagagaaagagaggaaaagagggacaccauauaaaacauaagauaaaagcauacauagggaguuuuuuaaaaaccaaauaccugaaaagaauuacaaauuuuacaauuauugcugaacucaaauucauagcugguauagguccuuuaucuauuuagguacaugccuuuucauuaucauuucucauugaguuaacuugcuuaaugacugugacuuuuacugugaaaaagugauccucaaaguguauucucagaccacuagcaucagcaucaccagacaacaaguuaaaaaugcaaauucccagaccucaucucagacugaaucagaaucuggggauggguuccagcaaccugugauucagcaagcaucaaaugauuccgacaugcacuaaagaguguuuuaugcucauaaacaaaaauaugaaguugacaagucccauggauuuuaacagagacucuguucucuaaaucaaaguuguucaugcuguguuagcauuuuucuuauuucuucaaaaguuauguaacuguaucauagucagaauuucauucuuugcaucagcaaauacuuugguuuaaaagcaagccugaauuuuaauauucaaaaugaaauuaaaugaaauagagauauuccauacaucacaaauagaaagcuaguucuauauucauucauucaaucagucagucauucaacaaaaaugccuguguuuauaauaaguucucacucugugagcaauuaauguaggccaaugucaucaugccaggaguuuuacaggcuuauuaccucauuuaauacccacaguaacuguacauagaagguaccauuaucaauccauuuuaugaaugagaaaacugaauauuagggagauugaauaacuugcucaaguuugcaguuaacagauggaagagcccagacccuaaccaagcucucucucacagcaaauuccauguucuugaccaccaccaagacugcucgccauguguucaccgagccuuguguauugagacugacuuggaacagaucuuuccaagccaguguaucaggccacuaaaucugucacuauggguuugccuaaaucacucagacuaugucuauuuucacacgaaauggcucuucuaguccuaauuuaacuuuaguuuaaauuaauauaaaacaucagaauuucugaacuagaaacaauguuaauaaccaucuaaaagguaggagaugacucaaauaaguggggcucuggauuuuacuucuuuacuucagaacaauccuacuuuuauccauuuuguauauugggauuccaggagugaucucuuuugaagaaaguucugcugcauaaaaaucaaguguaaggagcaaugaauuuuaauccaagcuucucaucuuacauauaaggacacuaaggcucuaggucacccuuaauuuugacaagcccaguucucugccucugucugauguucuuucuccuauaucacaauguacaugugcuguguuugucuuaaagaccucagagagcagaaucuauccaagugguaaaaauacuggcagccaagaaugggucuaccuaccaccugguaguuuacaugcaaaggggaauaaaggaagccaaaugacuguaaguuucuugcauaauccacaccagaaagcauugccuacagacuguaacugcccgcuauugacucuguugcuucaugaugaaugcuggaugaaacaucuucaaauucuaccugauuuauguaugaugucaacaugacuuaagguaagggcaaaauauguguuuuauuuuccuuacuuggauucccauuaauauauuaaacacuuucaccauuaauaacaguucauuggcauuuuagcagaucuacagaacugugauucaugacuacugucacuucaucuugaauuucaucaguuaaaguaaauuugcuuucaauuaguuguuuuaguuuuauaaaugaucaaaaaucaauuuugauuacaaugacagucguaggccacauaucacucugcgaaccugcauaauaugcacuaagcuuuacucuucucauucuguaauuuaugcuuuuauguaaaaucauagcauucugagaagugcccaagaaaugugauauuacagguaauucauaaugucuagaaguaggcauuuaguaaucagauuuuccauuuggcugauggauaaugcaauuuaauuuuucaagggaaaauaauucuaaguagagauggcagauuuaagcagaaauagaaauuauauuauuuccuuaagaguaaguaaguauacauagagggagggaaaagagaaaacaugucuucauggacuaggaugucauuauacucuugucauuauacucuugucauugucauuacaaaacaacagugcaggcucacaccuucaauguuugguagggcggcuguaagucacacuuacuuaguuuuguucacuggaaucagagauggugucaaagcaacguggcaagucaggucgagccugcgggaugguauuuugagcccauguggaagacuuaaugaaaugugcagaauuuuaaucuuuugcaaauuccagcgagaacacuaaacuaaaacacgacuaaugacaaguucauuaccucacauucgagguacauaaggcagauaauuucauacggcuuugcuaaaugccuuuaaauuccuggcaaaacaaaagcacaaccugcaugucaugcagucacucuacgcaacgccaauaaaacuauagucagugcugccuaccagguagcaaucugucauucuugcucuaaacccuauugaaaggcugugcaaagcuuuguaauccuguaacacguggaggaggaugugcuggaaacagaaggggcugggaagcugguccagggacugagucacacgagggcagucuggaaacaaaguuuguaugcacacggaggacagcuuaagacauugguagggaaggggguggagccuuuaacuucuuauguaacuaagucauggagcugcuccauugaaaacaagaaaaauacaauaaccacuaauagucauuuguccuugaaaacuguagccacuagugagaacauagauuuuuuuaauucuaucuggugaccugcaaucaauacagauccugcuccuaucucauucaagcugccccuuuccuaugcuucagauguccaucucuggaucuuugcagucgcugcuucccacuuuauggagcuucaacagcagcaaugcugauuauucacacaugcucccccugauacuuaaaagccaggcucuagcuuuuaugugauuauuuguugacagcagugucaacauguaucucauuuugaaaaaaaucuaaaucaagaucucuuaagaaauaauuugauauuauucaagaccuuccucccaucucuucucggaauguguuaauauacaagagcaauacauguuuugcucuuuaguauuuguuugguguuucacuugcccauucacuccuucaagaaacauuacugcauacgcauuauacccuaggcucugugcugaacacuggagguauaaagagagugaacgauucaaacagccccagagcagagagaagugcaugacuaauuauaauguaauuuaaaggccuuacgggaucauccccagcacugugaaacuggaggaagaagcagcauucaagugagugaauguguauuuggacugagcaaagggaauauucuucaagagagauucaaaaggcuucugaacgagaugagucauaaaggacagccaaggccuuauccaggugagcaauuucuagaaggugcagcaaaaccuggaggcaucagagagcagaacacaacugcagaacagaggaccccaaguggcagaggcaaaggugaguaugauggugaguaacuggaacaguaaggaauuuaacaguagagaaaagaaacacgucgacaacacggccaaugcucuccaaguuuaaguuugguuaaauauaaacacagacgugcuuuucuuuguugcuuuaaaagaagaaaaaggaaaaacgaaacugucauuugaaaaauucuucucuuaggagguauuuauagagcaaucuaagacccagggaguuauguggacaauuagcuaaaugggaugaauacuuaaccucagagauuauuacucauaugcagaaguacagaaguugaaaagucaaaucugugguuaugagggaauuuuuccccugagccauacuggcaagaaucuugaagguuuuuucgguggcuguuguuggccucuucuucaauuuaucagagcacuuuguagaaaacauccaugcucccaugucaugccaaaaguaaugaaauguaaaacaugaugcaauucuaugcuuuuuccuuaauaauuacugaaauuuauuuuucuuggagaaacagacaaucuaggagcuuagcugacagccucaauuugccaucuuguaagaguaauuuugagacuuuaaguuccaugcacauaggcaugagauaacugagacgugcucuucaauucugaagggaugguccuuuguuacuaaacaauuuguagcacauuugguaguucugguuugugguuaguucagaaccacuguuuccaccuguccugugauugcaugccuuuguuucuuuguuuaguaugagguucugaauauaucauuuaguuuuuuguguuaacuaccauuauacuuuacuaccaacggugaaaaaagaaauuauucauuucuuauuggccauaagcacuaauuuauagagggaguauauaaaguuagggagaaaagguuuuuuccccgucucccauccucugcuuaaacuauauauuuuacuuuuaaacuuuuuuacauggucucacauuuacacugaauauuuguuuugacuuuuuuuuuuuuuucauuuguuuugacuucuuuuuuuuucagauggggucucacucuguugcccaggcuggagugcaguggugcuaucauggcugacugcagccucaaccucccuaggcuuaaggcaucuucccaccucaaccuguagcugggacuacagacaugugacaccaugcccgauuaauuuguuuguuuguuuguuuguuuguuugcauuuuuuuguagagacagggauuugccauguuaccaggcugaucucaaacuccugggcucaagcaauucucacgucucagucucccaaaguguugggauuacaggcguaagccaccaugccuggccaccuucuucauuuuuuugcccccuuuuucuugaguaaaccaccaguaccuagaauagccccugcauauggcuugcacucaauauacacauuaaagaguuaaacaagaacauuuacuuuagucacuaacauucugauaugguuugaauuuguguccccacccaaaucucauguggaauuguaaucccccauguuggaggaagggccuggugucagguaauugcaucaugggagcaaaccucccccuugcuguucucaugauagugagugaguucuaaggagaucuguuuguuuuaaaaagugaguggcaccucccacccucccucuccuccuccuguucccaccauguaauauguacuggcuuccccuuugccuuccgccaugacuguaaguuuccugaggccuccccagccaugucuccuguauggccugcagaacugagcgucaauaaaaccucuuuucuuuacaaacuacccagucucagguaguucguuacagcagugugagaacagacuacuacauauccuuuuggcuucuauaaucuuacuuuuaaaaaugcucuuucugagaacuuugguaaugguuucccaucuuaccccaaaauuguguguuugggcuucucuuucagucacuuucagguuugaaugcacauauuuugucaccauuucaauuuugaugaguugcauuucugcuuuugccuccuagaguuuccuuccucagugaaagcuucaugaucaugucugccaaacaccuccacuuagaucuuuauaccaauucaauagaguucaauuuuucucagccuagugacuacguuuuccuuuucuauuaauccuuuacagccaaaucaaaugaguuuacauuuccuuccuuccuuccuuccuuccuuccuuccuucauucccucccucccucccucccucccucccucccuccuuccuuucgagacagggucucuuucuacagugaaggcuggaguggagugcuguggcacaaucauagcccacugcagucucacauuccuggccucaaguguuccuccugccucagccuccugaguagcuggaacuacaggugugugccaccacacuugcuauuuuuuuugguuguuuuguggagacugggucuuacuauguugccuaggcucgucuugaaguacuagccucaaguauuguuccugcaucagccucccaaaguuuuaggauuacaggaaugagccaucaugcccaccuaaauguuuuuauuucauacaaucuccaagagguaacccugaaaucuuauuugguguauuaacugcuacagaauguacaauuuguuuaagaaaauacuguauaauuuguucaagaaaauuuuccaaaagggucuuucuuucuuaucacuaugggcacacuucucuuaaaaauuucuaaacuccugauuuuuaaaauuuuaauuaagauaaaauacacauauauaauuuaccaucuuuacaauuuuuaaauguucaguuuaaugguaauaaauacauuuauauucuuguuuuuuuccuuuauccucuacuucccacuccccuucucggccucugguaaccucuaaucuacucucugucuucauaggaucuacuuuuuuagcaccugcaugagaacaugugauguuugucuuucggucccucgcuuauuucacuuaacaaaauggccuccaguuccauacauguugcugcaaaugacaggauuucauucuuuuuuauggcugaauaguaccacauuguguguguguguguguguguguguauauauauauauauauauaucuuuaugccacauucucuuuauccauuuaucuguugacagacauuuagguuaauuccauaucuuggcuauugugaauacuauugcaauaaacaugggagugcagauaucucuuugauauacuaauuuuuuucuuuuggauauauacccggugguagaauugcuggaucacacggaaguucuaguucuacuuuuauuuuuggaggacccuccauacuguucuccauaguggcuguacuauuuauauuucaaccaacaauauaugaugguucccuuucuccacauccucccagcaucuguuauugccuguuuuuuuuuuuuuuuuuaauacaagccauuuuaacuagggcaaguggauuuuacauugugguuuuguuuugcauuucucugauaauuagugauguugcgcauuuuuucauguaccuccuggccauuugucugucuucuuuugagaaauguccauucagaucuuuuauccauuuuuaaucaaauuuuuuuuucuguugaguuuucuaaucaggucucaugcccauuuuaaaaccagauuacuagauuuuuccuauacaguuguuugagcuccuuauagacucugguuauuaaucccuugucagauugauaguuugcaaauauuuucauccauucuuuggguaaucuauucccuuuguggauuguuuucuuugcuguggagaagcuuuccagcuugacauaaucccaauugccuauuuuugcuuugauagccuaugcuuuuucaggucuuacauaagaaaucuucgcuggccagggacaguggcuuaugcuaguaaucucagcacuuugggaggcugagacaggaggaucccuugaguucaggaguucgagaccagccugggcaagauggugagacuccaucucuacaaaaaauuuaaaaauuaguggaaugugguggcaugcaccugugguucuagcuacauggaaagccaaggugggagaauugcuugagcccaggaggucaaugccacaaugagccagguucaugccacuacacuccagccugagugacagaaugagaucuuugcuuagaccaauguccugaagcauuuccuuaauguuuucuucaaguaauuucauaguuucaggucuaagauucaagucauuaauauacuuucauuugauuucuguguaugguaagagaagcgaaucuaguuucauucuucugcauauaauuauccaauuuucccagcaccauuuauugaaaagacugucuuccccguuacaguucuuggcaccuuugucaaagaugaguugguuguaaacauguggacuuagguaucuggguucucuauucugucccacuggucuacuaugucuguuuuuauaucaguacuaugcuguuuugguuauuauaguuuuauaauaaauuuugaaguaagguaguguggugauucuaacuuuguucuuuuugcucaagauugcuuuggcuauuuggggucuuuuuagcuccauauacauuuuaggauuguuuuuucuauuucugugaagaaagucaucaguauuuuaauagggauugcauugaaucuguaaauugcuuuguguaguauagucauuuuaacaaaauuaauucuuccaauccaugaauauggaauaucuuuccaccuuuguguguuuucuucaauuuuuuaaaucauaguuuuauacuuuuccuuguauagaucucucaugucuuugguuagauugauuccuagguauuuuauacuuuuuguggcuauuauaaaugggauugcuuucuugauuucuuuuucagauuguucacuguuagcauauauaaauucuacugauuuuuauauguugauuuuauauccugcaacuuuacugaauucauuuaucaguucuacagguuuuuugagggagucuuuagguuuuucuagguguaagauaaugucaucugcuaagaaagcuaauuuaacuucuucuuuuccaauuuggaugcccuuuauuuauuuuuccugccuauuugcccuggccucuaaaccucuguuuuggaaaaaggcuuucauguaaucuagccaguuauguauuuuuuguucuauuuguguucuuuauuugagcaaaacuguaauaauuuauuauuuucagauuuacucaggcaaccuuaaaaaaauuaaaaugccuaagccauccaugcagaaauuuuuauuagcuacucuucaaauuacuuguaaguguugcuguguacaaagguagaaaacaacucugacuaaauuuuauuucuuccaauauuaagauauuccuuuacuuagcuuacagaaaauucucauagaaaaccuuugcuggagagcagaaguauggcagcucauugauuaaaaaaccacaaucaaggccagggugcgguggcucaugccuguaaucucagcacuuugggaggcuaaggugggcaaaucacuugaggcuaggaguuugagaccagccuggccaacauggcgaaaccucgacucuacuaaaaauacaaaaauuagccaggcaugauggugcaugcccauaaucccugcugugugggaggcugaggcacaagaaucacuugaacccaggaggcagggguugcagugagcugagauugcaccacugcaccccagccugagcaacagaguaagacucugucucaaaaaaacaaacagaaacaaaaacacacuuucuuucuuuuuaauacuguaaauuuggcagaaaacuugcugaguaagucucuuuuaaaacugccuuuuaaacucucuuuuaaacuuuuauuuuuauuuuauuucccuuuuuuuagaggaagguucucacuauguugccuaggcuagucuugaacaccuggccucaagcgauccuccugucuuggccucccauaguguugggauuauaggugugagccacugcacccagccagaaaugccauuuuuaucacuacccaaggaccuccauugcucucuggaggccuguugcauucucagccaccuuuaaguuucacuuaguuucaugacuuaaugccauccgacaucacucaaaugaucaaacuuuauuuuacuuuucaauguaagucucaggcccucuuggauauuuuuacuaauugacaaggauaguaacuggcuucaacaaagucuucuaacuugugaaaugcuugcaaauuacaggauaaucucuuuucugaguagcccaguguuaucugguauuuagcaugccugcuuaacugccugaugaggcauuacuguagauuauugcucagaaaaaaaauaggcaaaacaaaguuagcaguaugaaaaaauagacguguauacucuuugaucccagauuuauccuuaggaaguaaucgaggauguacuguccauacuagugaaaaaaaaauugccaacaacauaaauguucaauaauauaauuuuuuaaaaaaauuaugguacaucaauauaauggaauucaauuaaacuuuauaaaugguguuggagaaaacuacuuauugauauaaaaaagcaaagcauuuauucagugaaaaaacauguaacaaaauuauguacaauaugaucccauuuuguuaggaaaaaauaacuaucuaaaaguauacuggcugggcaugguggcucacggcuguaaucccagcacuuugggaagccaaggcggguggaucaccugaggucaagaguucaagaccagccuggccaacagggcaaaaccucaucucuacuaaaaauacaaaaauuagccgggaacgguggcaugagaccuguaaucccagcuacucgggaggcugaggcagaagaaucgcuugaacccaggagguggagguuguagugagcugagaucaugccacuguucuccagccugggugacacagcgagacuuagucucaaaaauaaauaaguaaauaaauaaauaaauaaauaaauaaauaaauaaaguauauaaaugcuuacaaaauauugaagguuaagacaucaaaaaauggcagggcacagugguucaugccuguaaucccaacaauuuaggaggccaaggcagguggauuaccuuaggucaggaguucaagaccagccuggccaacauggugaaaucccaucucuacuaaaaacacaaaaauuagcugggcaugguggcgcacaccuauaaucccagcuacucgggaggcugagguaggaaaauugcuugaacccgggaggcagagguugcagugagccaagaucgugccaucguacuccagccugggcaacaagagugaaacuccagcucaaaaauaaaaagacauaaaaaauuaacagugauuauaucucaguguuggaaucacaugcacuguaauuuucuuccugaaguugcuucuacuuucaaauuuuuucuuccuuuuuuuaacaaaaguuauguuauccuucuuaaugagauuuuuaaauguuaccaaaaauuacaucuauuuuuuaauguuaaguaauguggaguccugaacaauauuuucuuucuuuuuuuaaaacauacaucuucuuucccauuucugcuuugcucaugcccacacauuguguugggaauaucuuccuuaaauuuaacuuauugaucucaaauuguauuauuuaauccucuucauugaaauauaauuuaguuguaagcucugacagaaauaaggugacauaaaaaaaagaaaagaaaaggaaagaaaagaaaagaaaagaaaagcuuuaccuggauaucaguuaauuugcucaagaugcggcuugccagcuuaggaccauucuccauaguuggaauguguauugucuacaaaagaaagggaaaugagauaauuugaggguacucauguauauggugauaacagauaagacacucaagcaauucugcuauacuaaggcaauuccacugaaguuaaggaauagcacuaaaaccuacugacucugagugcuagcaccuuaugccaaagacuuucauauccaaaauuugaauaaaaacuagccaaugacagguuauacauugccuaccuaccaauuaauuuuagggcauaacugguuuguauaccagccuucaggaucauuugaagaaccaaggaggagcuacaguuaccuaaaauaguggcuaaacuuaaagaacccuaccucuuccaagauucugagaaucuguaaggaugaaugauugucuucuacauauuaacccucuggcuaauaugagaacucaaagauauuuugccacaguuuaaugcaagucauucugggagcauaaauuaaagcaagucuaugacuucauaaaaggggcuucuauaccuaucucuggcccaagguaaacuuccaggggccacuaccuccacaauauuggauagcaugauuaaaugcauggcugaaagagauuucaugcuucuaauuuguaucugagucaugccuacucaugccuugcuggcuugcagguuuugauaguuugauuuuaggagauagucugugcucucaaacacuuuucauauuauacccuuuaguauaauaugauaauuauauauacuuacuuuuuggcuguaaaugcuuccuaagccuggaucauuaaaauuaugcuaaacuuuauaaacuucuuauuucuagaagugaaauaauaauucaacuuaaaaaaaaucuggccuaaugacaacuucaguggauggaucacauuaccuugaugcauucuuaucaauguaaguauugacaugaaacagaacaauucuucucccaugaaacagucuaucuguugaugcaauuaugucaagagcaaucccuuaaaagcaaguucuaaaaccucaacaaaugaagcagccauuauuaaagucagaggaguugagcaaaacuccaaucagcugagggaaaauaacucuaaaguaaaauuugaaaaccaguggaguuugcauuuacgguugacacuugaacaacacggguuugaacuacacaaguucacuuauacguggacuuucuucugccucugccacuccuaaaacagcaagaccaaucccuccuccuccuccuccuccucagccuacucaacaugauggacaaugaggaugaagaccuuuaugaugauccacuuccauguaaugaauaguaaauauauuuucccuuccccaugauuuucguaacuuacuuuauuguaagaauacauauauaacauacauaacauacaaaauaugugccaaucgacuguuuuuguuguugauaaggcuuccggugaacagcaggcuacuaguaguuaaguuuuugggaagucaaaaguuauaugugggccgggcauggugacucacgccuguaauaccagcacuuugggaggucaaggcaggugaaucacuugaacucaagaguuugagaccagccugugaaacaucuugaaaccccgucucuacaaaaaauacuaaaauuagcugggugugguggugcacaccuguggucccagcuacuugggagacugaggugagaggaucgcuugagcuugggaggcggagguugcagugagccgagauugugccccugcacuccaguacaggugacagagaaagaccccguuuaaaaaaacaaacaaacaaaaaaaguuguauguggauuuuucaacugcauggggguugacaccccuaaucccuguguuguucaaggaucugcuauaauaugaauaacuuaagccaguucacauuauaagacuaauacuuacaugccuuuaaguuauaaaguuagaugccaauguuaaucauaaguauuggagcuuuguuauaaagugaaaagcaaaacaauuugacaagaaaacaaaaguauggcacauauaaaaucagacuaauuuacuaagaggagaacauuucuuccaaccaaauccucaaauuccuuuuguaagauuuuaguaaaugcaccagguuugccaaugaauaauucuuguaaaguggucuacuuacuauuaaugauaacagcauuaauaguaaaaaaaaaucaagggauugaccacucgaaugcauuuuccauaacuauuugccauuccuaauccagugguuuggaaguacuuuugguuaaccagaaacugaaauguaacuaccuauagagccuucccuagugagcugguaggaaggaagagagaagaguagaagacugucggcauagcuccaaucccgacauguagguaagacagaucuuacacguguccaaggacaaaacuaacuucccaccauguuuaagcuuacaugaaaucacuggaaacauaguagauauaugcuaauacaguuucaucuggauaaacugucccaguuauuuuuuuuguagugccaaguuaaaaaacaaaaacaacaacaaaaaagaccuagcauggugcgguggcgcacuccuguaaucccagcaacucaggaggcugaagcagaaggauugcgugagcccaggaguuugaggcugcagugagcuaugaucacaccagugaauagccacugcacuccagccugggcaacacagcgagacuccaucucuuuaaaauaaagaaaaacaacaacaacgacaaaacuuuugcaucuugggucuggguccagauacaauuuuauucauacacuuaaauuaaauguaauuuaaugugauuggaaaugauaggaaaugaggaaauacuugucguaccucgccuuuguacaguauaucagaaacugggcaaacaacacaggcuguaccagagccaaacaucucucucacucuguuccccuccagggcuguugucaagucauccauggugagguaucucucugacaccuuaaauucacccugcauggaauauaaaaaauaacaaguauauuuuaaaggaaaaggcaugcaaaacaauugcaauacuuacuguucugcuuaacauucugauugcacuuagacaaggucacaaucauccuuuaagggaaagcuggaaguggcacaccaucuuacuggugaacacaucgagguguuaaguaaccuacuucaaggucacagauuuauauaugagauuaucagaauauaaaauauaagauuaucaccacaagacacaugguauacuuuaacauaugccuucuuuuuugccuucuuauuuguuaacuuguauaaagucucacaaaauugaugcaucccaaaugcugcuugaugcaugcuccguguuaacagugucuuaggccgggcacgguggcucaugccuguaaucucugcauuuggggaggcugaggcaggcagauuacuugaggucaggaguuugagaccagccuggccaaccugguaaaacccugucucuacuaaaaauacaaaaauuagccaggcaugguggcgggugccuguaaucccagcuacucaggaggcugaggcaggagaaucgcuugaacucaggaggcagagguugcagugaaccaagaucacgucacugcaguccagccugggugacggagugagacucugucuccaaaaacaaaacaaaacaaaaaaaucagugucuuaaaaccuacuuuaccauaaaggagaacaauguauuauauaauauuaauaauuauagcuaccauuuaucaagcacccgcuauuaugccaaguucuguaauuuuaagggugaguacuaucauccccauuuuacagaugaggaaacuaagguucaaggagguugaagggcaucuccagggccacaaaggaaguaagugacagaaacucaauuugaacccaggucugaucugauuggcuccaaauuugguacucuuucuacguuugucucuuucuuuuuuuuuuuuuuuuaagacagggucuugcccugucacccaggcuggaaugcaguggcauaaucuuggcucauugcagccucgaccucccaggcccaagugauccuccugucucagucuccugagcaccugggacuacagguguaugcugccaugcccaacuagguuuuauauuuuauauuuuauuuuguaaagauaggggucucccuauguugcccaggcugggcucaugugauccucccaccucagccucccaaagugccaaagugcugggauuauaguugugagccacugugcacggcuuaccuauaucuuuuauggaauaaagaacagacugaguucaaauaucugaaauacucauuauuuuuaaacguugaauguauauuuggacuuuauuugagaaauuguauuguauguauuuuuuuuccuaauaugacuaacaguugacuuuacagugacaauucucuuccuucucuuucaguaucacauucaguugauuuucaucauggaauuagugguauaaccucauugacuucugccaaaguguuugaauauauucuuugcucaaggauaggaaaugggaaaaagauccuuuuaagcuauguguuuaaacuaucuguuuaauucuuguucuuuuaccucagugguucaaguucaaaguuugucaacaaguuauuugaauaaagggcaauaaaaauagagagguuuaaaaaaauaagaugaguauuuuuucuuaauuuauaaacccacaagagauaaaaauggaaaucaaagcucuuggcaauauucaaaauauuugaauauuuaaaagaagaacucaugcuguaaguagauuuggaagagcaggaaaauauaucugcaauagaaauauggcucuuugaaaguuucaauuucucucagucuacaauugcaauuauguuguucaaaaguaaaugaacugcagaaaaucaggcaaauuaauugaaaacaagcugaguucuguguccugaaaaagaaaagaaaagaaaacucuuuuguaaauaagcagaauuguuuuugcucugcucacccuuacuuaucuuuggacaauuuccccuaucuggcaaauaguggugacccccuacaugccucuuggcauuucacgucucauguuuuaaaauagcuuuuaaaauaaauuacagcuaugaagucaagaaaaaauuuccuccauaauaaccuauuuuucaugcuagcaaaucauuagugugggaaaguauuuccacuugcaacuugucgucgaaccuucuguacuugguugauauuuuucuuuaauaaaacaaaaauuacugagcuucaaaaauaucuuuccaauugcaaacauauuuaggacagggcaagcuguuugaaaauuauaccaacgguuuguaaaugucaugcccaaugcgccagccagcauguagcaguugggucuugucuacuucaggguuuuguagaauuauuuauagcacauuucaucuauuuugaaagucuuuuccagagaaaccaugcugguaugcuccuagauaacguguguguuucuaaacauuuguccuauuacuacuaguacucuuugaccacaguaagcucaaagccuuuucauguucuuuggagaccauuuuaacaccugggucaaaaguuccauccaagaaccuuuaccagacacccaauucauucaauaauuugucuugaauacauuacgucauuuccaaaaccaaaccuuuuuaaauuuuauuuuauuuauuuauuuauuuauuuauuuauuuauuuauuuauuuaauuuacuuuuagagacauggucucacccuguauucaggcuguagugcaguggcuugaucauagcucacugcgaccuugaccuccagaucuuaugccauccucccaccucagccccuccaaguagcugggacuacaggcauguaccaccauguucagcuaauguuuuugauuuuuuuguagauucggggucucacuauguugcccaggcuggucucgaauuccugggcuuaagugauccuccugccuuggccucccaaaaugcuagaauuauaggcaugaaccacugcacccgguccaccaaauuguuuaauaugcuugccugugucacacgaauuugaaagucuacugaaaacaacuuuacauuugcuugcauguucugauuuuaaaauaggcauguauaugaauuuuggaggauggggguaggacagagagaaaaagaaggcagucaaaccaauaauguuauauuaguaaacauuuauaugucagugaaauuauuucauuucuacggcaagcaugguuacacugguauaaauaaaggaaaggaagaaguaucauugccauuuggaagcaacacagacuugggaaguuaaggaaugucuggauggaagcacaucagguaugaaccagacaaaaguuggugggagauaccugguagacugagacuacuacuagaauacuucuccacuaugacaucuugcuaaacugguuucucucugcccuugcuaucaacaauacuuauuuuaauagucuugccaagaaagcccuucuagaagaauacuuuucauucacguuagaauuuaaagauuagauaacauugguuggaaccacaggauauuauuucaacacuaggcugggcuuauuuugauuauuuuuuauuucaggcuuacaaaaguuguucauaucaaaggcacccacccacugaugugccagguccagaaugcaccgccuugucacuccuggaagaaugaugccaucuaguggaggaguugccaguucuucuucugucaaucagaaauugggacauuuucaaacuuucacuacauuaggcaugccuuauuaucaauagccauuuuuuuaaaaaaccaucacaauuuugcuagcaacaaacauaaagaaaauuuuacuguucugcaugaucaaauuucccaaaucaguucacacuucagguagacccuuauuuaaaaaaagaagaaagaaggaaggaaggaaagaaggaaggaaggaaagaaggaaggaaggaaggagagagagagaaagaaaggaaggaaggaaggaaagagaaagagaaagaaagaaagaaagaaaagaaagagagaaagaaagaaagaaagaaagaaagaaagaaagaaagaaagaaagaaaagagaaagaaagaaagagagagagggagggagggaggaaggaacgaaggaaggaagaaagaaaaaagaaagaaagaaagaaaaaagaaaagaaaagaaagagagaaggaaagaaagagagagggagggagggagggagaaaggaaggaagaaagagaaggaagggaggaaggggggagggaaggaaggaaaguuaucuaaucaucuucaguuuacccuuaaccaguaaaauaaugagaugguuuuccaccaacaaacaguaagaguuauugcauggucuuaagaggaauauucugaagugaaaauuuaccuuagcagaugaaaggugguuacuaauuagaauaauguagauagggucuuacucagaaaaacuggucauuaccaaaccuucuaagaaugcuauggaggaggcuauccccaagaagugugcgugccuacucaggcuggucacugcuuccacgcugcccuuggaaagucuaauuuuuuuuuuuuuuuuuuuuuuuuagguuacccaggcuggagugcaguggcaccaucucagcucacugcacccucugccucccagggucaagugauucuccugccucagccuccugaguagcugggauuacagguacgcgccaccacgccuggcuaauuuuuguauuuuuaguagagacgggguuucaccauguuggucaggcuggucucgaacuccugagcucagaugaucugcccacuucggccucccaaagugcugagauuacagaugugagccaccgcacccagccuaagagucuaucuuuagugauuuucaaaccugguggagcaucagcaacaaguauggagaugcugccuuugcucucugagauucaaauguaaugggcuuaucagagugagcucaagcacguguacgguuaaaaaagaagacauucaagaaacaaaacuccaaagcugagcuacugcucuacugugagaugacugcagacaucccuaacuacugugaggucuaguaggacaauuguucacaggcaucaugcaugauccaucagcugcacaagcucuccuuacaguacccucuggcacucagcaucucccuuuccuccccacuucugacacccaggagucugaaucuagugaguccugacacugaggccaccacccucucccucaauacauggugguucuaggcucgcccacuccacugggguuacaucagacaugcccaacaaucaagcucuaucuggaauaccaaacucuaucuucauccuucuauccucaaaacugggcauugugccuagcccagaguguauauaauaaauguuuuugaguaaaaaauaaacgaauaaguuaucuuugcuaggauacagcaguauggcuuuuuugaauuuuguuucugaaaaucaucugcugaaaauugcuuucuggaaaggagaaaauuuguucuuggcaauguucuuagggcuacucuuugucauguuuagaaguguugaugaucucaaaauaaacauguguuuugcaauagcuagccaacuagauacauaaauguauggaucuauuuguguguguauauauauguacacacacacacacacuuccagugcccccaaaccggaccuuuccuaaagcuugcugagcccugagacuacaugaaguuaaaugaaaacagcagccccgcaugugcaagugcuguuuugugaaacauguuuaacacccagaacuguaaccacuagccugaggucaaggaacagaacaucugcuucucugguugccagacagagaugaugacaugacaacauuugggugagaaauauucauuuuccucugcaaccacaaacauacuuacaagagccagaaaucacuccagauugcccaacaugaggaaaacagaaccuacaaaugcagcuuguuuuugacaaagaagucauuuuuaggagaugaggaauuuagaagcaauaacagcaggauucaucugugacuucccaaagucaaacacuaauggaaaccaggaauguaggucugcauaagugcccuaaacaccaucagcacaauuagccauuuauucuacaaauacauauugagugcuguuuaccguuuuaagcucuaugaauacagcagugaacaaaacugacauaucucccugcuuacuuucuaauagacacagguaaacauuuauuguguugauaguauguuagacuacacagggggaaacaaagaaggaaaagcaauggagaaugcuggaaugcugaggagaaaugggaaauggaguuuaugauuuugauuaagagcucaaggaaagccagacugagaaugggauuuguaagcaaagauuuggaggaugucaaagagcaagcgguacagacaucugaggaagagugcuccaagucgaguccguauacacgccugacguguccgagaagacucaugauguggccugagcaauaccgagauucacugcugugguuguuuucccaaagugacugugaacucaaccacaaggccugggucuuauuuuucaggguaucuccaggguccaggauaugauacaaugcuuuguucaaauggugaauagcaagcguauggguuaaauuacucaucaacagagugaugaugugugaucuugccaccaugggugcuguuacugaaaucaaaacucccaugaguuacaagcugagugccacacauagugacugugcacagcacugugcuuugaacacacacuauccaccaccccauccaccuuccugcaccagccaucucaaccaacaggagcagugugugugggcgcucaugaaaagacggcaggcuauuaccgaaagaacucuguuuauaccuccuaucgguaacguuugugaaaaucaguauugugcugauuuucaacucguuuguucauuguauuuucuuaaaaucauaugauauaaaucaaaguuacuucagaauugcaugucuuuuuuuuuagcccaaagguuuuuccuaacauucuauuuacuucaaauauauauucuauuuccuuucuccuuauucugaauuuuauuuguucuguuagaugaacauccccaaagugaaggaguauauuaaaacuaaaguuaucccaggcaaccauaaucugaauaguaacuaacagucuuaaggucuuguauauuuugcaagaggcagaagacaaacucacucauuucuauucugaccuuuaaaagccaugguggaaauguuucaugauuauuguuuggauaaagaacaauuuuccaccaggacaguuucugguguuucugguuaaaucauguagcucugauucagaguguacuuaaauucugacaucucccauccauaaaaauaaugaugguaccaccucugaaugauguaacuguuuuuguuuugagcugugugguuuuuugguggaguuugggguggggguaagagugggcagaugggaagaaggguugaaucggccuauuaucuucuaagugcagaggucaacacuggcuacaaucuuccaaguguagcuuuuguuauaugucacauacaguaacucaaauuuauaaaucauaaauauuccuguauaaauuuuauuuucaaacagugccaaguacaaacagcaggaauggaaggaugagaaugaucuguaucugguuuuucauaugccaaggacuaccaauggccaagcccaggacaaggcuuacucaccauaucuucuguuuauucuaccucugacugcaguauaagacucaucuuguuagucucugcaacuaacacuaaaauuaguacuuagcucugaauucagccacaucuaaauuaccauuuuccucuuuuuguagccaaauaacauuagagcaagagaggcuacuguagcuacuuucaaauauaaacugcauuuuaaaaaauuuaauugaaacuacuaacacugagacuucauaaguauuuggaaacaucauuuauauuucuagucucuauaauuacuacugugaaaugaacaaccuaagaauguaaacaagucuaaaaauacgcuucuaaauuugguaugauuaucaaaauucuaauagaaauaaaugccuguuuuucucccaccguuggccauuuaauucaauaucauacacguugccaacacuucacugaaccccuauggucucugccaacuaauaaaaaaaaacagcaaagaaaaguaaugaguacucaggauauuaaagauaauagagaaauauugauaucuauaguggauauaugaaauugucuugaaugaaccaggaucuaguuacaaucccaagauacauugauuuaucuuuuaaaauggugcucuuuaaucagauugaguucuagaguaaauuuggagagauugugauacauuuucaaaauauguagaaaaggcaacaauuguuaaaacaauuacagccagagaguacacaaaauccuuccaguagaaucaguacacugcauuuauuacucuagcauuuuauauacgguauauggugaaugaccauugaccugaucugagaccugugucucaaugcaagguguucagauaggaaaauuguuggggaacugcagaagggauaaggaagcaaaucuuccaaucaugguaacuuaaaucccuuaaugugacaucucaguaucucaauaaucaguacaucuagagccagaaaaacaaaaaacgaaaaacaaaaaaccucuagagcuucuuuaaaucgaaacucggccgggugcaguggcucacaccuguaaucccagcacuuugggaggccaaggccgguggaucaccugaggucaggaguucaagaccagccugaccaacauggugaaacccuaucucuacuaaaaaaaaaaauacaaaaauuagcugggcaugguggcaggcuccugcaaucccagcuacucgggaggcugaggcaggagaauugcuugaaccagggugcagugagcugagaucacaccauugcacugcagccugggugacauagugagacuccaccucuuuaaaaaagaaagaaagaaaaaaaagaaacuugugucuauuugggcagcaaaagcacaguaguccuuacuuagccuuuggaacugugcuacuuacucccuuguacuaaguuucuagcucuugucuuucugguccuguugaaaaugacugagaaaugcacacagugaaaucugaguggauuaccuccaucuucauuuauccaguaaagaaaaagauucauaguucccacuucagugaucugaugguccucuccauagagccacaggaccugcugacacccauuaucuacugcuucacauugggcaaaaagagaugagccguaauuccuuuaagaaagagaaaauacacagguuacaaacauacuucauccccacucccucaucuucuacccucugauagccucaagcucuuaauucacauguggacauagugaagguauuauguucuuaauauauauacacucucuagucaacugcauaacauuaaaggaaaacucauuagaaaaucuaagugauuuaacugcauucauuggagagagaacaacgugaaaccuugaaauuuuaacuugaaauguaaugauagaagaacacagguaaauagccaaguuaaugagaacaguuaaaaguuacuauguuuccacacaccaagcaauuuuacaugaauuauuucauuuaaaucucacaccaauacuaugagauagacacuaucauuauuuccauuguucagaugagaaacuaagguuuagagaaguaacuucugucaaguugcaauagaagagcagcaagugugagcgcucuuaucuaacaccuuuuaauguauccaaggaauacauaaugcccaaugucuaaauuccccuaaaagauaggacaaauguuaaaagucucgauguugaccaaaaaguauuucaaaagccuauuuuucucagccugcaccauucaucucagauuauuuaaaaugaaaggaacacagcacauuuucccggaaugacaauuuaguguuauaauacuuuuaagguaucaucuuuuaucuaaacuuauaugggaaaauuauggaguauauuauaaaauaaggaugaauauuuuagacaaaacaugagaguccucaaauaaaugugaugacugcuugccucccuacaccccugguuguauaacucaguaggucugagaaguacugccguaagacagucagggaucgggaauaaacucuaguccuccuguugcaccaugaaauccccagaaauacacagaaacaaacaaugaaaaacaacuaaaacaacuacaaauguaguaauguaaaacuccuacauuacauuacauuacauuaauguaaucuaccacaaaauaucuauuuaggucucuuagacucuuuuacaucuggguaaaauuacaauuuguacuguugucuaaauaaaaguugagcaugaggccaggcgcgguggcuuaugucuguaauccuagcacuuuaggagccuaagaugggcggaucacugaggucaggaguucgagaccagcccggccaacauggugaaaccaugucucuacugaaaauacaagaauuagcugggcgugguggcgggugccuauaaucucagcugcuagggaggcugagggaggagaaucaucuuaacucgggaggcaaaaguugcagugagccaagauagcaccacugcacuccagccugggugacacagugagacucugucucaaaaaaaauaaaaauuaaacauuagagccacauguuaguguauaucuacuguuuucaucugcacuauauuccauacucuuauaaaaacauagucuuucuauagagcuaugucauucugcuuggacugauaauauagcaucuugcccuaccacaacugaugacaauauagcaucuugcccugcugcagcugaguuaaagggugggcauauaaccuaagacagucacaugauuccuuuuuugggugcauucacucauuuuaaugucuauaaccugaaauacaggcauuuucucccuucugggguugcuuacuugguaugcuguaaaacuggggucggcuguguccaugaucaccacacuucacagaagaaagcggcugaagugggagagcccuaggccaacauggagccagaagcucugaccagaggcagaggaagaagggaagaaaaagggggaugugcaaaggacacaagaaacuuggaaauaauugcuuuagccccuagcauccuaguuucauaagcccuugucugcuuaagaucauuuccaggccgggcacgguggcucaugccuguaaucccagcacuuugggaggcugaggugggcagaucaccugagguugggaguuugagaccauccugaccaacauggagaaaccccgucucuacuaaaaauaacaaaaaaauuagccgggagugguggcccaugccuguaaucccagcuacucuggaggcugaggcaggagaauugcuugaacucgggaggcggagguugcagugagccgagauugugccauggcacuccagccugggcaacaagagcaaaauuccgucucaaaaaaauaaauaaauaaauaaauaauaauuucaaguugguuuucugacuugcaacugaaagaauauugacuaauagcugaaauauuccaguaagcuguggaaaauagacaucauacuauggugauugccauuggagcacgaugagguugacucacaccaagguaauguuaagaguccuuaaaagggccaggcgcgguggcucacgccuguaaucccagcacuuugggaggcgagacggccggaucaugaggucaggagauugagaccauccuggcuaacacggugaaaccucgucucuacuaaaaauacuaaaaauuauccgggcgugguggcuggcgccuguagucccagcuacucgggaggcugaggcaggagaauggcgugaacccgggagguggagcuugcagugagccgagaucgcgccacugcacuccagucugagcgacagagugagacugucucaaaaaaaaaaaaaaaaaaaaaaagaguccuuaaaagggccaggcacaguggcucauaccuguaaucucagcacuuugggaggcugaggugggcaaguuacuugaggucaggaguuccagaccagccuggcuaacauggugaaacccugucucuaccaaaaauauaaaaaacuagcuggguuugguggaccacgccuguaaucccaccuacucgggaggcugaggcaggagcaccacucacaccagggaggcggagguugcagugagcugagauggugccacugcacuccagccuaggagacagagcgagacuguccccucccagcaaaaaaaaaaaaagagccauuaaaagacgcuuaaaacauaugcuucuaaauacagaugacaaaauauaaauucuuggucaauguggagaugaagcaagucugguauacagauaggaagcuauuaaaaaaacaauaaaauaaauaaaaauuaaaaagacaaagacaacagauaggaagcuauuguuuaaugaccauaaaaagucaaauaauccuuauucauaacugauaguaaauagauaacugaguuaaauuacaaaugcuuuuuaauaaugaguauaaaccagauugcaggggacgucugguagaaagaccacagguuuguuguuaacagaccugaggacagcucuugcauuuccacuauuugguauaugugaacuuaagcaaguuaguccuuauuuuucccucauuuaauuaucuggcagauaaaaauaucugcuuuauauaucucauuggguugcuuggaaaaaauaaauaauaacaauaaaagccaaaggaugaguuacaugagacuguuacauccuaaugaaauuaaguuuuuuaaaaaauaacuauuucaguggggugugguggcucaugccuguaaucccagugacucaggacaccgaggcaggaggauggcuugaggccagaagucccagaccagccugggcaacacagcaagacugcaucucuaaaaacuaauaauaauaacuauuuuauuugaauuuuuucucauucguagacacaacuacgaaguagugaagcagugaaguuuuacccuaccugaaaauaaauuauuuuuucauauacaaaaugcccuuuagacuguauuaaaaaacacauagagaauucuuacaggaugaauauuuagccuuucaaagaagcuucuaaauacaaaugcauacacauuucugaaaguguagcugaauuaaaaccauggcuccucagcuucaugaagcacugagcaaggaaagaggauuaaagacagugacuauuucaaugcacugaaaagaaaaggguuuuuuauguuuaaguuuuaauugauugauugauguauuauuauauucuguagauggucuuuauucccccaaacaaguuuuaauuuucccagaguucucucacagguguaagcuguauuauuaauguccacaggauaacugauaccaugguaauauaguuggguucccgcccaugugcugccaauauucauaagagaaacauguucuuggaggaaacagaaaaaugaaaaaguaagaaagcuguugacauagaaacauuucaauaugguuuuaaauagguuaucugggagaauagacauauuaaauacaucccuccaaaagaauaaauucuauuauguaaaauuuaacugauuucuucuaagauaaagagaguccaggaaaugaaaugagaaagugagaaaaccucacaacaucagugacugugagaguuuacuacagguugaggaucccuaauuuaaaacuuugaaaugcucuaaaaucuaaaacuuuuucggugccaacaugaugcucaauuuggauuucgaauuuuuuggauuagggaugcccaaagagaaauacuccaaaauuugaaauccaaaacacaucuggucccaagcauuucagauaagagauaugcaacccauaccugccagacugggugcuaaguacuuaacuacauuauuucauugagucaucuaaaaacaacccuagacuuuauuguucauuggaagacuuggagagaggauucaguuguagaagaucucacagauaguuaaguguguaacucccagacauuugacuccuaaacccaagcuuuuaaccauuagguuaucauacugcauuugcugagagcuuucuauaugccaaguacuauccuaggcacuuucuauuaucucacuuaaucugugcaagguauuauugccucaacuuuaaaaaugaggaaacugauacauagagcaguuaaguaacaugcccaaggcaauuagguugguuuguuuuuaaagacuucagguuuuuuucagagcaguuuuagguucccaccaaaacugaaaggcaaguacaaagauuucccauaucccuuucuccccauccaaaugaauaguuucuaccauuaccaaugccucacaccagagugguacauuugcugaaauuaaugaaccacauugacauaccauuaucaccugaagucuagaguuuucauuaguguucauuccugguguacauucuauggguuuggacaaaucuauaacgacauuuacgcaccauuaugacaguuagguuuuuaagccaggucuuucugacuucaaagcuuguacucuuaaaugcagaaucagaaugcaaggaaaaaagaaaaaacuaagagagauaauuugugugugugugugcacgugugcaugugcaagagagagagaaaaagagagaaagagagagagagugacagaaagccuuauuccucccaaauuaaccaaggaaucaccuggaacuaaagcuguuucuacagugcaagaccuuucucuagcucagugcuucucaagcuuggcugcaugcuaaagaauccugaugcucagucucugcccuagauucacuuagauagaaagcagaaaguucuugacuuuaugagacucaauaguuauuuaauaauaccaguugacuacaggugucaaggguaacuguugacuuaauuagguuuacagauguaauaauacacaaaacuaaaguugacuccaaaugucuuugccaacucaacaggauaauauuaaaugcggaauauuuuguuccccuuguaccucuccaggucagaagcauaggaggagacggcccuagaacuuuuuggaagugauaggcauauagguuaaaugcccauccuuuugguuaccaccuucccucuugccauuuuuaauuuaugaguucaauacuuucuucuccggucucuuccuuuccuaagagauuucaagucaauuuccauggaucauaguccaccugagccuaaugaaucaaauauuuuuauaauagauuuuauuauuuuagaguacuuuuagauucacagagaaauugagcaaaagguaacagaauuccccuauuauaccccuucccgaacacccucucaguuuuucuucuuauuaucaucuugcauuagugugguccacaaguccacaguuuacauuaggguucacucugugugguacugaaaacauuaauuuuuaacuggccuacagugaucauguauucugcaauagugcauuaaaucauuguuuacaaaauaaauuacaaccugcccaaauaccgguuaauaaagauugcccugcaauuucuguguccccagguuaucuuuuuccuaaacaggucggggagcuagaaagcaauauuuuaaacagggaaacuuuuuccuuauuacuuuucaucaagacuguuuauuuacucucuauauaugguauauauaugguaugcagugguacauaggcacaugcucugcgaagaaguuugaaccaguaaaaaaagaaaucaagagucaaaaaaaggaguuuucaaccuggcuagccuaggacacaggaaggugugcucuaagccagaaggagaauagacuuccuaguuuuaaugcacuccauuuggauuucucuacccauugagggaaugcaguugcuaaaguugccaguggggaugacuuuuauaaccguucuuuuuuaauuuggguaggugaggagagaaaagaaaaaggaaauacagcaagacuacagaggggucaaagccaguggucauugccucuaauaccccagcagcacgucaugugacucuccccugccuccuggaccuaaauguccuaccagggcccacaagacugccauggagucaccuucuaggacagcugcugcccugaguaugcaaacagcaccauuugauacaugcaaagcaagaacccaugcugcuuaaaccaguuauucucguucacccauaggggcauucccaacucauggccaaguccaccccugaaaucguccaacacuuuucaaaugcucuuuuauuuccugccagcuacauauggccuaugagacuggccugacagagccaaagcagggcugucccgcagccaguuggcagcagguguggccacaaucuguggcaaugaagacagcacuucagugaagcgggcaccuuccccagacaugacucccuggagccaacugagagccugggucccaggaccagaugcuuuuuaaugccagccgucagccugcagccagagaccagcgcccaggggaaguuuauccaaagcaccgaugugaugcuuguuguaguuucuuacuucaguucuucccuagauaucauauccaguguuucucccuuacaaagggccaugggcuauccuuuaaacuagcacaucuaaaagcgagggcacugaauucauacugcguuuauauaggaaaagcuacuacagcuggcuugcugaaagauuaaacugaaaauuaaccaugaaacacaaugagcauuaaaguuugaaaaguauuauauguguucauacugaagugaaauggcacuaacuaaauggucaugaaggugucuuuccuuuagacagagacacagauuuacuuacccucccaucuugcaguccccaguuccaccuuuccaggcucuuacauacuugggauuggcccacagggacacuggauuaaagguuccacuugaaaaauaaggucccacugggcucaagaguacaaagagcagggcuuugguaggcuucuugacuccaagagaaggcugcaacaaaguagaaguacauacaacuguaacuuaaaauguggacaccagucuuaaagucuagaauagauuuauaucugucucccagaagaagccaucgaauuacaggagcuauuaccauacuuuuaaaauugaguuacacaaagccuagugguuuuuaagaaggaaauccugagaauggaguacauacauuucauuuugcuuugcuuucugaguuguuaggauuuuagcaaaaaagcuagauuuguccauuuuugcguguuaguaggguuuuggaggacagacauauuucuaacaacuaucuauauaacaccuuucaagguugcaugauugggaauugagaaaggggagaaccuagacaugguuuuaggcuuugggggguaaaauauaauauuuacuucucuaacucauccuucuguuucauagccuaagugacugcuucaggacauggcagggucuucagcaggugguaggugcaggcgaaugugucauuagcacaccugcccacaucaacuagcagguagcaagagugcaauuucaacagagggauaaguacuguuaaaucaaguuuagccuacagcugccucauuacauuuuaagcucagcuuaaagguuucuuugcacaucaugaacuauaaccuaaguggacauuauaaacagaugguagccuacucuugugccaauuacugaguuuuggccaaucaaacguggccaacuguucaaaccauguucaaauaaggcaaacgcugaguuauaaccaauucagcuguuucugaaucucuuuucuguuuccuguaugucacuuuccuuccucuguccauaaauccucuuccaccauguggcugcacugaagucacagggacuacucuggaugggaaggcugcccgaauugagaaugguucuuugcucaauuaaaaacuuuuaaauuuaauucagcugaaguuuuuuuauuuaacaauaucuucaaaaaaacagggaaugaaugacuuauaaauaacaaagauagaagaccaucuuucccacaaacacuguaaagccagaagcccacaaugcaaaaucaugccaauuccuccaucacaagagcaguuauaaauaauuaggguucauuguuuauuaaggaagaaaacugagagacccaacguuuugaaggcuacauauuaagguagaaaugaucacugggcuauccucagcaauauaagaccacaugaaguaaaaaaacaaggcaggacucuuagguuaagagcuucgggauauaaaccacuuguguccaaucuucacuagagccuggucuaccuggauaggaauggggaucugucaggagaagaaagagaaucuuuacaauagaagacucaacuucagcugauuuuguggcuuuguaauguuucuggagggauauuuuuaucugaacuucaauuaaacuuccccuuacuacccauugccccaccaucccucacccacugcucaacacucagaucaccaaaaucaggcagguaaaauauucaugagcacaaaaaaauguguuuacacaagcacacaccaaugccaucugaaaggcaugucaccuuaggaaaugggaagguaauuucauuagcauuccaugggaacaugacgaccaaagggccuggguggccacaacaaaccuaugaugguugauggaagacuauguuagagaaauccgucagcaagcaacaacagguuuugauuguuagcuuguguuuguucuuuaacagagacugaagauuaaaggaggaccauccuaccaguaaaggauaaagcgccuuaaagcuucauuugccuuuuuggguuucauuguuugggaggaaaaaccuaagcauaauacacacacccgcuuuucuucccagcuacgauaaaacuuaaccaucuuaucucugcacuuuuauuuaaccucucaguuaagaaaugacaccuucauuucaugggugccuugaagcagaacauguuagauuuuuuuaacaaauccuaugauacgguuuggauuugugucccugcccauaucucaugucaaauuggaggaggggcccagugugagaugauaggaucgugggggugaauuuccucccugcugugcuugugagagugagugaguucuccugagaucugaugguuuaaaaguguguggcacuuccccugugcucucccucuccugcugccaugagaagguccuugcuucccuuucaccuucuuccacuguauguuuccugaggucucccagucaugcuuccuguuaagccugcagaacugugagucaauuaaaccucuuuucuucauaaauuacccagucucagguaguucuuuauagcagugugaaaauggacuaauacacccuagugaugaggaauuuagagaagcuucuuaacauaauuuagagauauaauaugcuggcaucaucucaauaauuuaccuagcuucuaaguuucugaauagaauagcuuauuuguggacaaacuaauagcauuuuaauagcuaucacaaaaauggcugggacuuuuuucacuccaaacuaauguauuuuaugcaaacuacauuauacuaaaagaaguaacaauaacguguuaugaaaauuuuuuccugaaauaaauuuccccugguucauuuucuucuccugauuuugacagguaaauuugcauuuuauuccacuaggugguaguauacagagcacagauagaaaauggaauaauucuguacauuaaauccauuuguagaaaaaaggucuugauaaaccucuaaguaauauuuuuauucuuagcaagcagguaaauuauagacuauaacuuuucaaugcugagagaaaauguguuuauguauacuaauacuuuauuuucugcaauuuaaccaaggucaauucauguuuuacaaguacuucaaguacugguguugaucacagacuagucaccuucauccucaaaugauuacuuacaccaauucauugucuuuucaugaauaaaacugugauuucacugaaaauggucacagugcuuuaagacaaugaauaagaucuaacacuaggcagaaagagaggaagagagcuuuaugauugggucuguuucuaugcuuaggagucauuauuuuuuucuauguuucaauuaucccuucuagccugaaaagcaaucuaaauucugugcuacuguuaagaguauuuuauuaugaacuguuauacaaaaaaagguaacugcacucauauguuuaucacagcccuguccacaacaacaaagacauggaaucaacccaggugaccaucaaugguggacugaauaaagaaaaugugauacauauaaaccauggaauacuaugcagccauaaaaaagaaugaacucaugucauuuguagcaacacagcugcagcuggagucucucuauccuaaaugaauuaacacagaaacagaaaaccaaaauaucacacguccgcacuuauaagugagagcuaagcauuagguacauauagacacaaagaugggaacaauaaacacuagggauuccaaaagagggggaggggaaaaguguuuagaaauacuaccuauaguguacuacguucacuacuugggcaaugagauccuuagaagcuaaaaucuuuguaucacaacauauacccauguaacaaacuugcacauguaacuccugacucucacauaaauuuuuuuuaauuaaaaaaagucaauuaacuuguuucacacaagaguauuuuauuauauaauauuaaacaacuacaagcaaaaucccacgaugauaaguucagucaucugauuaaauaaagcaaaagccacauaaauaaugagaacauauggaugacaauagcugaugaauugugugagucaauuucgaugagucacauuccuuauaaacacuuuaacacuuuggcuuuuuacucuacuagcuuccuggaauauucaaauacaugaggaauuaaaaggggcuuuaaaaaaaaacaugaaaaaugagaaacauaaaauuucaaaugcagcauauuuaacuucucaagagaccacauugacuuugaagcugaaaugaugauguguuuaaaaaaauaaagacuuuuuuuacuucacgagcuauaccucacaaauacauggcaaauacauauacaaggguuuuuaaauacauggauauguugcauagaaggacaagacacugagugugauggaaaauaaaaagacaugucacagagaaaaucaucacuuuccucugaucagucagaaauuacuuuaucaaaaggcaggauuucagaggugauuugaaugacggcaggaaagagcucagugagcugagaagaguacuauuagccuauguuuuggccuagaagccagagaggcacagcagcaugugcaggcuugagaauaauucugccuaggcaaggcagaugagaggcagaagaaauaagauaauuggaaaagacagaagaacauuuuuccuaaagcaagacaauuuuuuuuuuaauuugaagaguagccuguuuucuuuuuuaaaaaacuacugccaguuguuuugaaagaaguuuaaauuguuaaaggggaaaauaguaaagaauacuggacuaaggggugcuucaagggagagcucagcgguccauacagggcuugaaugcugugagggucaggaaagcgagggcacugaauucauacuguguuuauauaggaaaagcuacuauagcuggcuugcugaaagaucaaaaaauaauaauaacccccaauaguaugcauugcuuuuuggcuccaaaauauuucacugucauuaucucauacaacagaacaauucaaaaaguuauaauuccuauuuuuagguugaggaaacugaggcuucaaacaauuugcccaaaugucaugguuauuaaguucuaguucuucuccucuuaauccagaguuauuucauacuuuaccaaagcuugaaaaaaauauuaauaaaguacccaagaucuccuuacuuuaagagaguuccaacugguaucuagcuuucuucccgcugagccuucacccauagugagacacagcggggauaccucuuagggaccugcugagugccccccgccccugagcauaaaaauaaaggaacagcuugaguuccuucaagagaaaguccagucauccugcuagccuugagaaguaaaugagcaacucgauaagcaaaaagggaaacaguagcuuaaaauaaucaccaaggaggucagagucagaagauguuugguuuccuauagaaacuaaagauaacaucuuaacagauguuccagaguuguuuuucagaaccuggaucaccaucauauggauccuccagaccacagauaacgagggaacugagacaacucuggacauacuggcuaugagguagcccugcuccgcaggagcaguuaaaaaaaaaaaaaaagaaagaaaaaaaaaagaaaaggaauugaggacugaauuaucaccauucuuuguuuuccauuuuguuuuuuuagauggagucucaagucucgcucucuugcccaggguggagugcaguggcgcaaucuuggcucacugcaaccuccaccucccagguucaagcgauucuccugccucagccuccugaggagcugggauuacaggcgugcaccaccacacccggcuaguuuuuguauuuuuaguagagaugggguuucaccauguuggccaggcuggucucaaaucccugaccucaagugauccacccuccucagccucccaaagugcugggauuacaggcgugaacuaccacgccuggcaccauucuuugucuuaaauuucuuucugagaagucuggaggaaguccgcccaugggccagaccuaacauuccuuucugcugauuccaucuuuauuuuuuuucuuuuucuuuuuuucuuuuuuauuuuuuuuagagacagagucuugccauguugacuaggcuggucuugaaauccuggccucaaguuacccuccuucuucagccuuucaaagugcugagguuacaagcaugagccaccacaccuggccugcugaucccaucuuuagacaaauauccccuuccuuaaacaaugugcaaaucagaaaauauuuggauuuaccuguaaccuguaagccccuacuucaggauaucccaccuuuuuaggccaaaccaauauauggcuuccauguguugauugaugccuuugccuguaaccucugcaccuuacauguaagccacuguggaguucaggucuuaagcaugagcucccugauucuguuugcuucuugaccugcaaauaaacacccuccuuucucccacuguaaaaccccgguguggaugauagagcuuacugcacugggugaaauagccuucacccucuacacaccccacgcucaaaccauacugaaccccuuccauugcuccucacuuuccuacuuccauaugcucuacugcacuacuuccucugccuggaacacucuccuuccaaugcccuccuauuauggguugaauugugucccuaaaauuccuauguugaaauccuaacccacggugugacuguauuuggacaucgggccuuuaaagagguaauuaaacuuaaaugaagacaugaaagugaggccuuaauccauaggccugcuguccuuauaagaagaggaaaagacaccagagauagcucccuuggccagauagaggaaaggcccagagaggacauagggagaagguggccaucuacaagccaggagagcucuuaccagaaaucagcuuuacaggcacccucaucuuggacuucuagacuuuggagcagugagaaaauaaacaccugugguugaagcugccuagucuguaauauucuauuauggcagcccuagcuagccacaggauagaaugcaggccuaggaauccuacaaaucuggucuucaagcuggcccgcaaacuggucaguuacaaacuuuucugcaggucccugaaacaaaaacuggaugaaguuucccucucgucuuguuuuauguccuugaaagcuugaccuuguaaccacguggggguacuuucuccugaucucugccauccagagggugugaauuuugggguuccugucaauuaguccuaaaaauuaucuugagcaguuaaaagccuuugcaagcucaaaauuggcugcucuaggcuccuucucggaggagcaauggagacugugcaguacugcagcucaguaacuaaggcuuugcuauuucacagugguggccuggauucaauuccuagcuucgggaaugaguccuuucugguuugauaucuaugugaccuuugccauuuauuaauuaucuuccccucaugaacaacuucugacucccugucuugaaucuuccuuucucugagcuauguuuggagguuccagaucuuguaaaaacugcuuaccaccucuuugaaaauaccucccacaccugugguuaaaucauaaccuuaguuaaggcuuauugguuucaccugggagguuacuuuugguaaaguucaaaagccagaaauauuagcuguuuguccuggcuagagucugauaauaagagauuugguuaaaagucagcuuaauuaaaagugauguccaagauuaucuaucuaucuaucuaucuggcagguuuuauauugauuuuuuucuagauaaaaguuuuuucuucucagucaacugaauuguuuuucucauuuuguuuucuugccacucuugaugcccacauugagaggaccuaagaucauuucuaacagccugggcuuccuuagaaaaaacugagggagcaccacaggcuccauuuugggaaaaaucuguuuuccucauggaaccccaggaauugaaggcaagcaaaucccucucaaaauccaaggcauugcucugauuugcauuguguuaccuaauguuuuuuacuuguagggguaucagaaauuacuuugcauuaugggagagcuuuuaaccuugguguguaauaacuaggcaggaaauaugcuuuaagggaaggcuaauagcaguuauaggggaauaccccacucugugcacguuuggaucagagaagcaugcucuuggccaccuagaagguauggaaacauucuucuacaccuuccaaaacucccagaggggaugggcugauucccucuuuuugggauccagaauccaauauaaaaaugagaucuguaauuuuggggaaucuguuuugccuucuaacugcaccuguuuauuaggccccagaaacugcauguuuucccggcucuguccccacacguugcuccacccugaagccaguaauccaauuaagauucuuaaaagcuggcaaaugaaaaaauuaacagcuacugggucuucugucuguguauuuuuguguguuguaugugugauaugcauagaaaagagcucuaauuaauuggcuugaaaaauaagcacuuaaauugaauauuuugucagaaaaauaaaaacuuuaacaccuuuuaauucaugggacuuuaauaaucuuugggaaauaaagagaaucaaauauauugguaaaauaaaaaugucuucaaaauuuagacaucuggucuaaauuaggucagauuaaauuagauuugcugaaugcuucaaugccauaaacugcuucuuuaacuugauaauuguucaacucaccugcuuuggagccauuagauucuagguagggccuggggacauguggaguuggccaugcccccuagcuaugcuggaaagacucagaccuuaucugcacuucugucuggcguccuaggcuccacaccugguacauaauuaaaaccacuuauuuaucagacuuuucaccaaauauaaaaguugcuaagaguuaacauuguagcacauguaauugaggcuaccagagaaacaguguuaccugcaaggcguguaaggaaaauagaauguguuuuugguaaaagauuauaagaaggcaugggaauguggucuuauugccuaguuuacagaguuaaaagacuguuuuaaguuacauaggauaaagcuaaagguuugaguaaguugugggaggucagugaaaauuaaucuuguaaaagaaauucuguguguuaaaauauuagcuaaaguuaaaggguauuauucaguuuuuccauaaauagaacauuggaauaaaagcacaacaggguuuucuuagagcauuaaucugcucuuuaacaacaacaaaaaaaaauuguaaaggacuacaaaagguuuaugagaaucuuaucucaugguaaaauugauuaagauugaauaauuugucuacaagguuuucuuaagaauuggauuugacauucauuaaugcaaagaugaaauuuggcuuucucucuugaacaaaauuuucauguaauauuaaaagaucauggaagauuuuuguuugccuuuugaauaaacaacaaaauaaagaagaaaaagugagacauuguuuggaaagcugucuucccucuaucaaugaguaaaggauuuugcuugcugggcgcaguggcucacgccuguaauaccagcacuuugggaggcugaggcggguggaucacgaggucagaagauggagaccauccuggcuaacauggugaaaccccgucucuacuaaaaacacaaaaaaauuagccaagcguaguggcgggugccuguagucccagcuaccccggaggcugaggcaggagaauggugugaacccgggagacggagcuugcagugagccgagauggcgccacugaacuccagcugggcgacagagccagacucgucucaaaaaaaaaaaaaaaaaaaaaggauuuugcuuuuggaaaaucuuuguauuaucauuuuggcuaaauaaaugacuuuacagugaccugggauucgauuuuauaauaucaaguguuuuaaaucuuugauauuugacaaacuuuccaaaaucaaauucuauauuaugccuuuuccugaucuggucaauacuuuagauaugagguccccuuaaguccaaaaaugacauauuuggcuuacuugguauauuaaaaucauacaggaagcacugucaaauaugaaaugguguuuagcuuucuuugaguuguauuuguauaaauauguuauugguaugugcuccaaaauuaugggaaacuccuaaauucugauaugacuuaguuuauguuaucaguaauaauuauaacuguuauguaaaauuguuguaugccacagaaguaaccaaaauuucuagucaauugugucuuuaaccacggcuuuccuaagacuuuauguuauccacagaaaauuguugucuuguuuugauccucuuuaaaagaugguuuauaaucagauagagggcucuuaaaugcagguuucugaaaaauuuuguaaagugugccauuaagauagagaggaaaaaaacuuucaagagucucccuugggaaaccaauauguucauaaauauugagcaaacaggaauuaacagcauggacuaaacuaauaaaagaacaaaauaaccuucuagugacuuuuugcuuaaaauguugcugauccuuuguuucauuuuucagagucaagaaaccuuuuuuuuugagcuauuuacaguuguuaaaaauugaguaaauuauacuccuaugagaaaacuuuggagcauauuucuuucuaccugauuucucaagaauuugaaaacuauuugugaguauucuuaacuuauggcagcauaguaauuugcauaugugcaauaaaaaucuguuuuccuuuguaacaggacacaauuagagacacugccuguuuuaccagggcuuugacuggaauggcauucuuucaaauauaaacagauugcuuuaaggaaucaaaguugacuuacagaacugaugaaagccucugggaaaagcuggccucauaccuugucuauucaauuccuuuacaggguuccugaccugugguaaguaaagaaugucacuuucugacaggccuaggagcuccaguuaucuugggaucucaaaaggagaauucacacaacucauacaaguauuugcaggcacagauaaaucugugucucagcucaaggcuuuagaaagucuaaucugagauuucuuauggaacaaaguuacaucaaagucaauuuuuaaaaagccuacguggcaaauaauuauuauugcuaugcuuuauacaaauaaccaggccaagcauaauaagacuaaagcuuacugugcaaacaaaucaguccuaccaugauuuguuuucaauagaaaugggagacuggagagagaaaaauuauguuucagaaacuaugguauacuuguuauucaacucuagucccauucauuguuucgaguuuuuucugccauuuagauugacccuguuuguuccuaugaaccaaccagugaucucuagcugcugcucagaagaaacagaaggguaacauaaauaucuggaucaguauuuuaauucugaacauguguuggaauuggcuagcaaccccauauaagcuugguuccaacaacugccuaguucauggaaaggcuuguuauuuaguuuaguugggauaauuauacuuauuuugcuuuacuguuguagaauauauugcugugguacucuuuguguagcaaugcaggauaagacuacucaacguuuucuuaaauugaacacuuauuaaucuuccagauaucaccuuuugugagaacucgggaguuaggaauggccuucaccauacugaugcuuucucacugagcuccucucuacccugaauaguuacgcaaaaauaucaucaccuguauucagccagaagaagcuacagaagauggaucuucaucugucugcaaauuuugggauuaagggucccuuuggggguauuggggaaaauaugucagaacuauuuaaaccagagcaacuccaucuugaauaggggauagauaaaaugagcugagaccaccugugcuccauuccuaagaggucaggcauucuuaguuacaggaugagauaggacauuacaagacagauacaggucacaaagaacccacugaaaaaacaggaagcaguaaagaagccagccaaaacuaagauggugaggaaauugaccucuggucauccucacagcuuaucuuaggcuauuuauaaugcauuagcaugcuaaaagacauucccaccagugccauggcaguuuacaaaugccauggcaacauccagaacuuacccuauauggucuaaaagaaagagaaacccucaguucugggaauuccccaccccuuuccaggaaaauucaugaauaauccaccccuugcuuagcauauaaucaagaaauaaccauaaaaauagccaaccagaagccuucagugcugcucugcuuauggagcagccauucuuuucuuucucuacuucucuaauaaacuugauuugaucuuacucuguggacucacccugaauucuuucuugugugagauccaagaauccucucuuguggucuagacugguaucccuuuccaguaacacuccaauuaagcuuucuucucuaaaaguuaaacagaaaccagugcuucugaaagacugguaucaaccaccugccugacacugccccucccuuuugcaguuucaacacaacaacaagaauucuuuccugauaagagaccucugaccacagagugguucuggccagucuacagaggcugaacacagagggcuuucguguccucugcuucaccuuuugauguauaggcccuaacuguaauacauuaaauguuaaggcuccaccccaaagugacuugugaugcaugcugcauacacguuagccuacuauguaugugugugccaccccuucgugaauacuaauagcuccuccuauagccuguugaauauauauacuuagccacccugcucagcauaaauucccguucucuuuuccccucucucuccuuuccaaauuuaugagccccaucauucuucaguuaacaauauuuaggacugccagaacuagaggaacuucuaccacacuucaauuauuuucauuuguaaaaaaaaaaaaaucugaugcuaguccuaacauuuugcauugacugacacccuagagaaaauguccuuugucucuugccugauuuccuuuaguucuagccaauaaacuaaugggcaauccauacauaggcauuugaaaauguaucacuggggaagcugaaguccaaauuuucugagacuugcuguaacagggcuaagggauaaauccagguuuauuugccagcccuguucaaagaaaaaagaugguauaaauuuaacacuugauaaaaaggcugaucaacucuuuuaaguuuuuagauaagaaugaccuuagaauuuaaaagaacagcuaagagaaaacuaaagacaaaguggaaaagacuaaaagaacacuuaacacucuucucuaacuuccuccuguguaaaagaagugauaaugacuacucacaggguuaauauaaggauuacauuagauaauauguagagagcgccagggcucgauauuuuuaagcacgcaaaacuagcaaguguuauuguuuuugcaagaaaucauugcuaacagaaaugguaaauacauuccauauguacaauacaaagagcauaaaaaugacuguaaacaugaccacagaacuucagucaacacucaacguuugaagaguggaaaaugagcauuugggaaaaagacaagaauuaucaugccaguuauuugggaaauacagguuggcaaauuuggaaucaauccuaaauauggauuuuagaaugaauuauuuaaaaagugguccaggauacuugauaggaaaguacucaggaggugcuacagugagucacccuuagaaaggccaugcuuuggcugggcacaguggcccccaccuuuaauuccagcacuuugggaauccuggggcaggagaaucacuugagaccaggaguuugaggugagccuuggcaacauagcaagaccccaucaauacaaaaaauuuaaaaaucagccaggugugaugucacaugccuguaauccuagacacucaggaggcugaggugggaggauuacuugagcccagcaggucaaagcuguagugagcuaugaugacaccacuguacuccagccugggugacagagcaggaccuugucucaaaaaaaaaaaagaagccaugcuuuuauuucacuuucuggaaugauuccaaaucaggagucgacaaacuucagacugcugccuguuuuuauugcuuuuauuggaacauguucauuuauuuaugaauugucuauggcugcuuuuguacuauaaaagcagaggugaguagcuauauagccuacaaagucaaaaauauuuacuauuaagaccauuacaaaaaaaguuugcuaaugccuucucuaagugacaagaaaaugcuacaggaugguuauuaucgcaccaggaaugaccucaaaaccaagaucuccucacuggcuccugccuuugaccuugugguuauauccaguuuggcucaguugacuaggc[450 bp omitted]uauacauauucagcaucacagcuacccauucucucauucucucucaaaucccaaacacugcaaccccaccacccuacuaacacaugcuuaucaagaucaccaaggccuuccacauugacaaauccaauacucaguucucaggccucaucucacuguggcaggauuugccacagcugcuugugguuuccagguucacuugguuuccaguccacuaaaccucucuuguuuuucuuucuaccuugcaggcugcuacuucucagacagcuuagcauuuuacaaacucccuuucuucuaaaugcugaccugccccagggguuaguccuugccuucuuuucaucucuaucuacaguucuccccuuaaagauguaaucuaguuucucaccuucaaaggcauuuuuaugcuuaaagacaagaaucuaucccuuaaauuccaaacucuccccugaauaauagacuuucacaucuauaguaccuacaugcaugacuguuuuaacucuuuauucuacccauaucacuccaacaaacaaacaaaaaaagacuucuuucucauucuucuccaucuuaguaacugauuacuauccaguugccaucgcccaaaaggaaaacagcaucucuucucucacacccacauccaaccuaucagcaaauugugugagcugcaguaaguauccuugaauguaugucuucacaugcaacaggggauauaacuauaacauaaauuucuugaagaaaaccuacaucuuuaaggcucccaaauguaauuuuccugcuuuauucaauuuacuaguaacaguucuuauauuuguuguaucaacaauauaauaguugauuaacaagaaacugagagugaaauuauauuggcuguguguguguauguauauguguauguuauaugauacauauacauguuauaaaauauagaauauaauauauaaaaucugguuaaauacaucaaauauaauuguaucaacaauauaacgguugaucaacauuauaaccguuguuaucaacaaucuaauaaugguugaucaguaagagaccaaauuuaauuuuccugcuuuacucaauuuacuaguaacaguucuuauauuuguuguaucaauaauauaaugguuaaucaacaagagacugguuauauaaauuaugcuacugagagaugacagugcuggcagcccucccagcccucacucgcucucggugccuccucggccucggcgcccauucugaccgcgcuugaggagcccuucagccugccgcugcacugugggagccauucucugggcuggccaaggccggagcuggcucccucaguuugcagggagguguggagggagaggcaugggcgggaacccgggcugcgcauggugcuugugggccagcuggaguuccgggugggagugggcuuggcaggccccacauucggagcgaccggcuggcccugccagccccgggcagugaggggcuuagcacccaggccagcagcugcggagggugcaccgggucccccagcagugcuggcccaccggcgccgcgcuagauuucucgccgggccagauuucucgccaggccuuagcugccucccugcagggcagggcucgggaccugcagccugccaugccugagccucccgccccccgccaccgcugugggauccugugcggccugagucucccugacgagugccacccccacuccacagugccuggucccaucaacagcccgagggcugaggagugcgggugcacggcgcgggacuggcaggcagcuccaccugcagcccuggugcaagauacacugggugaagccagcugggcuccugagucuaguggggacuuggagaaucuuuacgucuggcuaagagauuguaaauacaccaaucggcgcucuguaucuagcucaagguuuguaaaugcaccagucagcacucugugucuagcucaggguuuguaaauacaucaaucaacacucuuuaucuagcuaauccaguggggagguggagaacuuuugugucuagcucagggauuguaaaugcaccaaucagcacccugacaaaacagaccaaucagcucucuguaaaauggaccaaucagcaggauguggguggggccagauaagagaauaaaagcaggcugccugagccagcaguggcaaccugcugggguccccuuccauacuguggaagcuuuguucucucgcucuuugcaguaaaucuugcugcugcucacucuuuggguccacacugccuuuaugagcuguaacacucacugggaaggucugcagcuucacuccugaagccagcgagaccacgaacccaccgcaaggaacgaacaacuccagacaugccgccuuaagagcugcaacacucaccgcaaagguccgcagcuucacuccugagccaacgagaccacgaaccuaccagaaggaagaaacuccgaacacaucugaacaucagaaggaacaaacuccagacacgacaccuuuaagaacuguaacacuuaccgcgaggguccauggcuucauucuugaagucagugagaccaagaacccaccaauuccggauacgcuaccauguuuuacagacucgaaaauaucuuuuuuuuuuuuuuuuuuuuaccuuuaacauguuugagaucuggacucagcauuccacaauuguuauuggcuaagcagcaguuauggcaaagcugucauugccaaacgucauagcuguugacacugaugauacuuccaguggcuaugggcauuggugacacauguugagugugccauguuaaaugucuuuaaaaacuuaugauuuagcacugagaagaaaaguuacugcacagaaaagcucaaaagcaggagcauggcauguauuugauguuagugaaacaaauauuuauaagacuauuaaacaaaagcaagucaauguuuucuugcaaagcaacaaccaagcccucuaaugaaacccacaauaggaagaaaccuuuaaaaagauaaagcuggcugguggcucacaccuguaaucccagcacuuugggaggcugaguggggcagaucaccugaggucaggaguucaagacaagccugaccaacauggugaaaccccaucucuacaaaaaauacaaaaaguagccgagcaugguggcacaugccuguaaucccagcuacucaggaggcugaggcaggagaaucgcuugaaccugggagacagagguugcagugagccgagauugcaccacugcacuccagccugggaaacagagcaagacuccgucucaauaaacaaaaacaaaaagaagauaaagcaguguuagcauuuguuacaaaauuacaugcaaaaauaaaaaugccuaucacgagccaagcaaugcaacucauggcaggagaaauggcagauucccucagaaaacguacaccucaaagaaauaagaggcuaguauaacuaacucaugaaucacucaggaugaucagggaaguacugcguugcaguuugauucuccaucucaguguauaaaauaauguuacaucuuguaauuuaugacauucuauauuaaauucaguacgguacauauguccaauggauaccccacaucuaggaaaauggaaaaaaaaauagggguguauccguaugugccaaaaugaaaagaucuccaagacaaauuuuaagugcaaaaaacaauaauacaaacaaaauuguucauaguaucaccacuauuuauauuuuuuaaaaaggaagguacagauagagagccccaaaauauucuucaucuauggaaacaugacauaucaaaacuggcacuguaaucagugaggaaaggauagaccacucaauaaauggugaugggacaacuuggucuccgugcagaaaaauaaaagaaauuguauauguuacuugauaacaaaguucacuuucauauggauuucauuuaaaugaaaaaaagcaaaacuuuaaaagaauguucuuggaguaagaauuuauuuaaccuguaugaccuuggaguaacaaaaaauuucuuuaaaaugcauaaaaaguauaaaacauaaagaaaacuuuaacuacuuuaaaacuaaguacuucuguucaucaaaagauaucaguaagaaagugacaaagcaagacacagacacagaagcuagccacagacugggaaacuauuugcaguacguuuauccaacauaggauuugccauagacuaggaaguuauuugugauauauguaucaaaggauuuauaccuagaauauacaaagaugcaaaaaauuaaaaagacaaaagacuugcaaaggcacuucacaagaggacuucuguagcugguaaaccuaugaaaagguacucaacauaauugguucucagggaaauuaaaccacaaauaacacaagacuguauacauuagaaugaggaaaguuaauaagacaguaucaguauuggcaaagaaaugaagcaaauacauacaccacugaugggagaguaaacugguauaagcacuuugggaguuuggcagugagacagccaagugggaagaagaccccagagaaacuccaaccggccugcacacugggaggagugcacacuggggagccacagacggucacaccauucacaguggggaggagccuggccccuccucuuccugggugguaccugggauucaaucugcaaggcaggaagcaugcuagcaggacccuggcuuuguggggagucccuguuucccuuuuuucccaauaaguuccauuauucucaccuuucaaauugucugcgagccuaauuuuucauggccuugggacaaggaccccaucuuuagcuaaacuaaggagaaaguccuacaacagcaguaucuacuaaagugaaauauacauacacccugugacccagcacuucaacuccuagguaaauaccaaagagaagcaacuacauaugucugccaaaauguccaucugcaguaaaagagaauaccauaccagaugggagauggggggacauaaagaaggaagugcuauaaccuccaacgugguugacucuauuggagagggaacggaggcaaaggagaaagguacacaaaggcuuuccauugaacccaucaugcucucaucuuaaccaugugcuggguccuuagauuuucacuuucacucuuuucuuuaaauuguauguuuauagguguguaauuuguuuuaaaauuuuugaguaguggcagaaacaggacaaagaaucacugccaauuuuguaaaaagagagauaauguacaaacacauguaaggguguguguguguguguguauauauguguguguguguguguguguauuucugaaaggguauaagaaaagcuggcaauaggaauugcuuggaaggagaugaauuguagaacccuggauggaaaugagagugugagagugaaaaggaaacuucccaucuauuguauaccuuugguucuacuugaauuuuuuaccagauaauuucucugccaaaaugaaaaugaauaguccuaaacuuagaagcauuguaauugaacuugagacuuaauuggcuguguguauguauguauauguguauguuauaugauauauauacauguuauaaaauacauaauacaauauauaaaaucugguuaaauacaucaaauauaguugagagcaagaaagcugauagcucagaaaagaaaaaaguagagaugaaaguagacauaguagaaugagaugggaaagaacuuagucgcccccauuggggcuauguuuccaugcuaaccauucccacuucuucacagcagugaccgccaucaauaugcacucauuuaguggguuuauauuaugaaagucugacccccugccagacacugagcucugugaaagcaagaagauaguuuuugcucagcacaguaucccuagacuuagugcagggacugacacauaaaagauguugcgggauggagguuaagagaauacaggcucuuauuucaccgcuuuggaccuuacuuucacaucccuaaaauacugcauaagcaccugcucacaagauuguuaucaggccaagcucaguggcucuugccugcaauuccagcacuuugggaggucaaguggaucaccugaggucaggauuucaagaccagccuggccaacauggugaaaccccaucucuacuaaaaauacaaaaauuagccagguguaguggugcacgccuguagucccagcuacuggggaggcugaggcaggagaaucgcuugaauuugggagguggagguugcagugagcugagaucacacaacugcacuccagccugggcaacagagcaagacucugucucaaaaaaagaaaaaaaaaagauuguuaucagaguuagugcauggaaagcacugaguacagugccugacaaguggggucacuucugaugccagacgacagugaugagaacagaucaaaugccaauuucgccaaggagaccaggccauucccgaaaaguagcaguaccuucuugggguggaaguguaagaugggccugggccuuuugcugggauauaaucacuuucaauaauuccuuggguuguaugauuuuccagcuguucacuggagcauugugugagguagcagggaacugggauuccaguuagggaauugggauacaauguggaagaugccucgcaucaugaacuaugcaacaguuagaaaugauggacuugauguacacauaguagacuggauagaaauggaacacacagugcugggcgaaaaagagaagaaacacaaugaaaucuguaggacaaagucucuuacauaaauuaaaauuacauguauaaaaagcgaugagauuuuuaaaaacacauauaagccagaauaauauuaauuugauuccugagaauuauuucuaguggagagagaggaaaugagaguggugaaugaagauagaagggaauaaaacaaagacagggaccuuauaugccccaugauggaaguaccaugaaucaggagcauaauuaauaaccugguguaccuaaacuccaaagaguaaaaaacauccccugugacaaguugaaaugagcaagaacagccucaagaugauacucacugguaagaguggccagauaauaauaagcugauuauaacaggcuaaaaucaaggcaaauagacuguaucucuaaaaacagacucgaugucuuaagacacuaaaaacggagcuguuaauauaaaauauauugaguuaugcaaauaaaacugaauauuguuuauaaacaguggaauauauauauauguauauguauuucacauaggacuaugaaaaagaacacauuaaauguauagacaguacccaaauuaaugauuuauaaauugcugcugugcuaacuagucuuuaaaucuuucagauucuucuguucauagaaacuaauuguaaaguaaaggaaaaagaugaucagauguauaagcacaaauagaggcagugaauaaggaaaauauuuuucaugggaauugauaugauuacaggcugaauuguauguucaaucuuaagauuuaacaaggugauaaaaggaaaagaaaggcaugucuaugaaacgcacauguccuuaagcucccuguggagugaaccagaaaugaaggagugaaucauuugagacagacaaaucucaucuccagccuuucuucugcccacucacaaaauggcagcaggguuuuaaaaugggaguucuaaugaacauuucauaauguaagauuucccaggaaguugcaaauggggaaacugcuuaugagagaugauuaaaauguugcucuacauuauucaaauuauauugugugcauccaaugcugguauuaacuaaaugcagacagcuucuuucuaguugagcucaacuccagagauguacuuacagacaaucuaaguguaggaggauaaaguuuacugaaaaagaggaauuaauuaauuucugcauuagccaaagucagcuugucuuugaguacauuugaaaaagucacaucugcagguagccugcaaaucugugguggacagccugggaucuggucacaguccugguugggcuaacuccugacaguuuccagggcugucucuagcaucacagauucgacccuuuucaaagacacuuauucucagcccugguauaguucaguauugucucacucuaccaccucccaaauggagagagugggugggaugaaaugggacugacauaugccuaaaaaguggaaggcuaagagcaacaaucaaauggaauuucagagcuugugguugugcauauuucugcuauugacuauggucaagacaccucuacacuuaccagaauccccgaggaaauaaaggucugggucuguguguccacauguguuuguaccacuguaccugcauggaguuacucaacaggacgagguuaaaaucagcaaaaccuggcuuccuuggauguaguguuguuaaguauccaauauugaacaugacagucauauaauuuuaguuucuugucuaguaaagugaaaacuuagaaaucauucauguaaauguuuuuauuuaaauauuaugaucugagauuuucucuuaauucccaacugauauguaaucagcaguaguuuagagcccuccagacuguaguuucucuuuuagauuuaacaacccauaaauaaauacuuuaggagauacugauuaaaaugcugcuauaauccuuuuuauaaauaugagaaaucuuuugguaaugugaaugauuuuacucucuaaacuuuuuacaagaaguuuauauaacauaauauccaacaaaguacauggauuuaaauauuuguguaccauacugaugcuauacauucaggucagugauuauccuguauuauguauuuauguauuauaggcuauaccuuauccaaaaagcuucaguccaaaaagcuuggacuaucccuuauccacaaagcuucugaccaaaacuguuuuugauuuaggauuuuuuucagauuuuggauuaaucugcauuaugcuuaccaauucagcaucccuaaucugaaaaaaugaaaucugaaaugcuccaaugagcauuuuuagucaugucagugcucaaaaaguuucagauuuuggaguauucugaauuucagguuguuguuuucuucaaauuuccaugcacugguagccugguauuuuuaauugccaaucccuacucacugguuauauaugaacaguuaauuaaacauguuucaauaauacacacuuccauuuauuaucaucauaaaucuauaaggauuuuaguaauugauuuaauuauuuaucaugaggaacugcacaaaaacauuaguacaacaaguauguaucuaugaagauuauuaaaaaugaaggaggccgggcaugguggcucaugccuguaauccagcacuuugggaggccgaggugggcagaacaccugaggucaggaguuugggaccagccuggccaacauggugaaaccccgucucuacuaaaaguacaaaaauuagcugggcaugguggcacgcaccuguaguccccgcuaaucaggaggcugaggcaggagaaucacuugaaccugggaagcagagguugcaaugagccaagauugcaccauugcacuccagccugggcaaccaagcgagacucuaucucaaaaauaaaauaaaacaaaauaaaaaugaaggaucaguuaauuauaaaacauguaaagagacagagcuuggcaaacauaaugaaauauuuuaaguccauccaauagcagagccacucccuaauuauauggcagugacugaaucuuauuuuaugugaaaaacaauaauauuagacuguuauaucagggccuauggaagugaacucaacacugccauuaggaugaaguuuagcuuucaauuauauaaauauuuccacuuuggugccauuaaaaguucagcuuucaaugacuuaaagcacugaaauuacuggcagacauauauuucauuccuuaacaagguuugggauggugaguccuuuaaaagugguuaugaaaucucuggagaguuuguugaaugcagagucucugauccuggcucuagaaauuucgauuugggucugggcuggggcccaacaccaauguguccauuguagaauccucaauguucuauaaacacagcaacuaccauaccagggaauagagacuggacacaagugaucaacuaggugucuauaaaaccuaauacaguagccuaacauagauuuauucauucaaagaaaucaaaauaucucuuggacauaagacccaguuaaucuaacuaugaaaaggacaugaaauaaaaacauauagaagucagccaaaagcaagacaggaccaaaaaaaaaaaaaaaaucacauaacugacagaguugagcuugcaauuauacuaugaagacaaugacaggauaggcccaucauagaaacaugcaacauaaaaagauaaguaaagcuagucaucucugaugaaagaaucccagcaaaccugaagcuacuggcaccagucuuccagccaguacuucacauaucaaauguagccaccacgaaaaccuaaugaaugaucauuaccaacaugaauugcguaacaucuguagggggcagaucuauuuaaauccauauacauuauuggauguuauuuguaucauguuccuuucugaaucacaagugaugguuuauucugccuauaccauuaauuagaaaaugauaguugauacaaauauaccaaccaaauauaaauaaugucggcuccccaaaugguauucguuaauaaauaauguugacuccccaaauaguauucauuauuuccuucaauucguaccucacaacuuaggaaguagauuuuuaaaaauuauugauuuugagguccaaagugugaucaaguacauaaguugauagaguguauagugaaagagaaccauucagcagggcuuuuguacuaagguucuugaaugugggcaggcaucacaaucacucaccagaucuacucagagucucuggagcuuggauuccauauguguauuuuaaauaacaccucggugauucaaaugcaaaaaguuaagaauucccuaauagugagaaugaucaugacuacaagauggaccacaaaaccugauuuaagaucuugucuaacucuagauuacaggauuuuggcagucuaaagaauuuacugaaucauggaauuagauacauagauguuccucaacuugugaugggguuacaacucaauaaacucauccuaaguugaaaauauccuuaaggugaaaaugcauuuaauauaccuaaccuaccaaacauccaucguaucuuagcuuauccuaucuuaaaugugcucagaacaauuacauuagccuaugguagggcagaaucaucuaaaaguguauuauuuuauaauaaaguauugguuaucucacauaauuuauugaauacuguacuaaaagcaaaaaaacagaaugguauguguacucaaaguaaguuucuacuaaacucauauuguuuucaaacaucauacagucaaaaacuccuaaguaggaccaucguaaguuggagugcagcuguauuagaaaacuagaucaagaggaagaggagggagauguaaaaaaaaaaaaaaaaaagaaagaaaagaaaaaugaaaacuagaucaauauauuucaugaacagugaaacaaaaauucuuaaaauauuagcaaacugaauauagcaagauaaaaaaauggauuauucacaaugaccaaguaggauuuagcuuaggaaaauaagguugauuuaacauccaaaaauaaauugauauaauucauucauuaauaauguaauaaaguacaaaaccacauaaucaugucaagagauucaaaaaaagcaauugacaaaauccaacauccauucaugacaaaaacucucaacaaaccaggaauaggaguaucagaucuuagacugaaaaaguaucucagaauaacuggaagguagugcuuugagaucaguaacaauguuucaaccaacuuuaaaaaguacuccuuccuaucauaaaguuaaaaauaauauuaaaagaaaaccaaacacugcauguucucuuauaagugggagcugaacaaugagaacacaugggcacaugcagggagcagcacauacuagggucugucggaaggggcgggaggaggaagagcaucaggaagaauagcuaauggaugcugggcuuaauaccuaggugauggguugauuuguacagcaaaccaccauggcuuacauuuaccuauauaacacaccuaccugcacauguacccuggaacuuaaaagcugaaaaaaaaaaauucaauuaucuuaaaaugucaaaaaacuuauggaaguagaugacuuuuuaaaauuguuccuauucuuuaaaacuugucagagagacugcaauucacgaaauucauuaucuagauccuuacacggcuuucgaaagguaucaaggauaccaaagaaaacacuucgguauuuauuccauggcccuauauaucucucuaccuuuugcauucauacagccuaguagaaaaccugguaaccccgcaacacuuaguagagaacagaauggcuaggcuauagcaaaagcgcucuaucucacacucucuuauucuaaauaucuccauauguucccuaucucuuuaccugccagccacauucaaucuccuuccaucaauuaucccucaauaucacacucucaagccacagcugccuagcagauaccagagacaggugacagggucuucauauaaacauacucguccgcucaaaaggccuuggccccuccaggcaugcccaauccaugccuuuauucacaagggcacccaaccaagagacugugacccaccaggaaaucauaaggucauguuauuuaaaccuaccaucccagcucuucaauuuccuuccuuaacucccacugugaacuuuauuuucaccauuuuucuaugugggaaggggaaccuccauucucacuccaugccaaguaaucccaagaccucaugaaaaugaaaauuagcagcucucccuccccuaaauuuuaaaaccauuucuaccucagagaaguacugccacaaugggaggcacugcacuuguaaacuuagaaaauaaugacuagucuuaauugggcaaggcaaacagcacugcauuuacucauuuaugugcugucuauggcugcuuuaguacuaaaauggcagaguuuaagaauccucuccggucaggugaaguggcucaugccuguaaucccaggacuuugggaggccaaggugggaggauugcuagaggccaggaguuugagaccagccaggacaacagagugagacaucaucucuacaaaaaauuuaaaaauuagcuaggcaugguagcacaugccuguaguacuagcuacuugggaagcugaggcaggaggaucacuugagcccaggaggucaaagcugcagucagccgugauugcaucacugcaccccagccuaagcgacaacgugggcaaaaaaaaaaaaccagagagagaccucaaaaaaaaaaaaucauuuccuaccuaaggucacagagauauuuuguauuucuuaauaaacgucuuaguauuuugucacauuuaaguauauaaucgaauuauaauugauuuugggguaugguaagagguagggaucuaauuucuuauuagaaacuauauggccacaaagccaaaaaauauuuacugauuggcgcuucacagaaaauguuugcuaccucuaaucuugacaaucagaaggaagaagucauuaaugaugcuacuggggggcuacugcaaacuauaugcuagaaguuucaaacaacaauaaacaauaauaacuugcccagcaaaguaccccaaaauaaagagucaguuugcaccucaguuccaaugaauguaggacgaauauacagacuagcagauguugaauaugggacccauucuugauccaauuucacaagcuguugaauacacucuaagagcucuucuuugucaaauaccugaaagaaugaaaaacauaauaaaugacagaauuuucucacaauguggcaauaauaaaugauccucacugaagcauuuaaacuguuaaaaaauuaauaaucccaacacaaaaaaauaagaaauguuugaggugauggauauccuaauuauccuaauuuuuauuuauuucuuucuuauuuguccuaaucauuacacauuauaugcaugcaugaaaacaucaguguaccucauaaauauguauaauuuaugguaccaauaaaaaaaauuuuaaaguaauaauaaaaccaaacaauuuuuucugauuuuccccccaaaaauugugaugggaugacgagcuauccacaugugaaagauaagauuagaucccuacaucuuaccauaccccccaaucaauucuaauuagaugauauacuuaaaugugacaaaauacuaagacuuuauuuaaaaaguacaaaauaucucugugaccuuaagguaggaaaggauucuuaaguaggagauguaaaacacaaaucaugaaggaaaaaaauggauaaaaugugacuauuugaaacuuaaagacuuccguucuucaaaagauguaaagcaacaaacugggugaaguuauugguagcaugaucaacaaagaauuuuaacugguauauauauuuggauauccccaaagucaaugaagagauagauaacccaauaggaaaaugggcaaaagcaaagagcacuuuauuucuaaagaaaaaaaaauuacaucuacuagaugggugauacuucauaaaauaauuuagucucugcucacuugcaaaguagagaaacauacuuucagagaugugaugggucaccuaagguagaaaugagucagucauaagcaucugaguaaagcucaugaagucagaauuugucuauuuaaauauugaccuguaacagcaauaauaauguaguaauguuauagaaauugggacugccaaucauauaggugaacccuguagcaccugccucagccccugguauugcugucuagagacagaauucagugagaagagaacuugaccaggaauaaaaacaccuggaucuaauuucuugcccuguccuuuugcucuuugugacuucagacaagucauuuaaucucucuggacucaaguuuucuucucuguacaaaggcacuaauaaacuguacaacaaauaaucuucuuagcaacgccuuacugcugugauuacacagauaaggaaugugaaacuacauaacacaguuugguagcaaaauugaugucuaacaaauauuacuucccuuuccuuccagccccauuuuaaagacuuuuccccagugaucuagcuguaaugagaagaagagcgaaacuaugcccuaguccaaagaauuuaccuuaauuuccccucugcuacuauauuauggccuccaaaggagaugggugaaaugcggguuacaaaaauaggcagaggaaugaagaacacuuggauuuagccguccucaggcuuccugaaugcauagguugggcuaaaucccugaagcugggcacgguggcucaugccuguaaucccagaacuuugggaggcugaggcaggcagaucacuugaggccagaaguucaaguccagccuggcuaacauggugaaaucaugucuccacuaaaaauaauuuuuaaaaaaauuaagcugggcauggcugcgugcacuuguaaucccagauacuaaggaggcugaggcacaagaaucacuugaaccccggagguggagguuguagugagccaagauugugccacugcacuauagcuugggugacagagugagacucucucucaaaaaaaaaaucuaacccaucuuacaaugauuucugcuccauaagaaacauugugacagccacgauucaauggccaugagaaaccauuuugauaucuuuuuaucucaaaacauuacuuaagauaaaauaucaaaauaauuaaguuacuauaucuugcuagcaucuaaagcaauuaggcaaaauauccgcaaaauaccugugcugcacaccauauuuuccauuuucaauauuaauuucauguggucuucaaauauuauuuuagguugagauacauuuuucuuccuuacucuuucaucucucacuugcauaugaaucccccacagacacugauuuuaaaaaauuguggaauugccaaaugauauuauuuucuuggguuuuuuguuuuuuguuuuuuuuuuuuacagagucucacuuugcggcuuaggcuggagggcagugaugugauuaucuuggcucacugcagccuccaccugccagguucaagcaauucucaugccucagccacaccgaugggaccacaggcaugugccaccaaacccggcuaauuuuuguauuuuuugcagagaugguguuucaccauguuggccaggcuugucuccaauuccugguuucaagugauccacccaccucagucucccagagugcugggauuauaggagugaaccaccgugcccggccauuuucuuguauuuuuaccuaacuaaaguagaucagaaauaauguuaauguucauaugguuuguacugaauauuuaucuaacuauucagaaauuauuuauuugguggucaacaccgugacccguuacauuaaaagaaacacaaaagaaacuccuacacuuacauaccggcagaguugcccucacagcagagcgauacauucuauccauguugagguuuggcugaaacagucgaauuuuauuaucuacuccucgaaaugccuucaauccuucaaauaacuggagaucaaagagaaaaaaucuuagaggguaaccaaaagaaaacaacccguguucaagagacugacuuuccuaugggcguucaucuuauucaucccauaaagcuguugacauugaccucaacuugagaucauuaaauccaggaaagcuaacaguugacaggacugguaaaaacaaugguugagguggaggaaaguuauuuuauuaucagaauuugguaggaauuccgaguucuccucugcuuagcaggagccacacugcugaauaacacauuuagguguuauuuaagggagcaggaagaaaacaucuagaaucacacagcacagguuaauucccuaggcaauggagaucgaaaccaaaggccuuguggcaccguggcccccaaagaguacccccauauccuuucauguaaucugguucauuugaaugcuggauaguagauaauccagaugugaccagagcugguucagucccuaaaucacagaaaccaggcagcucaagaccauacuauguuaagccacgucaccucccucaaucaaagugcuguccugaacaaaccacugaucagggauuugaaaagacuucaguagauacauacugauaaauacagagaaagacaaaaaucaauaauuuuagugggaaaauuuaacacagcuucucuaaguaauuuauagaacaaacaggcuaaaccuuaguaaagauaugcaagauaugaacaacaggaagaacaaacuucccuaacugauacagagaacucuuacacagaccagcuguagaauucacauauuuuccaaacacaagauaagccagaaaucaauaccaaaaguuugacuggacaccauccauauuuuggaaaauaaauccaccacuaacuaaaccauaggucacagaagaaaaauggaaauuagaaaauaaguuaaacugaacgauaaugaaaaguaaggccuuuaaagauguauacccuaaaaacuuacaugggaaaaaaagaaauacaaaucauguauaauuaaaaagcauaaaauuagauguuguauuuaagugcaaauauauuauuaguuuauuaaauauaacaguacuaaagcuucgguuaaaauauaaguuuguuagauuggacucagcugacaauaucugaaucaaaaagacagaaaaagauauaucaugcaaauacuuuauuuuuuauuauuuauuuuuuuuuuuugagacagaguuguuuuucucugucacccaggcugaaugaaguucaguggcaagaucuuggcucacugcaaccucuacccccuggguucaagcaauccucccaccucagccuccagaguagcugggacuacaggcgcgcaccaccacgcccaaguuaauuuuuuguauuuuuuguagagacgagguuuugccauguugccuaggcuggucucgaacuccugggcucaagugaugugccugccucggccucccaaagugcugggauuacaggcaugagccacugcaccuggccugcaaauacuuucuaaaauaaaacuggcaagcuuccauuacuauuuauaaaacaaaagaauuuaagccaagaagcacuacugaagauaaaaaaggcaacuucaaggcugggugugauggcucacgucuguaaucccaacacguugggaggccaaggcuguuggaucacuugaggucaggaguucgagaccagccuggacaacauggugaaacccaucucuaccaaaaauauaaaaaugagccaggcaugguagcaugugccuguagucccagcuacuugggaggcugagccaggagaauugcuuaaacccaggaggcggagauuguggugaaccaagaucacgcugcugcacuccagccuggugacagaguagcaacuuccuaagguucaauuuaaacuucauaauuuuaaaacuauacauacuuagaauggcuacuaucaaaaagauaaaagauaaguauuagugaggauauggaacccuuguauacugaggguagcgguguaaauuaguacagucauuacuuuuugagauucuucccaacacuaaaaauagggcugagugagauggcucauuccuguaguuccagaaauuugggaggcugaguugggaggauggcuugaggucaggaauuggaagcugcagugagcuaugauugcacugcugcauuccagccuaggugcuaaaaauaaauuaauuaaacuaaauuaaauuaaaauuaaaauuaaacuaccauaugcuucagcaaucccacuucuggguauauauccaaaagcagcaguccccaaccuuuuuggcaccagggaccaguuuuguggaagauaauuuuuccacagggaugagcguggggagucuugcagagugcaaucauucuaccucagaucaucaagcauuagauucucauaaaaagugcaccaccuagauuccugcaaugcacaguucacaauaggguucacacuccuaugagaaccuaaugcugccacugaucugagaugagauggagcucaggugguaaugcucacucgcagcugcucaccuccuacagugcgauccaguaccuaacaggccacacauaccacugcuguuccauagccugggguuuggggacccuuauccaaaggaauugaaaucagcaugagguaucugugcucucauguuuauuguagcauuauucacaauagccaggauacagaagcaaccuaacuguccaucaacagaugaaucgauaaagaaaaugugguauguauacaugauggaauguuauuuagcuauaaaaaagaaaauuccaucauuuacaaugacauggggaacccguuggacauuaugcuaagugaaacaagacaaguacagaaagacaaauacugcacgauuucacucauauguggacugaaaaagucaaacuaauggaaguagagaguagaauggugguuaccagaggaggcuagggguuggggaauuggaagauguuggucaaagggaacaaaauuucaauuaggaggaauaaguuuuugagaccuaucgcacagcauggugacuguaguuaauaauaauguaucauauauuucaaaauugcuaagagauuaaauuucaaauguucucaccacaagaaaugauaaauauguucagugaugaguaugcuaauuagcuugauuuagucacucuacaauguaaacauauaucaaaacacuacaucguaccccauaaauaaauacaauuauuugucaauuaaaaauuuaauaaaaauuguaugcacuuaaugacauggcuucaaauacauguaaagaguaugauaaucucauucaguauuauagauauaagauauacaaaaggcuaauacaacaugacuaaguugaauuuaucccagaaauggagauugguuuaacauuuaaaaaaaucaauuaaugugauucauuauauucacaguuuaugggaggaaaaaaacuauaugaucaucucauuagauguagcagauguaucugauaaaaucaaacuaacuuuucugauuuuuuaguuuccuagauaacuaaaaaacaaagauaacuucccuaagugacaaaggauagcuauaauaagcucgcaaacguuauacuuaaugguaaaauguaaaagcuuuccuuaucaaauugggaacaucgcaaauugccuacugcaaucacucuaacugaauauguacaaccaguauaaagcaagaauaaugaaauuuaaaauaucagcuuggagaugaaaaaauauaacugucauagaucauaaaacauagaugauaugauuacagagauagagaacacagaaaaucugacagauaauauuuugaaaucaucuguuuaggcaagcuggccagaugcaaaauuauauuccuauguaauagcagcaguuaaaaaauaaaaacacuauuuacaguagaauuaaaagauacaguacuuagguggagaaaaaucuaacaaaagaagugaaagauccauaaggaaaauauaaaacuuuaccaaguuauuaauguagaaagcaauuucaugcucauggauaaaaagccucaauauuauaaagauguugauuuuccccaaacugauuuauguauucaauguaauccaaauuaaaaaaaaucacauuagggcacuuuauuuucuuuuaaaaaacugcaugacaaaaguuuaucgacuugauaaaccaaaucuaaaaauuauauggaaagaaaaugaccaagaauauccaaggcacucuuggagaacaaaguagaaggacccuuccuagcaggcaaggcucauuauaaugacugagaaaccaagacuguggcauuuaugcagacaaguaaaacaacugaacacaaauagagauccagaagcaaacucauguguacaugacaaaggugucaucaugacauaucagaggggaaaguaccgcccguuuaaauggugcugggaaaacuggguauacauagguggaaaaaaauaaauugggcccuuacuucauacaaaaaucaacuucuaggauuaaagaccuaacugugaaugacaauaucaauacuauaagauaucuuuauaauauaagggcaggaaaagagucuuuaaagacacaacaaauuccaaacauaaggcagauugacaaaacugccuuuaauuuaaacauauuucuugucaucaaaaaauuauaaagacagcaauaaaaaagugaacaaaaaacuugaacaagugggcacuucaaauaagaacauauuuagcaacccaauaaacauaugaaaaggcgagcugggaaccguggcucacgccuguaauuccagcacuuugagaagcugaagcgagaggauugcuggagcccaggaguucgagaccagccugggcaacauggucagaccuugucuccacaaaaaauuuaaaaauuagcugagcauggugcugcacaccuguggucccagcaacuaaggaggcugaggcaggaggaucacuugagcccaggagguaaaggcugcagugagcugcaccccagucugggugacacagcaagaccuugucucaaauaaauaaauaaaaaucugccaaauggccaaaucugcauucauauucauacuuuguuauuucaaguaaaaacggugcucgaugaaaaaaguaguuccacuuacaaacucaagacaaucacacaacuccuuuuucuucagacaaccauaguacuuaaguauguaaaagcacuuuaugugacauugcuauuuuaucacacagaauauuaaaaugacauuugcucaagagccaagauuuaauaaaauuaauaauuguuacuguuucaccaagaauauucugagggaaaacuguuauucuuuuuauacugcaauggauggcaguaaagaacauaaugacugagccagcacuuugggagaccaaggacagaggaucuauugaggccaggaguucaacaccagccugggcaacauaguaagacccugucucuuaaaaaaaaaaaaaaaagaggccgggcauaguggcucacaugccaacauggugaaacccagucucuacuaaaaauacaaaaauuagccaggcauaguggcacgugccuguaaucucagcuacuugggaggcugaggcaggagaaucgcuugaacccaggagguggagauuacagugagccaagaucacaccacugcucuccagccuggaagaacgagagagaugcuagcuaaaaaaaaaaaaaaaaaaaauauauauauauauauauauauauauauauaaagcugauaagccccucggguuuaucaucccaagagcagacaccacuaguaggguacccaggccuaacuccaaaggacaggcaaaggucaucugccugcaggugguauggguaccuaugcagugucuggaagaccccuuguagcacagggcagaacugggaugggaacagauauggaguggaccaugucaucucugucuauacuuaggucccaggccccacaaauguuagguugguccuuccugguuagaucuuacauaauacuaagcucaaacaauaagggguauucacacgugugcaagcacacacacacacaugcacacaaacacaaaauauauacauuuuuucauuuacaugaaguucaaaaagaggcaaaacuauaguguuaagaaucuacacacuccauaaaggaaagcaaagaaagguuaucacaaaaguaagaauaaugguuaccaguagaaagauagaguuugugaucugaaugggacacgcgagggcuucugugauguucaacuguucuauuucuuuaucuggauggcaaauaugagcauucauuuauuaguacacauuaaauaguacauacaugucuuauccauuuuuuaaaauuaugcuuuauuucacuaaauauuuguuauaaucugaaaaugaagugccuauuaucaacuuuucauuuccuucaauccgcguucccuacucgcaguuugcgucucuccuccacuauuugaaaccuucaaauauuaucacuauuugaaacuuucagauauuaaaaauuacuuucagauauuaacagaaaccacauguaguuggagcucucaaaauaaaauggauucuagacucaauagguccgaugagugaaggagaaacauguucaaggauauuacuccuauuuaauuuugcauuuaaaaaaugaaacuauuauugaacuuaaaagucagguugacauucaaucaugugauguccuaagucugucagucuaagagaaacaguaauaucuaugaaaaagccugaaacauaaauggacuagauguuucaccacaauauuugggaagaaacucuuugaaauuaaaucccugccuaacuuuccauguggggguuaaaaaaaaaagacagaaaacaggccaggugcaguggcucaugccuguaaucucggcacugaggcaggcggaucacuugaggucaggaguuugagacuagccuggccaacaugaugaaacccugucucuacuaaaaauacaaaaauuagccgggcaugguggugggcaccuauaaucccagcuaccugggaggcugagggaggagaaucuguugaagccaggagguggaaguugcagugagcugagaucaggccacugcacuccagccugggcgacagagcaagaccuugucucagaaaaaaaagaaagaaagaaaacaauucuuugagagcaaggucaugguugguuugcuugccauccuauuccaggcaccuugcacagcccugggcacauaguagccacucaacauuuauuaaacagguaaacagggaaugaaaugaauaugauuagugagaaaauccagggacccugaaguucucuccagaaggcaaucacacuuccuagauuccuaugacacuauaauaaugauacaggaguuaagaaaucaccugcagauagugaggguacaagaguccucaguaagguuuuuguuuuaaugaaaagcagccccuuucuaaagaagagcagccuguaaaaucaagcugcagacauagauauccacagcugcgucaaucauguucaagauggcggcuccaucuucccuucucuuugucagccaccuguacaguaaggagcagacaagauagcuccaaucaacuaggaaaguccauuugcauaaaaggauuaggguggggcaaccagacuucccggugugcuauguaaacgucauaccugaucaaaccaaccuguuagcccuaaguaaaucagacacuuccuccucaaaccugacuauaaaauccagcucaucugcugcuggauggucuuuucccucgaagaucccucucucccuacagaaagaacuguuucuguuucucuucugccuauuaaaccuccacuccuaaacuccucgugugaguccuuguccuaaauuuuccuggcacaaaaugacgaaccccaagguauauaccccagacaacguagccacuucaauaauaucuggccugugaaaucuuagaacccaauuuggcacucagaggaaaacaauacauccaccauaucuccccauuuaucacugaugucuauuacagacuguauuuuccaugaaauggccgaacaauauuuccagucccccaugcucuuccagaacccugaccuuccucaucaagaaguggagugcuuuuuuccuccuuuugaacuuggacaggccuuuguaaccaucaugacugauaagaguaaggcagaaauaauacugugugauuuacaguuccuggcugguaacucccauagcccuuguuacagucuuuuguuauaaugcuggguguguuaggccucaggggcaggaagcagaaucucucugaccuucuccugcccuccuuucuaacugugagucuuaagauccucuccaaaggggcuggguggcucaugccuguagucccagcacuuucggaggcagaggcgggaggcuuacuugggcccaggaauucaauaccacccuaggcuacauagcaagaccccaucuuauauuuuaaaaauaaugaaauaaaauaaaagacccucuccggugaagguccugccucauaccccaggggaaggaauauugacgugaagcuuccauaaaaacccaaaagaaugaguucagugagcuuccggauagcagaacacaugaagguuccuaaaggguggcacaccccgggagggcauggaagcccugcacucuaucccccgauaccucacccuacacaucgcuucaucuauacacuuugcaguauccuuuauaauaaaccacuaaaccuaaguguuucccugaguuuugugagcugcuccaguaaauuaaucaaaccagaagagggggucaugggaacuccaacuugaugccucucagucagacauuccagaggacaggacuugugacuugugucugggccaggugagggugguuagggucuuggggaaugagcccuuaacccaugggaucugacacuauuuccagguggauaaugucagagguguuuggaccagagcgacuccauccugauuaggggcuggguaaaauaaggcugaaaccuacugggcugcauucucaggagguuaguauucuaggucacaggaugagauaggaggucggcacaacauacagguuacaaagaccccacugauaaaacaagaugugguaaagaagccagccaaaaccugccaaaucccauauggcaaugaaagggaugucuggccguccucgcugcucauuauaagcuaauuauaaugcauuagcaugcuaacagacacuccuaccagugucacgacaauuuacagaggccauggcaauggugggaaguuaaccuacaaggucuaaaaaggggaggaacccucaguuccaggaauugcccaucccuuuucuggaaaauuuaugaauaaucuaccccuucuuuagcaaaugaucaagaaauaaccauuaaaauagccaaccagcagcccucggagcuccucugucuacggaguagccauucuuuuuuuccuuuacuuucuuaauaaauuuuauuuuacuuuguggacucuccccaaauucuuucuugugcaacauccaagaaccucuuggggacuggauugggacaccuuucccguaauaacagugugagaauugaauuggaggacacccagcugggguucacugcuuggugguggggagaaaucccuacaccuuugaucauagaagucuccuauguugacuauuguugugguggugugagaguagaggaaaaacucgguuggagaauuuuucuugaaagaguaguuuugaggcuagggcguaaacagcaauagagcuuccaucugggcucagucaacugacacauacagauuuugggcccuaggucagcacauaagaaggcugccuacucugugacugccauccugaggagaccacauggagaacaaguaaugccggaagagccuucaacuccuugaguuuugcagcccagauggcaaugaaagugaccucuggucauccucacuguucauuauacacaaauuaugaagcauuagcaugcuaagagacacucccuccagcaccauaugaguuaggaagccugugagcugacucuaaccccagccacugacagcaaccgugugacggaccccaagcaaaaaccacuuagccauccuagucaaccccagaaacaugaaaaauaauuuuaaaaugacgcuuguaauuuuaagcuauuaauuuuguuacauagugguaaccaugcaauauacaauccaguuauuaauacaaaacauuuauuuuacuuauauuguaagcagaagacuaauaauaaaagauuuugguuuuuaacaaaggauaacaguaauuugagaguuuuuuuaaacuacccuaauuacaaaaaucuaaauuggcaaaaccaaucaaaguagcauuccaacucaucuaaauagauggccaaagagguuuuuguuuuuuuuuuuugagauggagucuugcucugucacccaguguggagugcagcggcgugaucucggcucacugcaaacuccgccuccuggguucacgucauuuuccugccucagccuccuaaguagcuuggacuacaggcgccugccaccacgcccggcuaauuuuuuuuuuuuuuucuauuuuuaguagagaugggguuucaccauguuagccaggauggucucgaucuccugaccucgugauccgcccgccuuggccucccaaagugcugguauuacaggcgugagccaccucgccuggccguuuuuuguuuuguuuuguuuuguuuuguuuuguuuuguuucaauagagucagggucucaucauguugcagcccaguaggucucagccuuauuuuacccagccccuauucaggauggagucacucugguuugaacgacucugacauuaucuacguggaaauagcaucagaucccauggguggagggcucauuucccaagaaccccaucuccccgaaacugcugaaauuacagaugugaaccaccccacccagccuucaaagaguuuucaaaaaccagugaccaccaaaaucuuuuuuaacuuccaaaaaugacauuaaaucauuucucauuuacuucccauaggccagcaauucccaaaauguggucccuggagcgacaaaauuaacaugaucuggacacuuguuagaaaugagaaacucuggagauguagccagcugauucugaugcacauuaaguuugagaaccagugaccugggcuugggcauauuauuccuuucaaauuuaaaagcacauagccaggagcaguggcucauggcugucaucccagcacuugaagaagccaaggcaagaggauugcuugagcccaggaguuugagaccagccugggcaacauggcaaaacccagucucaacaaaauauguaaaaauuagccagacauggugacaugugucuguggucccagcuacucaggaggcugagguacgagguuugcuugagcccaggaguuugaggcugcagugagccacgaucgugccacugcacuccagccugggugacagagcaagaaucugucugaaaaauaaauaaauaaaagcacuucauuucaccuguucuuuauuauaccuuaugacauggugagggcuuguggcaaauaaugaaagaacucauucaaauugacauaacaggaagagcugggaacagaaacuuagauuccuaaauucaacauuuuguggauacauauggacagugaauaucuuuccaaaauuauaugaauuuauaauuuugaaggaguuaauugcaaaagcauccuaguaauuuugguguauacauguaggggcuauauaacagaaagaagcuucucauuggaaccuuagcuccacccuuacugcuguguaauauuagucaagaaacaacucuucugagccuccuuuuauaauggaugagaccacugcuucaagaguuaauuauuauugcuaacaacugggcucucgcuaugcaccagauaugacucuauaugcuuagauaaauuacuuuauuuuauacuuaugagaucacuguaagauagauauuauaacuaccccaauuuuauagauaaagaaauuaaagcacaaaugauuaaauuccucaagucauaaagguuccuauggagcaaaugagaccgaauuugagcccaggaugucugacuucaaagccugaaugcuuaaucacaugccuucucacuuaagguaauuaaaugagaugauucauauauggaacauaauacagaacguauugcaggaauucaguaaacaaaaguuguuauuuuaucauuaaucuauuaauauuuuacuauuaccauauuuuagcacuuaauaggaagacuauuauuauuuccagcaccccuauuauucugggaaagauguccaaaucauucaaaaguaaaauacaaugagaaucaagacaaugggaaguauacugugcaucugguuaauugugcacccugaaaaggaccagagaaagaauucuuuaaacauuuuaugcuuaaaauuauuucaacucauggcugaaggaggacauuuaauuacaugucccuuaacaugcauaacuagacauuauuacuggucauaaaaauguggaguuagcauuaaaaucaaaucauaauauuguucucaaugacccuuucucaauuauuagaagaucuaagaagaaaggugacuuauuaaauuaucaacagugcuggcuuuuuaauugccaauuuucccaccagcuguccuuucuauuugcuuuaaauaauuuuuuuauugacgucacagaaaaugcaagauuaucugaaaaauuagcugcuaagauuuaucuucaauccaacugucuauaggaaaacuuuuaaagacauuuucggcuuccucugguaaauaugauaaagcccauacugcccaagagcuauuuuagcaggagaagcuacuuaguacccacagugaagugcaagcaugucacucucuuuaauucccauguacuuacuuccacugcauagugcaaagcugaugagccagggugcaaugacagguucugaagaggcuugauaugagguuucucccauccaaacucugaggaccacuccaccgucagcauaugauccgugaacacaguuccaaaaaccagauuauuggggucugguuuuuccuuuaaaaugguagcuggugugacuauuaggucuuuagccuggggaagaaaaaucaucacuauuuacagaaaagcuacugagcauucgcuggcuagauuauacagaggggaaaaaaaaaaaggaaaucaauugacuuuuaaagguuagcagcuaacacagaaauuuaacacucugagcugaacaaaucaugccugcauucagaauucggccaguuauucauaaucucugcaauguacacugccuaauagaauaucagaaccaaauuucagugauauauagaagagggacaaaauagcagaugggguaagaugaugcaaaaaaagaauacaacccuuuuucacucucaccauaggacucauguugaguauuugggaaagaugaaagagauguuuucccuaauaaaaaauggcaacacucacaaugauuuguuaaacuaaaaugaaugucauuaaguacugaacugcuauuuagcaaugguuacacuccaacugccccaaagaauuguuggcauaagccuucaaaauccucugggugcacuggagaagaaaugagcaaagugaagcaaauguuuuccucuuugaaaacaggaaaguugagaaugaacacuaagauauaaauccucuguucuguguggaggaaacagugaacaaaggaacucuuauuuaaacaaagauaaaucagaguaauaggaaacaacuccccacaagcagcaucucaccagcucccgacauagccaguuugcccacugcaaauggccaaacauuaagcguacaaauugcaugcgauaccaccacuaacuuuauagcaucuguggaaugcugacaaaaacacaggagaccagcacuuugggaagccgaggcaugcagaucacaagguuuggagauugagaccauccuagcuaacauggugaaaccccgucucuacuaaaaauacuaaaaauuagccaggcgugguggcaugcaccuguagucgcagcuacucaggaggcugaggcaggaaaaucacuugaacccgggaggcggagguugcagagagucaagaucgcaccacugcacuccagccugggagacagagcaagacucugucucagaaaaaaaaaaaagaaaagaaaagaagagaaaagagaagaaaaaaagaaacacaagagaaggaacuuuuugaucaguuaaaaaaacaggggcaaguucaaccuguaacagguugugaagggaugucaaacuccaucucuuugaauauacaaaaaaagucuuuucccucccaaauuaaauacagaccuucacuuuacaucaucagcucuuaucauuauuuuuaaaaugaucuaauucuguuuaauucacugccuugcagcuacgugagucauuugauauauuaugaaugauaguaaauuguauuuuuagaauaauauucaggcugaaaacauauuccaaaacaaacagaaagcucauauuacagugacacaaaaggcauuaaggacagaauauuacuguaauguucaggcuagucuaguaaugcuacuuuguaauaugccaauaaaaugccaaguuucaauaaaaaauugacuuuguucuaccauuauuauuauuauuuuguauuuuuuuuagagauagggacucacuauguugcccaggcuggucucgaacuccugggcuuaagcaaucugccugccucgaccucccaaaguucuaagauuacaggcaugagccacugugcccagccuguuuuaccacuauuuaauucaaguaaaaacguuaauuuaagacuuuuuacuaaguauaauaaguuuauuuaaagaaauauauuccagcuaaauuauuuuuaucuuugaaucccuuuucucucccguuguccucuggacuagguagggggucaggcagacuuuacuugcagaccaaaugcagccagcuggccuguuuugaaauuaaaauguuauuggaacauagucacgccauucuuguaucuucaguggcagcacagccaacuaguuguaacagaaaccugauggcccucaagccuaaaauauuuaucaucuagccauuuaagaaaguuuagcaggccgggcacaguggcacacccugaaucccaacacuuugggaggccgaggcggguggaucaccaaaggucaggaguuugagaucaaccuggcaaacagcacaacccugucucuacuaaaaauacaaaaauuaacugaguguaguggugggcgccuguaaucccagcuacuugggaggcugaggcaggagaacugcuugaaccugggaggcagagguugcagucagcagagacacaccagugcacuccagccugggcaauaagaguggaacuccaucucaaaaaaaaagaaagaaaguuuagcaaccccuauucuggacuauuuagacaagaagucuggcuagaguauucacaguugaauuccaaagcuaacacagugccuagcacacagaauaguaaaggguuucuuaaauacugaagaugucuggcugcuuucagauacacucacagaagauguccaggauuuaaagagagugaaauucuaacacaaacuuuuuauuacaugaauaguuucacaguauucuugcacaauaaacaccugugauuuaccuuaguuagcuuuuaucagugaauggggaggacccugggcuaagaaacauuuggagccauaucaauacaguacgacaaacuuaaugcaaauuuucuucuacuaagacuacuuaguaaaaggggaaggguaguaaaacacaaaacaaaaacagaaagaugagagugggugacaagaaugauuaugauccaguauauauaauuuuuaguuuucugagaccucuccuuaaaauacccauaggacccacaauaacccacuaauccagagagaucaaauuagcggcaaagcagggauagaauaagguaauuuuuaaccucaaauaaguguucuuauaauuagaacuucauaauaucaguuaaauuucugacaauuaaagauaaauuauuacauuucuagguaugacuucuauuucaguaaacugcuacauucuuucguaagacacauuauuucuuaaugauaugaauagcaaccucuaacuuucugauuuguaccuaagcacugcccuguauccaguuuuguuuuguuuugcuuuuucuuuuagauggagucucacucugucacccaggcggaagagcagugaugugaucugggcucacugcaaccuccgccucccagguucaagugauucuccugcuucagccuccugaguagcugggacuacaggcaugugccacaacacccggcuaaguuuuguauuuuugguagagaugggguuucaccauguugaccaggcuggucucgaacuccugaccucaggugacccacccaccucggccucugaaagugcugggauuacaggugugagcuaccgcgcccggcauauauccaguuuuucaaaguaauauacgauuagguggcuucagaaucucaucaugaacuuuucucuacuugaaaaaaaaauucugcaacucugaaaacuaaaaauaacaacuuuuaaccugagcucaaagagaaauuaccuaagaauacuaaauuacuaggugauagaauugaauaaaguucaaacguaaacaagcaauauuagcugaagacaugugacucguuuggggcagauaugaaauguaguuuuaagggaacgauuuguuuccuaaaggaaacaaauuuuauaaacaauuuuuaucaguguucuuuaaaaaguauuuucuuuuucuagauuuccuuuccaaagauaaauaaaaauaauauuuugucaaaugauacuuucuucugcauaauuaaucugucucuuuccaaugcuccacauucccugaugacaucgaagucaggauguuucacaucauauguuuguggaagaauuggaaugccacaauaacugauugugaaauggcaagaaauauugagaaaaacagggcauauuaaaaacaacuuccuaauucaaaguuugcaguuggguaaucauuuguucugaaauagggaggcucagggcagggaaguguaaauuuguugaaagcaccugaaaacuguuucagccaggguucagucaacacuuuuuuuuuuuuuuuuuuuuuuuuuugcucuguugcccaggcuggagugcaguggcacaaucucggcucgcugcaaccuccgccuccccgguucaagcaagucucaagccucagccucccagguagcugggauuacaggcaugugucaucgcaccuggcuaauuuuuguauuuuuaauacaaacaggguuucaccauguuggccaggcuagucucaaacuccugaccucaaaugauccacccaccucagccucccaaagugcugggauuacaggggugagucaccaugccaggccugucaacaccuuuugcucaccaucguauagcacauuugcucuucucuucauuggccacauuuuucaaaaaucaagucuguauuacaacuguaucagacauuuaauaacuuuauucuagguucuugugcauuauucuuacuccauuuggaaagccuuaggcacuauguucaucuuuuggagauacucuuuuaaaaucuaauaaagaggaucaugaagagaacugcagauuugcaguguugcauucuguggagauaugugaagcuggaggaauuggaagaaauagauggcugaccucuugcaaaugaagaggauccuagaguccacagaaagauucgccaggauguguaacaacguaucucauugcuaggcccugcugcaaaacugcauccucauguaauaugacugcaucauaaauggggaggggagaagaaauacgaaaacuacccaagagagacccaaaaggccauaugaaauguuauaaaugauguagauuaacaaaaagguagagaaauaugucaaaagcaaccacaguuagaaugguuauuauuagaaagacaaaaaauaacagaugcugaugaggauacagagaaaagagaacgcuuauacacuguugguaagaauguaaauuaguuuaucuacuguggaaaaugguaugaagcuuuccaaaaaaaaaacuaaaaguagaaugaccauauaaaccaacaauccuacuacuggguauuuuccaaaggaaaggaaaucaguauaucaaagggauaucugcagucccauguuuauuacagcacuauucacaauagucaagacauggaaucaccuaaguguccaucaaugaacaaauaaaauguggugcauauacacaauggaauacuacucagccauuaaaaaagaguaaaaucgugucauuuguagcaacauggauggaacuggaagucauuaugguaagcgaaauaagccaaacacagaaaaaaaaaaaaacccagaaaaacaaauauugcauguucucacucauacgugagagcuaaaaaaaaaaguugaucucauggaggaagagaguacucauagaaugauagauaucagaagauggcagggggugggaaggguguagguggaggaagagagguugguuaaugaguacaaacauacaguuagauagaagcgauaaagucuacuguucauagcagaguagggugauuauaguuaacaacaauguaggcuauauauauauauuuuguuuguuuguuuguuuuuguuuuuguuuuuugagacagagaaaaguauaucaaaaacaaagauggucuauaaaaucuaccauuuuuauucccuaaauuaucaauaucauuuuuacacaugccuuauuacauaugugcugugaauacauccaccauaacucauguuuugauguguaaauacaugaguguaaacaggcaauuccccuaaauaaaaccuaauauacagaaaucuaaauuaacaaauaaaaaagauuauuuauggccaggcauuguggcuuaugccugugacccagcauuuugggaggccgaggugggaggguugcacaagcccaggaguuggagaucagucugggcaacacagggagaucccaucucuacaaaaaaugacgaaauuaguugggccugauggcaugcaagccgauagucucagguacuugagaggcuaagaggaucacuugagucugagagaucaaggcugaaagugauaccuaauugauggugccacugcacuucagucugggcaacagaacaagacucugucucaaaaaaaagaaaaagaaaggaaaagauuauuuaaauuugaguugauauuuuucuuugcaaagaauucuucaggcuaggcuugguggcucacgccugcaaucccagcacuuugggagguggauugcaugaggccaggaguucgagaccagccuggcuaacauggugauaaccccaucucuacuaaaaauacaaaauuagcugggcgugauggcacaugccuguaaucucagcuacucaggaggcugaggcaggagaaucacuugaaccugggaggcagagauugcagugagcugagaucgugccacugcacuccagccugggugacagagcgagacccugucucaaaaaacagaaaagaaauugcaauauucuaauuuugcuuuuuaaaaaauccuugcuaagaugacagcaagagaaggaaaaagaaaaauaaaauaaaaauuccuugcaaguagagaccuaaucuugaauucaccuuuggauguccaaugcauggcacagucuccagcacacugugagagagcucaaugugugagaaacugaugagucaaguuuccuucccucucugaaccgccaggaugugagaucauuaggacacucugugucaauugucugaugacaauugacagugacucaaacaggcagaagagcagcacuaggcauaaaaagaagaagcuaaaaccuccacgaggagggaggguaggagauagacuuauagaaaaaauaauauuacaucuuacauuuguauuuguacaguuuucaacgugcuuuguuucucacuguuugaaguaugagcuauuuacuauauaaaccccgcaauucagauagaaaagaagaaaaugcaacacuuucacuguagaguguuaugugcuacugaaagagaaaaaucacaguuuaacuuuuucuacaaguagacugaagguuuguacguauuauggaaucugauaaacaacuaguuuaauauuuacgcauugacuauuuuucaagaaaaauauaugacucaaaauaaaaucagcaauuagcugcuagauaauuuuuguugugaugaauguacugucacucucuaaauggcuuuuuuuccucuaagaguggaauuuuaaaagucuggcaacacaaccuaggaacuggguaacccacacagugaaaauuuccccgaaucucaacaagaaauggauuuauucaguugaacguugcuuuagacacuaagccucuggcaagcaacuuaccuuaaaaguccccaccaccucuuuugauccuccuucuccgguacacucugcggagcauccguuacugcaauccuuaaagaagaauuaaaccaccauuaaguaaaugcagguggguaagcgggacccgggguaaccuacgugacgcucaccaugauaccgugcgcuccucuccaggacccaggcaaacacaaaaaaggaggcucagacaaccaagcacccaggcccgaaccuccaacaagcgugucuugggagcgcugcccugcacuucccacccugccggggucgcggcgguuuuuguccuccuccgccggcucagggaagacugguuaaauuccaggucagcccuacagagccaggguucgccggcaaagaacaaaaaaacaauugucucccuuauauccgagcaaauagucuagacugggguguuaagccauuuauagaaaaaucuccagggcgcgcucagccucguggucuugucaaucacagacgcacaauagcaagccugcaaagggaacggggacgggcgugaaccauuuccuccaccagcaggguccuccgaugccgcagcauccaccccacaccuuaaaccucaugguauuagugggcaauuuaaaagauaaagacacagggaagcgggacuaauugggaaaaccugcagacauuuguuuuaaugcguaaucugcuaaauaacuacggggguggggguggggaaggaagagauccaaggaggcagaaggcugcggucaaaauauuuugggguggcagagucacguaggauguggcuguggguucuggcagcccagagauucagcucccgccuccucccucagagcgaguccauagcuacccucacgucccccguggcgguccucgccacgcuccggagcggguuacccaugagggugcuagaccugggcagcgggaaccucgaagagguggagauugcaggcugggacuccagauuucgggcagggaugcggggaagggaagacgccucgcuggaggcggaauggagggcaaggcgaaggaggauggugcaggaaacggcgacaaggcgcccggccaggcccgcgagcuaccgagacccggguuccaauccuccccccuuccgcaaacgcccggguucgagguaccuggcgggcaagggccgcagcggagcgaagcgggcuggccauggggaggcugcggggacgcggggcugcagagagcggcaguggcacggagcgcgcggcuggaagcgaaagcaggcgguguggccaagccccggcgcacggcccauagggcgcuggguaccacgaccuggggccgcgcgccagggccaggcgcaggguacgacgcaaccccuccagcaucccuuggggaggagccuccaaccgucucgucccagucugucugcagucgcuaaaaccgaagcgguugucccugucaccggggucgcuugcggaggcccgagaaugcgcgccacgaacgagcgccuuuccaagcgcagauauuucgcgagcauccuuguuuauuaaacaaccucuaggugaauggccgggaagcgccccucggucaaggcuaaggaaaccucggagaaacuacauuagggcagcuuuuccaccgacuccaaauccaacugacaaaaagcaguuucugcccucgagaguuugcgggcggggauugacauuugugcgucugcucuugucugccacugaccgcuaugugcaaacugaagggggagaacgugaauccagcuuuuagauuucccugcgccaccuacccaaaccgaauuuguaacucgggguguuauggggcuaccaggcucgcauucccuaagggccauuucugcccaaagaucucaaugccuuucaucguuuucaggcaaagcagaccaucaagagcuccaaucauacuguuuucauaguuuuccgauguaggcucgugaucgcaauauuuagaaagaggacuggaaaagugauguuagaaguacuauucgguuuagaaagggaaaggaggauuggaauagcuauugucuuauaugcaguguucgccuggggcaacgucagccuaaauuaugagccuuccugguuuuuaaauuaauaggaagugguaacuggggcugacuugaucuuggaaagagggggagggcaguuuauucugggugaaagcgguuaaauccgguuugguuuuuuaaaugguuucauacaacgcuacugauaauauacuguagcucuaaucuuaucaacucagaaaaccuacacuuuuccucuccuuuauacaaggcacagaaaggccucuuacgcugggguggggucccaagcuccaaagaccacagaguccaggcaggucacguaccaccauagagcggcgagugucccuggaaguccagggucgcuuauaagauaaguuuuguccuuguuguuuugagacggagucucgcucugucgcccaggcuggagugcaguggcgcgaucucgucuaauugcaacauccgccuccccgguucaagcaauucucccaucucagccuccccaguagccgggacuacaggccugcgccaccacgccgggcuaauuuuuguauuuuuuguagagaccggguuuugcuauguugcccaggcugcucucaaacuccuggacucaagccacccaccuaucucagccucccaaagugcuaggauuacaggcgugagccacggcgcccggccuccaucuguauuaacugcuucuauuuccuccccauuaagggcuucuguccaauuauuccaccuaaauaaggucucuaauagccuucauuuuguuccugccaaugguuuugcuucucgugcauuuucauggcugcaccuaugugcugaugacucccaaauauauuuuuucaguccaucugucuccugagcaguagguacuugcuacucaaaaaucugucuaaaauaaaaacgguguaucuauccaccauguucgaagcacugggcuaguugcugggggaggguugagagcauaccaucauccuguuaucaugcauugcccccagccagagagaaaaguguuaauuguguuagaaaguguuaaggaaucccacagacagauguaaaauuauaacaagugcugccugugcucuaagagccucuaauaauggauuguauugacucagaaaggccuggaaaggcuuucagcaagugauccuugagcagaaaucugaaagauuaaagaaauuuacuaaaggaagaagggaugaagagcaccugguaugaaagugaguuccaggacaaaagaacuucucugaggagggcuggaacaaagggccaaaagagagccuggggcugcgguagacagaagaggauggagcuugggcuagugaguagccaaagggccagccaaguagugccuuagggagagcuaaagaauaauuuuaaaaagcaaaaauaagguaaaagccugacugucauacagguauaaaauaaacuaaauuauagaguuuauuuaaaucauuuaaugaaguuaccaggcagauauaaaaacugguucaaagaacaggcauguuuauaggucagaaauauugaaaugaauaugcaaaugaaauuggcuucuuccacaguaggggagagaaguuaauugaacccugaccuucagauuuuacuugcaugacugcaugcaauaauuauuuugcauuucuaucagucaucuguaaaauaacucaaaaacaaugaaacaauguaagacccaaugaaagggcccauggaaucagaaucagauaaccuuaaagguuugcucuaaauaauucaguuuuccauugaaguacaaauuuuucccuacaguacgguaauauaauuucuucauucaagaagugcuauuagucagcaacagcugaaguaaaccagacauaguagucacuguacuuacuaguuacacuaagaagcuguagcuuuagcaguuuucaauuuagcuuaaccuaggggcaagagaaaccauugaaagguuaaggauuagguggaguaugcaggagcggugacagaauugaagguauuggcugcaguuuggagauuggaagagggucuggguggagaggaauggauuuugaagaagcuauuacagaacccacauacgagaugauccuuuuaauaagucagauuuggcuggugguugguaauagaaguggagagaaacagccagauuucagcaagaauggagauaagguggcagccugggcaacauggcaaaacccugucucugguaaaaauacaaaaauuagccgggcucgguggcaugugccuguagucccagcuacucacgggauuaaggugagaggauuaccugaacuuggugagguugaggcugcagugggccaggaucacaccacugcacuugccugggugacacagugagacaccaucucaaaaaaaaagaaaaagaaaaauagaugauauaaggugggacaaggaugagagaagugccaaggaggccuccuuggaucugacuugcuuaucuauuuggugauguucacuaagaaaaaaggaauguugaaaaagaauguguuugaggggaugaggaggagucugguuugggaccuaugauuucugaagugucuccaagacuggcugugagagaucugccugucugaagcucagagaagaggucuggauuagagguauuauugaaucauuggcauagaggugguaacugaagcuaugggugcgaaagagaaucucuaugucaguuuucuccgcuguaaaaugagacaauagcaacacuucauguuugucaacugggauagaugagcauuaauauaugaaacuuauguauauuacuuagaaccaugccugaugucagccaugcagaauaggugaaagaacgggcauggcucuguuuccauuaaacuguauuugaaaaacgggacagagcaaauguggucuguggacuguaaguugcuuacuccugcucuauguaguugcucuaguagaaacauagcaguugucccucaaaugcauccaagugaugaucaccaaugucuauccauucuugcuccaaauacccugacaguugccauuucuccaaccauguuauccgcauccuaguaccaaacagcuuccaagcagcuccucugaccccagccuugcuucucuuuaagccauucuuagcaugacaaccagugaaaaugucucaaacgcaaaucugaagacaucuccucuuggucaaaaaaccuucaaggcuucacaucacccauuugacaaaaugauuggcaagcucccagcccaucccagauucugccuucugccucugacucuccagcucaccuuuugcuaggcucuuucuuucucucuccccccacacauuuaauuuauuucaguccuuucggacaucaggccuucucacaggugcccaaauaccuguaacauucccugccuuugccaggcacugucauccuuccuuguucagucccugugccauguccuuggcaggaacgucucugaacccugucuaggcuacaguggguuccucugcuguuuauuuacauacaaugcuugccauuucaaaauaaugguaauauuuuauucuaaucauuugauuaaugcucuucuaauuuuaugaugggaaguucaugucugucaggccucugagcccaagcuaauccaucauauccccugugaccugcacguauacauccagauggccugaagcaacugaagaucaacaaaagugaaaauagcagguuccugccuuaacugaugacauuccacuguugugauuuguuccugccccacccuaaccgaucaauugacuuugugacaauacacccucccugcccuugcgauaauguacuuugugauauuuccccacccuugugaaugcacuuuguaugauacacccuccccacccuugagaagguacuuuguaauauccuucccugcccuuaagguacuuuguaauauucuccucgcccuugagaauguacuuuguaagauccauccccugcccacaaaaaauuguuccuacuccaccgccuaucccaaaccucuaagaacuaauuauaaucccaccacccuuugcugacucucuuuucagacucggcccgccuguacccaggugauuaaaaagcuuuauugcucacacaaagccuguuugguggucucuucacacgaacacacaugacaaugccuauauuauucaccuagccaucccaccucacccagugccggacaugcuguggagaguuaaaaaucuguugaacugcagcucucuaauauuuuagaaagcauguacuuaauauacuuuggaauuuuaacugccaaaguuuagaauauaauagacuaacauguucucaggguccacuccacuccuagauaugagcuucuuuucuucauagaacugcucucccucacccuaaaucuuucuucuuccuuuuuuccuauuuucugccuuccucuacucguugucuucccuuguacagucauaauaaggacuuuauaugcauugugacuguucaaagagauuggaucaaugcuuuccaguagaacuuucugugcugauggaaacguucuauaucugccagguagccacuaagccacauguagcuacugagcacuucaagugugguuagugugauugagaaaccgaauuuuuaaucuuguuucauuuuaauuuauauuuaaauguaaauagcugggccgggcaugguggcucacaccuguaauccccccacuuuaggagggugaggcaagugggcaggucacuugagcucaggaguucaagaccagccugggcaacauggugaaacucaccucuaccaagaacacaacaaauuaguugggcguggugccauacaccuguggucccagcuacuugggaggcugagaugagaggaucacuugagcccaggagguggagguugcagugagccaagaucacaccacuccacuccagccuaggugacagagcaagacccugucuuaaaaaaaauaauaaacauuaaaaauuuuuucaaauguaaauagcuaacuacauggggcuacagucugagcaccgguuugggcauugaagucccuugguugagauucguuauccugguucuaucacuuauaagcccuaugacuuuuggcaaauuacuaaccucuuuugagucucauauuuaaacucagaguaaguaaugggcagugacgacacucaacaugaagauaucuauaaaggacuuagcaguacuuagcacuuaguaacugcucaguacauguuagcuaguguuauauaccauguuuuaauuuuuuuaagacccauuuauuuuucaguuauauguagcccuuggauuacgguauacugaugauuaggauauuaugugagagaaaccuuaaaaauauacaucuaguguuucuagguuuuuguuuguuuaauaaaguuucuuuaaaaaaaauaaggcccaguuugguucagaaaacaaacugcacagcuauuauuuacaugcuuccugguugguauugggaagacaaugacagaugaguauaauuccuaccugccaaacccuccccuuacuccugccaugucacgucucuggaaaagugagccauaaaaaaaucuugacaaaagaauucucauuugggcuuauucaaugccaagucccauucaacgaaguaaaaugagcaauucuauguacuguguauguaguuacuguaucauuugccuaggacgguaguaacaaagugccacaaacuggguagcuuaaacccacagaaagugauugucucauaguuccagaggugagguguggacaggcccagcuuccuuuggaaccuguaggggagaauccuaccuuucuucuucuagcuucugguaacccagguguuucuuggcuugcagcugccaacacuucaaucucuccuucuguugcauuguguuuucccuuccugucugucugcuuccuguaacugcuuugauuaauggacuauggagaaauauggaagugacacuguucuaagacuaagcauauacacuaacuggccaggcaguuucugcuuucuuccucuuggaaggaucuuggaacuaccccaccuagaacccagucaccccagcuauaaauagcccaaaucacauggaggagccacgugcaggcucauuagucaacagugcaacauccagcaucacugucagcccugugaguggcugucuuaaacauccagcccagucaagccuucagaugaugccggccccucaugacugauuaaaaacacaugagagaccauaaggcugacucagacugcucagccgggcccaggcaaucuagagaccaugagagauaaaaauaaauuauuguuggccaugcacaguggcucacaccuguaaucccagcacuuugggaggccaaagcaggcauaucaccugagaucaggaguucgagaccaaccuggccaacauggugaaaccccgucucuacuaaaaauaaaggaaaaauuagcugggcuugauggcgggugccuguaaucccagcucuacgggaggcugaggcaggaggaucacuugaacccaggagguggagguugcagugagccgagaucaugccgcugcacuccagccugggugacauagcgagacucugucucaaaaauaaauaaauaaauaaauaaauaaauaaauaaauaaauaaauaaauuauuguuuuaaggccacaaaguuuggggugguugguuauauagcaauguuaaccaaagcagcaugcaaaccuaacaugcuuauuucauuauuuauuuaaaaaccuaauaauaauaaaucaugcccaaaaauagggauaaaagggugagauaaacaugaaauaaguaauccuuuaaaauaucuuucuaacuaugguuauuuuauuguaccagcccuagcuaaaggcccaguauacacaagggccaaguaaucaguaaugacagugauacaaauccuucuuuuaaagucuucuugaugaucaaaauugugucacccacuauuugucaguuccgaugaaaucauuguuguuuuuuuaaucucaugauaugguuaauggagaacuuauaauaagaacuggggccaggcacaguggcacacgccuguaaucccagcacuuugggaggccaaggcggccgaucaccugaggucaggaguuugagaccagccuggccaacaugguaaaacccugucuuuacuaaaaauacaaaaauuagcugggcaugguggcgagugccuguaaacccagcuacucaggaggcugagacaugagaauugugugaaccugggagguggagguugcagugagccaagaucgcacuacugacuccagccuggugacagagugagacugucuuaaaaaaaaaaaaaaauugaaaaaauauuaguuaucaugaaaaacaugacacauuuccuuguuuuacauuacuaauauuuucauuauuauucuggcuuuauccuuuuaaauuuuuauuuauguuuguuuagaguuuuuuuugcagacaucucuuaaagccaaugucccuuuugcaaagauuaucaguuaacaccagaugacauaaucuguaacucuccuuaaccaggcucacacagaccgccacaaaucacaacccucuggaagagaaugaaugcgcagggcuacacaggcaacccccugggagcaggagcuaugcccuccucuccccucaggacccugcucgaaguuugugacagcguggcagggugacacacagaaugagcacgugccaaucuaugugaguuaaauacaaauacaguuuaaucuuucccacauguuagaggaaaaauaaacauaaguucuucugacauuccaguggagucuguugcauaucucaauauauacacaccacgaugaaacucacucugcgagcagacaaagugcaaauuccugagcuuagucugugggcuccugcacuugcugaaucaccugacucccucuucccuccccaccccucguccucauuugcacuucccaucuucuucugcacagggaggaaacccuaagcguggcaagccucuaggucaucuccagguaccuuaaaaaggagugacagauggacagagagacaaacacaugaagauucuggauaaaaagauuaggaauuucauuuccuguguggaaaacaauuaagcuuauaauuuugcguuuuacagaaacagaaucacuuaacuucugaaaggagaaauuaauccuaauuaaaugaggcugcuuuuuuaaaauccagauauuauauacuggauugcuuuggagaaaauuuuguuuuauaccaguaccuaaauagcuuuuaagaguucagguuaaccuaugcugaggaaauuaauagcaaaaagaaaaggccacaaucaagacggaaaggauuuaaguuuuauuaaugauuauuaagugcauuauuuauaguagaauccacaacauaugcucacgaaaauaaaccaguucuaguaaauacaugauaaauauaaaaaauuagaagagggcugggcgcaguggcucacaccuguaaucccagcacuuugggaggccgaggcgggcggaucacgaggucaggagauugagaccauccugucuaacacggugaaaccccgucucuaccaaaaaagaaauacaaaaaaauuagccgggcguaguggugggcaccuguagucccagcuacucgggaggcugaggcaggagaauggcgugaaccagggaggcagagcuugcagugagccaagauugcgccacugcacuccagccugggugacagagugagacuccaucucagagaagagaaaugguugaugccugacaaugagcaauauacauacacccaaaggagaaaauggggccgggcgugauggcuuaugucuguaaucacagcacuuugggaagcugaggugagaggauugcuugaguccagaagcuugagacuagccuggacaacacagugagaccccaucucuaaaaaaaaaaaaaaaaaauggagaacguggguauuugggaagacaguaaucuuuuggaaaaaguguuuuuccuaugaaugugauauauguucaagaaaauagacugacuuaucugauauauaccuuguggcagcaaagggaauacuuccccaucacuuucuucagaagguugcucaaaaucauugacaaggggcagauuaauaggagaaaagucauacaaauuuauuugaucauaauuuuaugugacacgagagccuacagaacgaagacccaaagauauaagggaaacuguccauuuuuauggugaaacccugucuuuacaaaaauacaaaaauuuuaauggacaguuuuuguuuuguuuuguuuguuuuuuuaagagcaaggagaguaugcuuuuuaaaugccauugguucaugugccacagaaccuaaaacagcuucaaauggacaccaaguaaaaaauaccaguuuucagaagucugucauuauguauuuacacaaauuacauaauccuguauguauuuacaauuacagauuaucaaguagauaacacaaaguuguaguguuaaugagacaaaauagaauaaaaacaccacaaggaagccauuugcuuaucuaccaagcaggaccuagcaaggccgauccuggcaugugcuucaacauugcuuggggacauuuaugugacagaugggaagauuuguucagucugugcuagguaagucuuugaccacagugcaaacguuggcaccaaguagaugguaguuuggcugucugaguaucuauuugugaaacuggaaccccccuuccacgauggcucaggguugccauccaacaggcuuugggccuuuuacaacaagaacuggaugcaaacccaugagcuggggaugacucacucuauuccccaacagacaaugcccaggccaaaacccugagcccccuuagguuagguuaaacaaaguauggagagccacguagaaauaugauuggacaaaaaagguauggucuaaugcuaauagacugagcagggaaauccagcacagccugucugucuggacccuucuugccucucugagcaugcauuucuuccuucuggguguggugcuggacccucucuggaaugggggucuuauaaccuucagucaaacaaagugagucagauaauuucuuuauggccuuacacagacaggcugggggugguggaaguuagaguacuauuuuuagguuuuaugguuggcuuuggggaaaagggguuuuguuucuauggcccacuuuggggaagagggguuguagucuugauggcuagccucaagggagaaugaaaggucagagacaggagagcaggagcccaacauuccccaguugagaaauuggguugguagauuaucuuuuuuuuuuuuuuuugagauggggucucacuguauugcccaggcuagagugcagugucauaaucucagcucacugcaagcucugccucccaggcucaggcaauccucccacauccaccucccgaggagcugggaccacaggcacaugcuacuaugcccggcuaauuuuuuauauuuuugguagagacaggguuucaccauguugcucuggcuggucucgaacuccugagcucaagcaauuugcccaccucagccucccaaagugcugagauuacaggugugaacuacugugcccagcggguggauuauuuuauaagccauugaacuagucuugcagucgugagaacaggccgcuccaauuaaacgguuaacaguuauaucucauuucaggcagugguguugcuuccaccaaagucaggccucuaugaaucaagcaaucagauguuuaauaaaaggcauuuccaugaaaacaaaagaaaaacaaagauuaacaucuggaguugucuauaaacuaauuuuccuagagucucugaaguagcuucagauugcaguggcaaucuuacagauauuucuggauuauaguuugaaucagguguucaaguaaaccuucugaguaauccauacaucagcugacaugaacacugcucauauauuaaguugcugucauuauuucuuccaaaguuuauaucaaguugucuagcuaaagccugcagggcuuggugauuccaagacagaaaaaugguagaaaaauuaggaaacauuaguuuggagacuuguacccaggaaggaauucaggauucagcccaaauuguaggcaaauaacaaaaacucaaaaaaacaauuaucaagacuagaaucuaauaacaaguaugguauaauuuucuucugaaauauaauuuucucuucuacagucaucccaacuuuuacccacaaagauaauaauaauaaaacuaauuuauuugcaaagucaguuuagucucuggcaugauuaucugcuuaaagugcaguaagaauggugauuuaucaugaaggcucuuuuuuuuuugcuuugauauuuuuuauuuauuauaaaaacugaguuuucaacaaaggcaguuuagcaggacuauaguugugaaaauaaaucugaauguagccauucuuuaaacuuaaacuaaaaaucauuguagaauaaaaugucaagcaagugaaaacuuuucugugauauauacagaaaugauauagacauaaauaucuucacauaaacaaaagcaaagaucaagaaaaaaauuaaauaucuuggugggcaagagaaauacacagauuaaaaagguuauuuuuauuuuacuucaaugcuucuauugagcacgccugucagagcaauaggaauuagauaaaucuuuacauuucuucagggaauuacauacaauaaagacaccucucuagaagaaaauauauuagcaucauuagacuccugaaagucaugacuuucaauuaaguuacacuuuuugcucuaccgugaagcuacaugcuuuaucagaauuuugccaguugaaagaaaauaaagcuaacccugguaagauccagcacagacacagguggcagcaaauuaggcacaaugaugucuggauuuuccucucaaaguggauuacccaugccuaggagauaacggcuugcaacgcaaaacaaacauuguggcauaaaacagacgauauuuaaauagauauauuuucuacagggauggcucuuaaguuggcuuuguuggaauuuuuucauaaggaaucucagauuaagacuuuugaaaccucucaagggcugggcacaguggcucacgccuguaaucccagcacuuugggaggcugagguggguggaucaccugaggucaggaguucaagaccacccugggcaacauggugaaaccucaucucuaccaaaaauacaaaaaauuagcugggaguagcaacacaugccuguaaucccagcuacucgggaggcugaagcaggagaaucacuugaauccaggaagcagagguuucagugagccaagaucucaccacugcacuccagaaugggugacagagugagauuccgugucaaaaaaacaaacucuugaagcaaugaagccaagccaaagauucgccaucagacugugccuguaaaaccuguaugaauugggugaauugcucucuuuucaacgucuccaaaauaucuugaggucccugggccugucagaaagugacauucuuuacuuauugcaaaguuagaaacgcuauaaaggaauugugugggcaagguaccaggugugucuuuuuccaagucuacuggcuguauaaagucaaccucaaucccucgaagcaguccgguugcacucaaaaaaaagacauuccagucaaagccuugguaaaauaaccacuguuuccauguguccaguuacaaaagaaaauaagcucuuuuuuuguuuguuugcuuuuuguuuuuuuguuuguuuguuuugagauagagucucgcucuuguccccuaggcuggagcgcaguggugcgaucucggcucacugcaaccucugccacccaagguucaagcuauucuccugccucagccucccgaguagcugggauuacaggcgccugccaccgcgccugguuaaucuuuguaguuuuaguagagacgggguuucaccaucuuggccaggcuguucucaaacuccugaccuugugauccaccggccucgcccucccaaggugcugggauuacaggcaugagccaccaugcacagccgaaaauagguucuuauugaacuuaugcaaauaacuauauugccagaaaauaagaacacuaaugaauaguuuccaaauucugaagaauucagguagaaagaaagguaaauguuuccauuuugcucacagaaguauacuuuaccccaaugcuguaagcuauaaauagcucaaaagaaaaaaaauauuuucuugagucuggaaaacaaaacauaaaaaaaaucaguaauguuucaaacaaaaacccuuuaaaauaguaauuucaauccuucauucacucagucccauguaauucucguucuccuugauguuggguuagcaaucugcaugaaugcaucaguuuuucauuagagcuuuggacuuuuuuuuuuuuuuuuuuuuuuuuugaggcuggagugcaguggcgcgaucucggcucacugcaagcuccgucuugccgcuucgcgccauucuuccgccucagccugccggguagcuggaacuacaggcgcccgccaccacgcccggcuaauuuuguuuuuguguuuuuaguagagaugggguuucaccguguuagccaggauggucucgaucuccugaccucgugauccgccugccuuggccucccaaagugcugggauuacaggcgugagccacugcgcccagacgaguuuuggauguuuuuaccuaguccaaaggugugaucuccaaaguuaucagaaaccuguauuuaagacuacuugucaaggucccuuucaugaauuuccuugaauacacagcacuucaggauuugcaaaaggcuuuuagaaaaaaaaaucagaauaaagcaauuuacugcauauaccaugacauaucagccuuuuauuuuuauuuucacuuuuuauuuuuggaguaauguggaacuuuuuaauuuggaaggcaaaagguuacaguuaauugaaggcagaagucagguuaauaaauguuacaaaguuguucugacagagagagggaacuucucugggcucuccuccacaccaaaucaguugguaguaagcacaaauuugaagaaaauucaugugucaaacaagcugccaucucaagaacucuuaacucuuauccaggaaaaucaaagugagcauuguuccagucucuuacucuucaauuaaguaaaugggaaugauucagccaacaaaguucaugacgauaagguacaagauggugcuagcaaagagaaagaagcaaagucucacuccaaggagaugcuuucgaaguccacuuuguucuguggguucaccuguauucucaggcaaacuacuaggaugaaacuccccacccaagaugugaaacccaagaggaaagaguugaaggggaagguccccaugagaagacaguaaguaaacugcagcgcccuagucagcaguuuauacagcagguauauauccagcaacuucagacacugcagaguagagcuaaguacucuucuaagaaccaucgggugccugacacuaccaacgcugacaugaauggaugcaagguaaccggccagugcucccuaggcucauagaggacccaacaaccacacuggauguccauaucagauuuuuaggaaucucauacaauguuggaacacauauuaacaacauauccauauaaauauaacucaaagaaaguguaacaccauuucuuauuuaacaacacuuccuguaugauuuuaacauaccaaauaagccucaugucucucuuggacuuccagggguccuauuuauuauuaauaauauauguuaauguauuauaguauuauguucaaguuaguuaagggcaaaaauacuuaauuuuagaauaugaaauuugauuuucagaaguauaucauauaucaaaaguuuaaaacccuugcuaucaaaauaaagauuuaagaccuauguucaaaauagaaucgcaagucacugugaccugaucgaggaccugggaacugacugguuuccuaacacauuccuguccuguguacuucucuggaaagucuuccuguauccccaagagcacaaguuuugcaugguagagaugcuaguuuaacauugcauguaauagacuaguuaugacacuugauuauuacccugcuuguuuaugugucagccuccaacugucuaggcagugacuucauucucuuuggguuuccagugcuuaguacacagucagauaaaugugugagccucgauaaauaucuacucaauaaauugauugaauauauuaaucuaccauguuuuugcuuaaauuaaaaauugaucaaugggcugauauauuuuauaacacaugcauacacacauaaguagagacagaaagagagacagagcagaaaauagauaccagcauaaagucaauuguguuaggcacaaaagaaccaaauuagauuuuaaauauggcuauuuauucaggcuacuuacugaacugccuuuaucugucuaugagauacuuugccuuuucuccuaacuuccucgcauuucuggauagacagugaaauguccgcaggacuuuucccaaaucuuauuaagccaugaguucugagcucauuagaagauuuuguuuuaagcuguagcuccauuguccagcuggguguaaguucuagcuuuauugucagauagacaauuaucuaguaucuaguagauaaagcuuggguaaaccaccuaaugucucuaaaccccacuuuaaugucccugaaccucggccuccuccccuguaggagucaaaaggaaaugcaaacuacugaacagaauaugucaugguuauuuguucuaacauaagguuaucaagcuuauagguagacccuauaauauaccaguaaaucacauagacucuggagugacauuggcagauuuaauuccagcaauaccacuuacuagcuuugcaagguuugucuaauuacuuacugauauggguuagcuaugucuccacacaaaucucaucuugaauuguagcuccacguguugugggagggacccaauggaagauaacugaaucaugggggcgguuucccccauauaguuucugugguagugaauaauugucucauguuaccugaugguuuuauaaggggaaaccccuuucgcuugguucucauuuucugucuugccaccaccagguaagaagugccuuuugccuucugccaugauugugaggccucccagccauguggaaaugugaguccauuaaaccucuuuuucuguauaaauuacccugucuuggguaugucuuuauuagcagcauaaaaauggacuaauacacuuacccucucugugcuuccauuucucuaucuguaaaauaauauuaauaauagaguuuuaugagaacuaaaugagauaaaucauguaaagccuauuucagcauccaggaagaucucaaucugugucaguuauaauuguuaaguugaagauucauauugagucuuuagaccuugugagguaauauggcauguuuggaagcugcguuauuuauaauuuuagagagaagaaugaauccacaggaacuccaccucucugcaaaccgcacucuguggcauggcuuaauuagaggccugcugcagggcugagaaguaaugcuugaccuuagaugcuccauaaauccucuuggcaaacugaccacuccagauuuuuauuuuuauuuucauuuuuuauuuuugggguagcauauuuuauuuuuggaguguuucuaccacuauacuaagaggggcuguuucccgaaaaacucucaaaccauuuuuccucugcucucacacaaaaacaaucaacacggaagacuucuggaccccaaaauauauagggauuucuccccagcaggaagcaagcaaucaguucugcaguggacacaagcuagguguccuccaauucagcuccaacacugucuacccagagauagcaucagauccacaaguugagggcucagucccacaagagcaccccguccuuccaaccagucauaaguucaggucucuggaacugcugaccaacagguuucaaguugggguugccaugacccccucuuccgguuugauuaauuugcuagcgugguucacagaacugaggaagacacuuacaucuaccaguuuaucacucaggauauuuuuuaaaauacaaauaaaagccaaugaagagauacaagguccaagucuggaaggguucugagcacaggagcuuuuguccucguggaguugggaugugccacccucccagcaugugaaugaauuuuugcuuaccuucccgugacccuccacguguucagcacaggaggcucacgggaagguaaaaaacacuucuuagaagcuccccaguccauucccuuuggauuuucauggaggcuucauuacauaggcaugacugauuaaaccacuggccauuggugaucaacuugaccagccccacucugaagcuaucagucaacacuaauauacaaaaagacagcacuuuggagauuccaaggauuuuuaguacuuguaugccaggaaacaggaacaaagaccacauauauguauuucacaauaucacagggacacuggcuuuuuuuaggccuuuccucagaucgcuagagcagcauacaggaaaaccaguuuuccacuaggguuccuuagauguucagacuuggugugauccuccagugaguuaaaacauaccuccuccaaaagucugauucauuuaucucucuacuuagaaaaaacugcuauggaaacucuuuuucaccaaugaugaugacauacauuuuucccaguaauguaagcccaauauaugccagucucaauuuacaagacagauacaucauaggaucuuugauacacauaccuaggaagaucuuugaauuacuuaauaaaacauucaggaauauucccuccaccccagagcugacaaggaacaacaguuauagaaaaauaguuguagaggcagugaauauuuaagauggguugguaccuuuuguuuuaauagcuuccauuagucacaacuugauaaacuguaacauuccuuucuaaaucugcuuccugcuccuuccucaccucugucauuuucugcagcagaauauguaguacacauuggcucuauaaauugccaggugcacaucaaaggaaagcaugaaaaaaauaguaaugaaaaaguaaaccucccaaaggacuucgucguuagauaagaaaacuagcacacaugugcacacauacacacauacacacacacauacacacuuuaaugaaagaacuagggguccugauaagcuggcacauaaaccuguuguucccaucaaaugaauaaucaaagauuugagaguuaauuugagugacugugucaguauuauuccaacaaagacaugagcacacacgcaaacacaagauuguuccuuuuuuuugagacagacucucauuacauuguccaggcuggaguccaguggcuauugauagacgugaucauagcguacuacagccuugaacuccuaggcucaagcgauccaccugccucagucccccaaguagcugggacuacaggcaugugccaccuugcccagcuacaagaugguuuuuaccugaagaguuaauaugauccguaauaauaaccacccacuguaugacucauccuacauccggccccuaguuucacacauauuucaccauauuuuucauacuuaaaacaacccuauaagguagauaucaucauuauuauagcaacccauuuuacauaugagaaaauuggaagcaguuuggugauucucuaaguugauucacaggacucaauacuuucgacuauaauuuauuacaggauaaaaauuauggccaggcacaguggcccaggccuauaauuccagcacuuugggaggccgaggcaggcggaucacgaggucaggagaucaagaccauccuggccaacauggugaaaccccgucucuacuaaaaauacaaaaauuagccgguguggcagcgcgcgccuguagucccagcuacucgggaggcugaggcaggagaauugcuugaauccaggaggcagaggcugcagugagccgacauggggccacugaacuccagucugggcaacagaguaagacucugucucucaaaaaaaaaaaaaaaaauuuacaaggcaaaaaucagcaaaaggaaaaggcacaugggacaaaggaaaucagacaugugcuucccagaguccucucccaguggagucacacaggaugcacuuaacuccuccagcaaugaguugugauaauauguguaaaauauuacuuacuagggaaucucauuagacacucagugcccaagguuuuuauguggggcugucauguaaacaccccuaccuagcacauccuaaaauuccagacucccagaaggaagcagauguucagcagaaacuucauuguuuguacaaauauuuuaggcaucgugagccauucuuuucagggaauggugagaacccuccagaaauucaaguucccagacaccagacaagggccaacuuugcaagccuuucuaagacuagcagccucaggccugcuuuaauucuuuucuacacaggaguagacugagaagccuuggucaacugugcagaagcagaggacggggcugucacugagcaagggacaugaagcauucaaguguguguauauauauauuuuagacagggucucucucugucacccaggcucccaggcuggagugcaguggcacaaucucagaucacugcaaccucugccucccaggauucuccugccucaaccuccugaguagcugggacuacaggcgugcaccaccaugccuggcuaauuuuuuguuuguuuuuuguagaguugagguuuugccauguugcccagccuggucucaaacuccugagcccaagcgauccucccaccucggcuucccauagugcuggaauuacaggcauaagccaccaugcccggccuucaaguauauuucuuaugcucaaaucagagagaaccaaacugaguaucaagaagauugauugccuugaccaaaguaacacaccugucugcagagggagagcugguacuagaacccaggucuucagaccacacagggcaauuaacaaauaucagagugaaaagcagaaucugcucaguccauccccuucucugccauuagugaagauacugaucaauuaauuuaauuuuuauucauacacuauaaggauuuauuaaaaaucaaacaaaacaaaacaauacaaguugauuuuucacagguggcuuuuuaaucugcaugauggcauaauuacagcacuagacauuuucaaccgauuaugucgauaauauacauucucguuuccucccuuuuuuuccccucagcuuucugacccauccucccuuuucuagagugagaagaccauaaauuaccaaugauuuauugaaaaauacugccuuugaguaauucuuaguaacuuguaagaaaauaacaguaacaaauuauaaugagaggagggagagaaagagaaccccuucuuuacacaagaaugcuacucaaugccaagaaugauauaauuagaucaguuaaugcuaaagucaucagaagaaagguugucagagaaugggauauuuacacagucucaaagucuugugccacaaauuacauauuaauuuaaaaggagaaaaugucccuuuacaagagugagaaaugguggcgaccaccuucaccagcuaaucaaacuuaacaugacuaaugcaggaaccaaugcauaucaugugucuuugaugcagggcaauuaggaguacacaaccucacuucaguguuauucuugccaagaauuagagccuggcucuaaucauaaagauaaaauuagagaaauucaggaugugaaauagccaaugagccugaauuauucaaaacaaugucauuaaaaaaaauagcagcaaaaacacacaaauauugauccguauuaaaagaaacauaacuauaaagaguaauauguaaacaaaacaaacacauuuugaggucagcuagggaaaauuauauaugaaccagauaugacaugaucucucugaauuaauacuaaucuucuuaggugugcuauguaggagaaugucccauaugaaguauuuagauaggaaauaucacaaccauaauuuauuuucauaugauucaguacuugggagaaagagaaagcauauagaaagguuaaccauugggugaauccguugauaaaugacggauucaaaaacaguuguuuuuugaaacaguaguucuuucaucucuacagagugaugguuaauuucaugugucugcuuggcuaagcuauagugcccaauugcuuagacaacacaaguucaaauguugcugugaaaguauuuuuuagaugugauuaccauuuaaaucagcagacuuugaguaaagcagauugcccucaaugugggagggcuucauccaauuaguugaaggccuuaacagcaaaaaagacggagguuuccugaagaaggaauuuggccucaggacugcaauugcaauagauacuguaccugaccugcccugcaaauuucagacucacgacugcaacaucaacucuuaccagaauuuccagcugaccaacuugcccuauggauuucagacuugccagcucccacaaucacaugaaccaauuccuuaaaauaaaucucucucucucgaucucuugauagauagauagaaagauuauagauauagauauagauaaagauauaaauauagauauagauaugcccuauugguucuguuucccuggagaacccugccuaacacaauagguuuggaaauugcuaaauaaaaaauugcagcucccccucccccucucccucuccccacggucucccucucccucucuuuccacggucucccucugaugccaagccgaagcuggacuguacugcugccaucucugcucacugcaaccucccugccugauuguccugccucagccugccgagugccugugauugcaggcgcgcgccaccaugccugacugguuuucguauuuuuuugguggagacgggguuucgcuguguuggccgggcuggucuccagcuccuaaccgggagugaucugccagccucggccucccgaggugccgggauugcagacggagucucguucacucagugcucaauguugcccaagcuggaguguaguggcgugaucucggcucgcuacaaccuccaccucccagccgccugccuuggccucccaaagugccgagauugcagccucugcccggccgccaccccaucugggaagugaggagcuucucugccuggcugcccaucgucugggaugugaggagccccucugccuggcugcccagucugggaagugaggagcgccucuucccggcugccaucccgucuaggaagugaggagcgucucugcccggccgcccaucgucugagauguggggagcgccucugcccugcugccccgucugggaggugaggagcgccucugcccggccgccccgucugagaagugaggagccccuccacccggcagccgccccaucugagaaguaaagagccccuccgcccagcagccaccccgucugggaaguugggggcagcccccgccuggccagccgccccguccgggagggagguugggggugccucugccaggccaccccuucugggaagugaggagccccucugcccggccgccaccccgucugggagguguacccaacagcucauugagaacgggccaugaugacaauggcgguuuuguggaauagaaaagggggaaauguggggaaaagauagagaaaucagauuguugcugugucuguguagaaagaaguagacauaggagacuccauuuuguucuguacuaagaaaaauucuucugccuugggaugcuguugaucuaugaccuuacccccaacccggugcucucugaaacaugugcuguguccacucaggguuaaauggauuaagggcggugcaagaugugcuuuguuaaacagaugcuugaaggcagcaugcucuuuaagagucaucaccacucccuaaucucaaguacccagggacacaaacacugcggaaggccgcaggguccucugccuaggaaaaccagagaccuuuguucacucguuuaucugcugaccuucccuccacuauuguccuaugacccugccaaaucccccucugcgagaaacacccaagaaugaucaauuaaaaaaaaaaaaacugcagacaaauuuuuaaaauccucacuuguauguuacaugugggacagaauaauuuuaaaaaacacauauaaucuccaaaccccaguucaacuauaaguuauaaucuuuucucccugauuaagauuuguauuugaaacaauagucauuugcuuugaguuaaauuucaucucuuggaugauaaugaaaugaguaaaaaucaaguuauaagaugucuguaaucccggcuauuugggaaggugaggugggagaaucacuugaacccaggagauggaggcagcaaugagacgagauugugccacuguacuccagccugggugacaaagugagacucugucucgaaaaaaaaagaaaagaaaagaaaagaaaaaaaucaaguuauaagagagaaacagaagaaugcaaggugaucuacauagacaagcuacauagcaauacuggaaaaaccuagaauguuauuuuuccuuaaaaaucuaccagugacuccaauuaaacaugguagacugaacacaugaaucuuucuccacaucuuuuuagauauucacuuaaacaaauaccauugucuuuuaaaguuuaaaccauaagggaaagagaaugggaaacaugauaaugagugacauuaacacauuuuggaagguagaaagcugacaguagagaaggaacuaacucuguagauuagaaagaacugaaacuguauugcacaaagaaggagauacugaugagaagccaccuuucccucaucucagaaagucucagaauagagaauccagguguuuccaaaggugaggcugaaaacagggacuuuugaugcaaaucuauauaaccauucauugaaugaccuugacuugggagaguacaaccagaaauaguuuuauuuuucucucauuacugcccuucacacccacuuucaaaaaucuaccaucccuaucuggagaagaucacacugauccuauugaguuuccagucacuuuuaaguauuaggaaaaucuugcugcaaguacuuaaaagaccgguaugaucuguaauaaaacuuugaccucacauugcauucaaugcuuuacugucugagcagccaccaccaccagcccccagcaagcugagguuguuaacaucuguaaaagaaaacaaaauucuuaaaacucucuaaaauuauuuauuaugccaagggagaaguuaaguacuggaaacugagucacauagcauguuugcaauucugcuucuuagguuauagauucacucucuucucaucguucuaguucuguaaaugacuaggagagaccagagaccagaccuucccccuucacugaucuuuguuauggauuaauggauuaacugccuccuuuauuguccuguaccuaacucacaccaguuggcacaaaagaccccaugggaugagcacaguagcccaugccuguaauccaggcacuuugggaggcugaggcaggagaauuguuugaguccaggaguuugagaccagccugggcaaaagggggaucuggucucuauaagaaauaaaaaauaaauuagccgggugugguggcacaugacuguggucccagcuagucgggagacugaggugguaggaucacuugagcccacaaaaucgaagcugcagcgagcugugauugugccaugccagccugcaauacagagcgagacagucucaaaaaaaaaaaaaaaaaaccaagaaaaacgaaaauacaaacccaugacuguuacaccuucagugugaaauguuuguuguuguuguuguuguuguuguuguuguuguuguuguuguuguuugagauggaguuucauucuuguugcccaggcuggagugcaauggugcaaucucagcucaccacaaccucugccucccagguucaagcaauucuccugccucagcuucccaaguagcugggauuacaggcacgugcaccaugcccggcuaauuuuuuuuauuuuauuuuauuuuauuguauuguauuuuuaguagagaagggguuuccccauauuggccaggcuggccucgaacuccugaccucagaugaucugcccgccucggccucccaaagugcugagauuacaggcaugaaccaccgcucccagcccgugaaauguuaaauaugccuuucucaaaugaaagugaccaccuugacuaaucagaucauuguaacuaggcauuaagccuuacacagaaagauguugaaauucuguuaagcuucccuaaacucucucucuauaaacaaucccaaacuucuaaaguucagaacgcugacuuccauucuuugggauccguguuucccuagcacuguccuuaaacuuugcacuugaauaaaguaucuuuaaacuagauucugacccuuuugauuauuuuagguuggcacauccaacagaaaugggguuccuguuuuuucagcauuggagcucaggacgcaccaucccaaaauaugaccagaauaugccacaucaggauaugcuuauuugauguauuuccaguuaguuauucugagacacuguagacacaggaguagcucugaaaaacugucuuuuuguaaacaaaauuuauaucuauaaagaaaaaaacuuugauaagaaucucaucaaccagggaagauuuuaucaccagggagaagauuggacagguagaccuugucacaggcuauuaccuauucuucugaugggggacucugagacaacuuuuaucaccugagagacuuuuuaucugcauaacaagacaaccuaugcuugcuauacacuuccucuccucacccucuuauaaccugucaccaccuccccucaauaagccccaagcccugauuccuuuucuguagcucaggaauacuauauaaacuucaaucaucuggccuuucuuugagucucauauuuuaugggacucccauguguacgcacaaaauaaauuuaugucuuuucuccuauuuaucuuucuacugucaguuuacuucauaaacucaguuaugaaaaggguaaagaaaguuuucucucucccacaucacuuuccucuccauucuccagcugcuguuuccaggacccacgggguuaaguguggaccaugaauuagaggaaaugguuaaaaaucucauuugucugugaccauuauaaucuggcacugggggcccucuccuauggcaaaugcccaaauucuggcuuucuauugcaucauggucacuuacggauucuucacaaccuccccucccccuuguccucaccuccuguggagaccacugccuugcacagccccacugcaaugaugcacauucugucucaccucuaaggauucuccuucaaccccagcucuggcauuauucccuacacagccucugaccccuggggucuccuugccccagcaaguagccuucuuagacaguguccuuuugagguguuucuaugacaccuuuccucagaguucacauaguucaugacgucuuugcucuacuaaacucuggaacugcaaacugcacccacugaagaccccucucuugacucuaaccacaggcagcaccagccagccuugacugucccagggcagagcugacacugcuauguuccguacaccaguggcacaagucaaguguucgcaagcuacagauccucuaggcaaagcauuucucacuuaauuuuuagugaaugcccuguugggggaaugggagaaucacuuuuuuaccucuuccaggguaaagaaguuuccagaaaugccaagcucuccuugcuuggcugacaauuuuuuauuuccaaauaaucuuauuuccuuucuguucaauuuccagccuucuauuaaauauaaauuggagauaaguuagaggcuaaagcuugcagaauuaguuuagucauccuuuagaagguucuuuagaugugucaaacguguuuggaauuuggagguaguaucccuccaugcuccgcacugaagccucaguggaacagggcccuuuuuuuuuuuuuuuuuuuuuugagauagagucuugcucugucacccagguuggaguacaauggcacacaaucucagcucacuacaaccuccaccucccagguucuggugauucuccugucucagccucccaaguagcugggacuacaggagcccaccaccacgccuggcuaaguuuuuguauuuuuaguagagacaggguuucaucauguuggccagacuggucuugagcuccugaccucaggugauccacuccccgcucagccuuccaaagugcugggauuacaggugugagccacugcaccuggcccaggaugcuauuuuuuuaaaggauuaaucagaagaaauaugaagaguaaaauuuuaaaauucaggggaaaggcugaaagauaacauugaugagaucuuucucccaccucaaaaauuggacacuaggagagaaaaauuaaauuagaagaucaaacaaggaggucuaaugucaaacaaauagaaguuuaagaaugagaaaagagggaaagcagaggagacgaaaucaucaaagauauaggaaaggaaaauuuucuaggaugaaugacuaaggacccauguuaugauaaagcuccccaaauuagcaauaaaaagagacccugaauaccucaaggaacaaaaaacagguuacacauaaaaaggaccugaaauacgagccccuuuggacuuccuaucaguaacacaggaaacuagacaacagaaaagcaauucccuuaaaauucugacgaaaaaucauuucuaaccuaggauauuauucaaaaucaaguauuaaccuagagcaaaaguagaacaaaaagucaggcauguaaggaaucaaaacaucuaccucugaugcacucuuuaucuaaaaacaacuagagcauacgugcaacacaaaugaggaaguaaaguaaaaaggagaacgccacacgauucagaaaaccggggauguaacacagagagaggguaaaagaugccaagaggaagucuuaggcaggcagcugugcagcuggcucagagagaaaccagcacaaauuagugcaagaaugagaaugguagcagaaagaguacagagacaaaaaagaaaaugaacugucagauacauuuaaccuaaguaaaauuacauugagaggcugucaggaaguugggaauuggaaagaauucauaauaaauauauaguaagguaaguaaauaaaaggaaauaaugcaagaauuaacugcaggaaaaacaaaaugagguauaaggggaaaaaaauguaaccauaguacacuacuugacucaccagugacuuuuaaaaauggaauuccaucuacuacucaaaaccucucaggggcauuucaccacacuuagaauaaaauccacacuuaccaggacuaaggaacuucaaugauguggcuccacuccugaaaucuccccucucagauuaugcucugggaaguuucauuugcuguuccauaugcaugggacacucuuaccuccagaccaugguacucaggugucagcugaaaguucaccuuuucugugaagcuuucccugaccagucaguauaaauuuguaccagcuuucucucaguucugucacuacugcaucauuucauuuuauucauauugcaucacugacugaaaauauuugauauguuacuauaugaggauaaauuguaauaauauuaguuaauacuuacaguacuuacauaguacuuauuucagaccagacccuguuauaagugcuuuauauuuguuuuuggaucuuuguugcagacugucuccuucuaucgcacaggcuggagugcaguggcacaaucuuaacucacugcaaccuccaccuccuggguucaagugauucuccugccucagccuccugaguagcugggauuacaggugugugccaccaugccugguuaauuuuuuugguuuuuuuguuuuguuuugagauggagucucgcuccgucgcccaggcuggagugcaguggcgcaaccucggcucacugcaacuucugccucccagguucaagugauucuccugccucagccucccgaguagcugggacuacaggugcccaccaccacacuuggcuaauuuuuguauuuuuaguagagacggggauucaccauauuggccaggcuggucucaaacuccugaccuugugauccacccgccucggccucccaaagugcugggauuacaagcaugagccaccacgccuggccuuuuuuuuuuuuuuuuuuuuuuuuuuuuuuuguauuuuaagcagagaugagguuucgcuauguuggccaggcaggucucaggcuucuaaccucaaguaacccucgggccucagccucccaaugugccgagauuacaggugugcaccacugugccuggcaacauguuauuuuauuuaauccucacaucauccaugagagguggguuguacuaauaccaccauuucauaaacaaaaaaacugaggcacaguuuaauaacuugcugguggucacucaauagcaaagcuggggcucacacaccugcaguccagucccaguuugugcucauaaccauguguuauauggccuuucccugcaaguugcaggagagcugcaacuuuaccugcucuucacccucugauaugguuugguuuggcucugugucccuacucaaaccucauguggaauuuuaauccccucacgccaggggaggaaccuggucgaaggugauuggaucuugggggugaauagugagugaguucucacuuaaguggcuauguuuucugggguauauaccccagguucauccucucaugccgggaaaauucagaacagacacacacagggaguuuaggagcacagguuaauaggcagaagaaggagaaaggaaaacagcccucucucuaaugagagagaggggacuucugagaggaaacaccggcggguggcgaaugcaccagauuuuauagucaggcuugaggagguggugucugauuuacauagggcucacagauugguucaaucagguaugauguucacauagcgcacugggaaggcuggucaccccacccuaaucuuauuaugcacaugaauucuccucuuggccggcaccagcuugucugcuccuuacuguacacuuggcuggcagagaagggaaaauggagccgccaucuuaacgugucugguuccuaguuucugccggcauucacccgugcaagcucccagcuugcuugucuauguguggggcugcuuuucauuuaaaagaaaagccuuaccaaggacucccguacccucacuaucuaccuaagugauuucuucuuaacuccuauaucaucauaagaucugaugguuuaaaaguguggcacuucucccuucucacugugucuccugccaccauguaagaugugccuugcuuccucuucaccuucugccaugauuguaaguuuccugaggccuuucuggccaugaugaacuguaauucaguuaaaccucuuuucuuuauaaaucacccagucucagguaguucuuuauagcagugugaaaacggacuaauacacccucacagccucaagaccuugagcagugucugaugcuuacauaaugaguacuccucaaauauuuguucaauaaaugcauuauaagaaucucaguuauccugaggcaagagaaaagaagaggguacaaacuuuucuuuuuauuuuuuugagacagaguuuaacucuugucacccaggcuggagugcaguggugcgaucuuggcucacugcaaccucugcucccagguucaagcaauuuuccugccucagccucccaaguagcugggacuauaggugcacaccaccacgcccagcuaauuuuuguauuuuuaguagagacaggguuucaccauauuggccaggcuggucucgaacuccugaccucaggugauccaccuguuucagccucccaaagugcugggauuacagggggauacaaauuuuuccuccuuggcuaucaguuguaccacuugccacaucucaguuuuuuccacauuuugauaccagcugcucugguucuuccaguuuuagggucucuugaucaagauauugugguuuccucucuagaaacaggcuccauaacauucuucuucuucucucucucucuaauuaagcuauugcuguauuagcacuuguaagcuacccagugacugcaggacaugacugccucaccuucuagucugugcccaaggugaaauggaugugguagugauucuuccacagaccaaguggauccagugaguugccuauaggacauccagaagacucacugacggaguguugugggaaagagcagaaagcuagaaaccaccucucauuggaucuuuaguccagagaggaauccagcacgcaaaaugcagaaaaauaugauuuguccucacguggacaugaagccaaggcauucuggagagagucagggauauggucagagagcuuagguggccaggaaagagagcucuacauguguuuccacuuauggaaucaaggaacucaauacaaagucccaacagaaucaacucauuccucucuauuuucccauaccccgucagaccccuaguccaagucaccaucaucucuucccugcaucccugccacagccccuaaccuacgccacaaggaacucacccuuggcuuccucuccagagcacacuuuccugacaaugaaucuucuaauucuagcaucuuuuacaaaccagguauccugagaauuucccaagucaucaugucuuuguuccuuuuucuuaacaguuccuaccucaauuuaucccuuuuucucgggcauuuuacuauaaaacagcaagagaaaaccaggcuacaccuucaauacuuuacuuggaaagcuaagccaaauauccaaguucaaacaaauucugcuucccauauaacuguaagacacaauuccacaguuucauuccacuguaugacaaggaucuuuuuccuccaguuucccuaaacaugguccucauuucuuucucagcccucaccaacaacacauuaugaaaaccuacacuucugccaaccuucuacaaugacuuugauauucucuaaaaugaaacacauuuucuuuaccaugcucuucacuuccaaguccucaccagcagcgccuuuaacaucccuacuucuacuaacagucuuucuaaggcaagcuaggcuuuuccuaucaugcuucucaaaauucuuccacaugcugcccaacacccaauucaaaagccacuuccacauuguuuagguaucuguuacaguagcacaccauuuccagguaccaaaaucuguauucguguacuacugcuguuguaacagaugacugcagacuuuguggccugaaauuauacaaaauuauucuuuuuuucugacgaagucucacgcuguagcccaggcuggagugcaguggcacaaucuuagcuuacugcaaucucuaccucccggguucaagugauucuccugccccagcuucccaaguaguugggucuauaggcgugcaccaccacaccuggcuaauuuuuguauauuuaguacauacaggguuucaccauguuggccaggcuagucucaaacuccugaccucaagugauccacccaccuuggccucccaaagugcuggaauuacaggcaugagcccagccucaaaacuacacaaaauuauuaucuuaugguucuggaaguuccaaaucaaggugucagcagagcugcauuccuucuggaggcucuagagugagaauguuuucuuggcuucuccagcuucuacaagccaccugcauucuuuggcucauccuuauccucagaucaaguaauggagcucuuuaaaucucaaucucucucucucacacacacacacacacauacacacacacauacacacacaccccuuugcuuccacuguggcaucuccuucucugauucugcuuuugacccucugccucucucuuauaaagacgcuacugauuauauuggaccuauuuagauaaucaaggauaaucucuccaucucaagauccauaacuuaaucacaaucugcaaaaucccuuuuaccaugaaagcuucuggggaugaggcuaugggcauccuugggggcuaugacucagccuaccacauucaccaacccccuauuaugggccaagcauuggacgacauaugguugcacagugguaaaaaaacuggauaugcucucugcucucaagaaauguauggucuaguggaagagucagauaucaaucccaaagucauacaaauaaucaccccaauacaaucauuacaaguugagaugagggcacugaaagccugggaaacaugggagucccaagggucucuuugaggaaguagcauccaaucugagguuggcagggcagggugauaaggcaccccuggauggggaaucagaagaagaccuuccaggcagaggcaucagcaagugcaaaggcccugaagaaaaagaguuugggggaugagggagguggaaacggcaaaacaagaugaggcuguaaagaugagaaggaccagaucccuugggaacuucuggagcaugguggggacuuuagcuuuuauucaaaacauaacaggaagagguugaagagguuuuuugcuuaauaaaaaauuuuuuguugguuuuuguuuguuuguuuguuugcuuguuuuugagauagggugucacucuguagcccaggcuggagugcagugacgugaucacagaucacuucagcuccuccugugcucaagugauccucccaccucagccucccaaagugcugggauuacagugcuggggcugugagucaccaugccccaccggguugaggaguuuuuauagcaggugacugaugugaucacucugcucuggagaacaaauugugucugggaaacaaauggggaugagaaaaaacaggaacacauauauucagugaagagaagacaguggccuaaacugggcacaugguuguuaaaauagauagcacugcauagauguaagauaggucuuggaccaaaaaugacucauaggacuugauggaauuuggugugugauucaaaggucugggauauggccauagggguagcuggcauaugaggaauguagcaaauuaauggaaaugagaaauuaaagggauuaagaugccaggaaggggaaugggccauccacaugcaccuuaaaauaaaugggaaaacagcacaugggagggaagagaggagguaagugcuaaaaucuacaguggauaauggggccagagggacuggggugucuuccaaugaugguuagaggaagagagagcacagacuccuggucugaguagcagagagcagaugcuaugcaaggagucucauguggaaacaguacugggcagggugaagggcaucagucccacuccagcccuggaugagggacagagaaaaugagcagcuuccacuuuaaaggcuggcagagaaaugaccucaccuaagaccaggaggagcaggaaacccuuagggaagauaaaguguagugcgguaauauugguugcaaagguuauugggggcagauuugagugggagggucuacugugggucgaguuaagagagaaaaugcagagcaucaagagagugaaggugauggggacaauguggaaacagugacaaggggaauuuaacugggugcuggguugccaaugcuuuaagucccagugguguauucccugggggauguugggugcuuaggccucucuguauuuaccagugggcuggaagggaaccccagcaugcuuuuccucaaggucuucuaugauuagggaaugagcaagugagucugagcccaggaguaugggguuguguacaagugcucuuacccccauguucaucaggucuucuuucgugauucugcuuaaaugucaccucccaauaaagccuuuccuaauuuuucugacuugucuuuuccacauacacagaaccuugugcagacuucuacuguagcaccuacuauaugcacauuauugccuuugcuauuuauuuauuuauuuauuuauucauugagauggagucucgcucugucacccaggcuggaguacaguggugcaaucucagcucacuguagccuccaccucccagguucaagcaauuaucugccucagccugcccaguagcugggauugcaggugcaugccaccacacccagcuaauuuuuguauguuuaguagaaacaggguuucaccauguuggucaggcuagucucgaacuccuggccucaagugaucugccugccuuggccucccaaagugcugggauuacaggcaugagccacugcacccagccaccuuugcuuuuuauguauaucucccuaaauagaauuguuucucaagagugagaauaaugcuugaauuauuucuguuuuccuguuacuggguacaaagucugguagccuugguaggagcuacacaaaugucuaauuaaguaaaacuuagccauuguuugcuggucauuauuguacuauauaaaugguagauuugaagaaaaguuuagacacucuucauauaaugguuacuaugaaucauuauaauguguauacuaugaaguauacacauuacauuuaacuugcuuucuuaauagauaauuuucaauuaguuaaauuaaauacaacacuucggaaauacugucaaaaauauguuacuggucuuaacuaaaauuugcuuaaauggccgggugcaguggcucacgccuguaaucccaacacuuugggaggcugaggcagguggaccaccugaggucaggaguuugagaucagccuggccagcauggcaaaacuccgucacuacuaaaaauacaaaaacuagccaagcaugguggcaggcaucuguaaucccagcuacucgggaggcugaggagaaucgcuugaaccugggaggcuggagauugcagugagcugagaucacaccacuucacuccagucugggcgacagagcaagacucugucucaaaaaauaauaaaacuaaaaauaauaaaaucaaaugugcauagguaccaguauuucagauuuucuugauaaugacucuggugucaagcuaauuucauuaaaaggcuucaauuuuuuucauucaaucuugauuauaauaaacucacgugucaaaaaucaaauauauaaauauauacagugaaaaggcucacgguaacuuucuuuuuaucucuaccugagagcuuacugguucuuuccucaauuguuuucuuuuaaugucauuauuuuuuacgccuaaugacuaugcaaaugacuuccacucuuuguaaucacaaacaaugcugcaauaaauaaucuuguugauaagucauuucacauguguacaaguuaauauaaggcacuuuuaauuaaacuaaauauuaacaaugauguugaaucauuaaaucuauugcaaacuaugcaguuacguuaauaugguuaaaacaaucccucauuucaagcuucgaaguguuguccuugaauaucaagugguagacuaaaguacuccuguacauacuguucuaagaacauugaucaaaaggagggaaggugccaguuaaccagcaaauacaacauuaacacacucaguuauuaaggggcauaaacuuuauugacauccuacaucuauauauucauggaacuacugacaauauuaauaaaauauuugcucuaauguuauugaauuuuuaaaagccaguuuaguuaauaucaugcuuuauaaccaaguaaugguuauauguuauaugauuaauguuauaugauuucuuuuaaauaagcauaaagaaucauggaaaacuaucagcagagccaaccaugaauaguugauguguauaaccaaaagaaaaaggaaaucaguuaucaggagacuuucaaaagugaauauaguaggugccagaacucuccacagggaauuugagaaguccuauuucucgaggcauuuaaauggaauagaacugaaagcuagaaaaauaaacucaaaagaacaauccuucuucagcagaaguaaaagcccaaaaugaccuaauagauuuuuucuuucaaaauucuaggauucaaugaacacugcucuaaguaccucuuuuguuggauuuguuugucaggguaugcauucauuaguuugcuuaaaaacugcauuguuugcaacaaagaaaaacauguugaacaguauuggaauugguuaagauucccaaacacaugacuuuguucuauauucuaagaccauuccaaggauguuucccuuugcauacugccuuaaucugaaaacuagugauugaacaggcuggcauuacugaguuuguucauuacgauuuuugugguguucaguuuauauuccuauguagcaucuuuuuguaugaauuuuccuacaaucaauuuaaaaucaaccagcuaugugaguuuuccaguagacauauauagcagcuauaugaguuuggcaaugggcauuaagcuacaugaguuugcagcuauaugagucuggcaauaggcauuaauagcagcuauauguguuuggcaauaggcauuaagaccguguaaauacuuuacuguucucuguguuuuuauaauccucugucuuuuggaagucaauuaaagcuuuaacuucaaagaaauccaaguguggaaagauguaugugccauucaaaaacagagaaguauaaaacagaaucaauuaaucugaaucuugaaaguccagaaauaggcucucgauuuaacucaaccaauaucuguaaagcaccaacaauggugcaagguuccugccaugguagaagaaaagguaagugcagaggaguugcagcauaugaucaauaucuuuuuggggcaagguucaugcuacaacagaggaaaagguaaaaagcacagucgaauuaaagcauugaucaguaucuuauuuccugacuucaaaauguaaaucuaugcauaccuucccaccuuucgcccauguucauuccacugcaaaaacaugaucacuguucucacaaggugucuggggagugggcugcauggugagcaacauggugcaaauuauagauaggauggagggaguuaaaaaccaguaaaugcaaauauaagaacacauuuugagauagaucaaauccucucuuaugacuagagaaaugcaugcacauagaagagguguagguagauuuuaaacggucucaugcacuaaacuaaacucaggagacaauggagaagccauagauuuugcgugguggaaugacaucgaacagcacauaaugaaaauuaagcuucagaccaguugggagacuuuuggaauaauucaagcgagaaguaaugagagcauaaaccaguaugcagggcaaugggaaagagagaaccuauagauucagagaagacagaguccacaggacgugguaccugcuugaauauguggaauaagagaauaagaaagaaguaaaagauggcuggcugggcauguaaucccaguaguuugggaggccaaggcgggcggaucacuugaggucaagaguucuagaccagccuggccaacauggagaaaccccgucucuacuaaaaauacaaaaauacaaagccaagcguggucgugggugucuguaaucccagcuacucaggaggcugaggcaggagaauugcuugaacccgggaggcagagguugcagugagccaaaaucacaccacugcacuccagcgugggugacagaacaagacuccgccucaaaaaaaaaaaaaaaagauggcuggacuugggccaaauauacacccuuguuacaaucagcuguggcuaagguggagucaccugcaaagaacauggccauacuggccuucuccuuugacagguacaacagguaggggaaguuaucuaagugggaaguaggaaggcuaggcaccccaaacuccuacacuccacuaagaaauugcauauuaaccuuggcuaagaaaacacccacacacacuuccaaacuaguugaagaucgaagaaauuagggugcauaugguaugaaccgaguucuauucuguaacuauacaccuuagaucuugaugggaugaaacagagaagaaagugauaacuuaugugcugugaacaaacaaaccauugguuguuuaucucuugaacuaaaaguggagauuuucaauauucaaauggcagcgugaagcuucugcuuauauaguuucauaucucagcugacugcaaaggcaagagccaauagcccuccacugcucugaauaacuaaaccauuucagucuuuucuaccugucuuccaugcuauaugcacucuauuguccuggcuuuaauaaccaauaauuuagauauaaaacuuugugucuauauguguuugcacauuuugcaaaagauuggccauacuuuucauaagauuuacaaacuggcccagugcagugacggaugccuguaaucccagcacuuuggaggccaagguggguggaucacuggagcccaggaguucaagaccagccagugcaacauggagaaaccccaucucuacaaaaaauacaaaaauucaccgggcgugguggcacaugccuguggucccagcuacucagggagcugaggcaggaagaucacuugagcccaggagguugaagcugaagugagccaugauuguaccacugcacuccagccuaggugacagaaugagacccuaucuggaaaaaaaaaaaaaaaaaaaaaaaaauuuacaaaguggugucagacccaagaaagccuagaaccuggagagaucaauagcacaauagacuaggagucugucuacuuucucauuuugcucuuuuauuuguauuauuuauuuauucuuaagcaauucuaguaaguuuucugaugcuuuccuuagaagaauguuuucaguuaaaguaguuugaggccgggagcgguggcucacgccuguaaucccagcaccuuggguggccgaggcgggcagaucacgaggucaggagaucaagaccuuccuggcuaacauggugaaaccccgucucuacaaaaaauacaaaaaauuagccgggcgugguggcgggcgccuguagucccagcuacucaggaagcugaggcaggagaauggcgugaacccaggaggcggagcuugcagugagccgagaucgcaccacuguacuccagccugggugacagagcaagacuccgucucaacaaaagaaaaaaaaaaaaguaguuugcauggcauuuagaaaauggaaagcaaaagcaccaauuaagcaaggaagucuugccucaaaccugcauguguuucuucuauaaacaccagcacuauucuuauaaguguacagagcacucaccgacacugaaaaccauggaacccugagucauguauuaugcuuccccauguagacuucgcagcugucuuuuaacucuaccuuuuaucuucaaaguucaaggaaacauuuauuaugauuucaaauuccugaacucacaucuaguccuaaagucaaaacaauauaacuugguaucuaaaucaacugaaaugaaaugaaaugcacuuggcaaaaucacccuuuuauguagugguggaaugcuaacaacugcccugugaccauccugugcaaauccacccuuggccucaucccaggauauacccaaacuucgucucaacugugucucuuugucagucacguuaagagacagcuguggaauguuuggucuagaauaucccaacaggugcuccuuccgucucaacuucuauggagucaaauagaauuugaucuguaauccuaugucccaggcuuccuaagucuuccuaaagcagauauccauuuauagucaaaacagcaaaaacaguucucacacugagggauaaaccguaaaugcaauugaugaaacauucaaaucuacacaccgaaauaaagaacugacaaaugaauuuguucuuuuuagauuaaagacuauucuuaauggaacuagcugaguuuugcaaguauuucacaacuuucaauaagaaagagccauauguuuuucaguaugacuucaguuuauuacuuguaauuuccucuauuuuuuucuuuauuggucuucccuguuuccauucuuccauuuuccuguauuuuugggacauaacugucucuuucuuuuagaguuuguuuuucccauuaauuacugaacacaagaaaaauguuuugcaaaauagucuuucccaccaaaaagguauaacaguagaaaaacguuuaugugacaugcuaugcuguauucauaagguaaucuaauuuccaagcuauuuuaaggauaugaguacucaauuuuuaggggaaagauaauuuagcuuuguggacuuuagagcacaaauuauaagcauaguugaaacugauaccugaaccugguguuccagaaaagacagauucuccuuugcguucaccauugacauugugagucacugacaaggucuuaugaugaaacuguuuaccaauauuugcaaagucauguuuaugaauaaaagcaccuaaaugcuuaauuuugaaacauuuaaaaaaugugaguugcaccucacauuuauuucuuggcugaacugcauacaaucccauugcaguggccuuaguugaauggacagaggcucaggaaaggccaacaguaggaacauuuaccauauguuaggugaaauguauagaccaguuggacagcuguuaaggggauaauguuacaauacaaaagcugccuauauuuuugacaguaaaaugagcagaucagccauaguuuccuccugugcucaaaaagaaugauagcacaugccuguaaucccagcacuuugggaggccgagaugggcagaucgcuugaggccaggaguuccagaccagccuggccaacauggcaaaacuccgucuuuacaaaaaaauacgaaaauuagcugggcauggugguaaucccagcuucucaggaggcugaggcacaagaauugcuugaaccuaggaggcagagguugcagugaguagagaucacucugcggcacuccagccugaacaacacagugagauucugucaaaaaaaagaaaagaaaaaagaaugauagcaucauauagaaaguagaggauagcuggcacaauuaugucuaucauggaaggucccagauucucacucuccaguauagcaaccaaaccuuccugagcauaaggcugaucaugccacuggguuucccuggggugggcaucuguuauuuaaagaaacugugguuaccaacacuaaagggaaauaaagaaaguucuuuauuuuccaacuuccuauaccaguugagaagaggccauuuaaagaagcuggcaaccugaaaccccaaaagauguaacuaauacaaaggcucaacauagcugccauuuagaaacaaucuuucauuuaugcacaggaauaauuuacucauaagcccagcccucucaguuagguuaauaacaccacuaucaguuuuccagcuguuuacuucccuagcuuuauuucuagacaugagaaauaaggaacaaaauauauaauuaggaaaacaauuggaaugucagccuacggacaaaacugagacaaaauuuauauaaguagagaguauauugaggucaaauuugaggacugcaaccaacgaaacaccaaaucaaguugcccugaauauauacagcaguuacaaguggguuuuuaaaagaaaaaagaggcaguuucuaaguugagaagaauuuauauuaaaauaacauaaacuauauaaacuauugauaggcuaaacauuguuuuuuuguaucacaaauuccaggaacauaaugagugaggcaguuagucaggaacaaaaugucuuuaaauaauuacuccugcgcaugcguacggggggacgugacugaagucucacacuccuaucucucugggccugauaaauuguguagccuucacaaagcucagaucgcucugcgcuauuuuucuuuuuucagggaguugcacagcuacugacagaaagcacaucuugguuuuaguccauaguacaaaacucaauugugaucgaauguuuucaacuuccuuucauaauaagguuuuaaacucauuucaaauaauuagaucugguucuaaugagcugaaaagcaagagaaauucuugcguaaaaaaggaaaaauauuuuuccccuuuucucucuguaguucugaaauccagugaaauuacucauuacugaaacuuaucagaugaaaauauuggccagcauuaaauucuuuuccuccccaacccccaccucuuuuuuuccuuuuucuaaccaccacccuuuuguuaggccagcuuaacuagcuuuacaucucugagccuagccugaggggccacauccugugucuggaauguaaaaccucucuccccacuaggccucccgucuucccuccacacacacacacacacacacacacacacacacacacacacacacggacuucccuugccuccaaucccauuuacauguguaucauuuuuaaauccccaucuaaauuuauuaagucauaauacucacuuaccauuuuuguacacaugcuacucaguguauauccuauguuucuuauccaaguugcccauucugcaugugucugucuuaaaauacaagcucaugcaugacuuaagcccggagaauuugcugaggacaaaggcaaucaagaugccaugugcaaauaacauuuuuuuaaaaaaucaagcuugugauagcaauacauauuuaagagauaaguggaaagauguuugaaauauugugauaaaacuaacuuaauggaaccuuccauacuucuucgaucauaccuagaauacaaucauuucuuucuuaaucuuaggaaauaucaggaaacagaaaagagacuacuuguagauaucuuaccuaguuccccauguuauaaaaguaucuuguggaagggacagggguuuuuggaccuacaaaaacgcguaauuaaccacaacugcacauggacaggaaaaagcuggaaaagcaagacuguucauucuuaguuuucuccuuuuacuuacuaaagcuauaaucaacuaaaguguguuuuucaucugaaaugaaacaagcaugaggaagccagaaauagaaccucuaacuauagaagaaaaguugugugaucucuguugaauacaaaaacgcauaguuuccacucgguuacuguuuaauuguagugaaaguuuuuguuuggcaacaaaggcgcuauuuacauauuauuucuucuaagugaaacuauggucugggauggguuguagauaagagcaguugagaaccacgcuucaucucccuccuuagaaacucugaaacgaggcuuuauuccuaccagaaguucagauugcauuauggucaucucaauuccaaaauguuagauggcaagaauaucugcccauccuucacuuuccuuggaaaaaguugcucuucggguuuuauaugcgauugcaguuuuccagugugugaaacuaggaaaacaaaacacucaacgguguacaucccuacaccuaaauagucagaaauaauaggcagcuaggcuaauuauccuugauuagcaagaucagagccauuagggugcucacugguuuaacaaaugaaugcccuuaggcgucuaucauuuguaacuccuagaagcuuuaauuuccacaagaaacaaaauaagaggggccuucugcuuuuaacagugaaaagaucguucucccuccccucuccacccgggucaacucuuccagccgcucccuccugcaucacgaacacacgcugcaggaaagcgcauuuacagcccgggacauccccagaccuccucuccaaaauuccccaccuccugugcauaggagaaacugagagaagcccucacuuccuuuccaaacuucacaagcaggggagggagcuguagcagacuuucaccuccguucccaaaagcgaaugugaaaaaguccgagaaggcacguccugcgaguggagguuaaaccgaaaucugaacagaaugcacgguccccgcaaacuacgauugauaaagaagauacugagacguuugcgggggauauaagccaugguugucucgccuuccuccccucccugccaacuauguuucuuggagaaaucgccgguucgauucacgcacacauuuuuguaaaacacggacaaaaccauaaguaguuaccuucauuguuccgucggccacgagggaagcucgagcugagcggagggcagaucccaagggucguagccccuggccguguggaccgggucugcggcugcagagcgcggucccggcugcagcaagaccuggggcagugcccgaggcggcggcgaguacacguggcgggcuggauugcagaccggcccucucgcggcggagacucgcgaccuagcggauugcaucagcaggaagacacuaaggcugcucccccaggccgcccccagaugguggagucucucccagcccgaagauucggagccagcgcccagacccgagccucacucacugcucacucccggggugcagggcagaggugccaguguugcaagcaaaugacacgguuacccccgaaucagccacugugggugcguauccgaguguggggaugcccguguaacauuuauauggagacgucaaggaggaggaaauaaacagaucagaggucaaaugugauugccauuccgucaucacuggcuccugcccaccucccuacu
